United States Patent 9,216,205 (MODIFIED POLYNUCLEOTIDES ENCODING GRANULYSIN) - sequence listing, part 4

SEQ ID NO: 2806 - DNA, 6644 bp, Homo sapiens
cagagatcgcgagcgaggcaccagcctgcagccggcccccagcacatcctcagccgcacagacactcggcgaggtggaggtgagggcgggcgccagcgaactcggagaggggctcgctcactcccaggcgatcccagccgccaccgccgccgcaccagcagcagcaacagcagcagcagcttccttcctcagactcccctcgagaggctggccaagcgggtgtagccgttgggggaggctcccgccgggggaacccggcgaggacaagagcagggcggccgccttccactcgggctgtccggcggcggctgcctccgcccgtgtgtccgtcaagggtgccgcgggatgtgtgtcagtttacgcctctgagatcacacagctgcctgggggccgtgtgatgcccaaggcaagtcttggttttaattattattattatcattattgttacgcttggctttcgggaaatactcgtgatatttgtaggataaaggaaatgacactttgaggaactggagagaacatatatgcgttttgtttttaagaggaaaaccgtgttctcttcccggcttgttccctctttgctgatttcaggagctactctcctcctggtgaggtggaaattccagcaagaatagaggtgaagacaagccaccaggactcaggagggaaacgctgaccattagaaacctctgcataagacgttgtaaggaggaaaataaaagagagaaaaacacaaagatttaaacaagaaacctacgaacccagctctggaaagagccaccttctccaaaatggatatgtttcctctcacctgggttttcttagccctctacttttcaagacaccaagtgagaggccaaccagacccaccgtgcggaggtcgtttgaattccaaagatgctggctatatcacctctcccggttacccccaggactacccctcccaccagaactgcgagtggattgtttacgcccccgaacccaaccagaagattgtcctcaacttcaaccctcactttgaaatcgagaagcacgactgcaagtatgactttatcgagattcgggatggggacagtgaatccgcagacctcctgggcaaacactgtgggaacatcgccccgcccaccatcatctcctcgggctccatgctctacatcaggttcacctccgactacgcccggcagggggcaggcttctctctgcgctacgagatcttcaagacaggctctgaagattgctcaaaaaacttcacaagccccaacgggaccatcgaatctcctgggtttcctgagaagtatccacacaacttggactgcacctttaccatcctggccaaacccaagatggagatcatcctgcagttcctgatctttgacctggagcatgaccctttgcaggtgggagagggggactgcaagtacgattggctggacatctgggatggcattccacatgttggccccctgattggcaagtactgtgggaccaaaacaccctctgaacttcgttcatcgacggggatcctctccctgacctttcacacggacatggcggtggccaaggatggcttctctgcgcgttactacctggtccaccaagagccactagagaactttcagtgcaatgttcctctgggcatggagtctggccggattgctaatgaacagatcagtgcctcatctacctactctgatgggaggtggacccctcaacaaagccggctccatggtgatgacaatggctggacccccaacttggattccaacaaggagtatctccaggtggacctgcgctttttaaccatgctcacggccatcgcaacacagggagcgatttccagggaaacacagaatggctactatgtcaaatcctacaagctggaagtcagcactaatggagaggactggatggtgtaccggcatggcaaaaaccacaaggtatttcaagccaacaacgatgcaactgaggtggttctgaacaagctccacgctccactgctgacaaggtttgttagaatccgccctcagacctggcactcaggtatcgccctccggctggagctcttcggctgccgggtcacagatgctccctgctccaacatgctggggatgctctcaggcctcattgcagactcccagatctccgcctcttccacccaggaatacctctggagccccagtgcagcccgcctggttagcagccgctcgggctggttccctcgaatccctcaggcccagcccggtgaggagtggcttcaggtagatctgggaacacccaagacagtgaaaggtgtcatcatccagggagcccgcggaggagacagtatcactgctgtggaagccagagcatttgtgcgcaagttcaaagtctcctacagcctaaacggcaaggactgggaatacattcaggaccccaggacccagcagccaaagctgttcgaagggaacatgcactatgacacccctgacatccgaaggtttgaccccattccggcacagtatgtgcgggtatacccggagaggtggtcgccggcggggattgggatgcggctggaggtgctgggctgtgactggacagactccaagcccacggtagagacgctgggacccactgtgaagagcgaagagacaaccaccccctaccccaccgaagaggaggccacagagtgtggggagaactgcagctttgaggatgacaaagatttgcagctcccttcgggattcaattgcaacttcgatttcctcgaggagccctgtggttggatgtatgaccatgccaagtggctccggaccacctgggccagcagctccagcccaaacgaccggacgtttccagatgacaggaatttcttgcggctgcagagtgacagccagagagagggccagtatgcccggctcatcagcccccctgtccacctgccccgaagcccggtgtgcatggagttccagtaccaggccacgggcggccgcggggtggcgctgcaggtggtgcgggaagccagccaggagagcaagttgctgtgggtcatccgtgaggaccagggcggcgagtggaagcacgggcggatcatcctgcccagctacgacatggagtaccagattgtgttcgagggagtgatagggaaaggacgttccggagagattgccattgatgacattcggataagcactgatgtcccactggagaactgcatggccacagtctctgcaagtatagtggacatcccagaaatacatgagagagaaggatatgaagatgaaattgatgatgaatacgaggtggactggagcaattcttcttctgcaacctcagggtctggcgccccctcgaccgacaaagaaaagagctggctgtacaccctggatcccatcctcatcaccatcatcgccatgagctcactgggcgtcctcctgggggccacctgtgcaggcctcctgctctactgcacctgttcctactcgggcctgagctcccgaagctgcaccacactggagaactacaacttcgagctctacgatggccttaagcacaaggtcaagatgaaccaccaaaagtgctgctccgaggcatgacggattgcacctgaatcctatctgacgtttcattccagcaagaggggctggggaagattacatttttttttcctttggaaactgaatgccataatctcgatcaaaccgatccagaataccgaaggtatggacaggacagaaaagcgagtcgcaggaggaagggagatgcagccgcacaggggatgattaccctcctaggaccgcggtggctaagtcattgcaggaacggggctgtgttctctgctgggacaaaacaggagctcatctctttggggtcacagttctattttgtttgtgagtttgtattattattattattattattattattatattttatttctttggtctgtgagcaactcaaagaggcagaagaggagaatgacttttccagaatagaagtggagcagtgatcattattctccgctttctctttctaatcaacacttgaaaagcaaagtgtcttttcagcctttccatctttacaaataaaactcaaaaaagccgtccagcttatcccatcctctgattgtcttctgacttaagggatttactgtggtgtaggttctgccagccaaccctacaagctgccatttccagtcctagcatttaagtaggatgttgttgcctttaacttttcttatccaggggaaaattgccattttagggtcagcatgaacagctctttcttgtatgcgatttaaaacaaactggaaaggaaacttcacacgtcaaaatccatagaagcgcctggacgaggcttaaagtgctttgtgagtgaataggagccattcgctaattctagacccacagtgtctggtggtggggcttcccttgtggggcttctggtggtggttttgccttttcttttccctcctccatgttcttctaaaacatatacatatatacatacacacatacacatattcttcaggtctctaagcccctggaagcagcattgtgtgatattctcagaggcaggggaaaatagagggaaaaatagagactattggtatgttctccccatcagcgagttattgtaactggtcaccactggacgggaaggagaacagaggagagggaaagagaagcccaacctctgtgatcatatgagggccaaggctgagcagtgtagacagagaccctttgaaatgcatttgtctctcaaatagactagtaaacaccgacttctcctttgggttacaaacaccatttcaacctttcgggagagtcagagctaggatgtacaagaactgattctaaccagaagtccgcaagtactgtggacaagaatgcttaaccatgctgcttcagccttgagagacctaggttcttacacatatgcacacacgcatacacacatgcacgcacacacacatacacacatgcacgcacgcacgcatgcacaccaatttatgtttttattaagtgccttgaaaaaatgaagaaaaatgtattttccctttatgtaaaaattagtgaatatcttatgaattaaggcattcctctttccctaaccccgatggctccattcccaagtaccccaactcactgctgatcctattaaaggaatgagtcctgctacccgagtggtagtcatagccctagatgactctcaactactcttcaaagggaggcatcaggaatagaatgaaactgtgtgaaggataagattgttcgcatcaagatccaaatcttgatttcatattaacgcctaaggattgcctgtgtgctggaaatatatttgaaactcaaccagtatgcccagcctattgcatatcattgtcagaccatttttgctgctgtggtcacccacgatttcatttgtcttatacccaggtgaaaggggaagggtgaatgggactggctggttcctttaaatgttaacttatggaaatgctagttcaaatggtaatgtcacagtgttttgtatgcagagagcaagagttcaaccaacagctgtttattcatgtgtgtgtgtctttgctgctttgagttctctgtatctactgtgtatgtgaatggtcatgtgggactcagtggtggtgttgtgactttgacctagggtccgagtgtcacagctgatcttggcactcggcactcattggcacagtggtagttagaggtgaaaagtagagctgtcaagcccaagggcttagctttagggctcctcctgagttcggcccacagtagaagcaagattttaactagccccttttcctcttcaccctcccatgatgcgcagtgttcagaaagctggtaagtcctagggatttccagaagtagcctgcagaagaaggtaagtttgaaagccactccaggggtcctgatgctgtcatgctcagtgagccattttacagttctccaaagtctagccctgtttcggacctgcacttcacctctaagttatgtacaactcaacctgcatccctctaaaagtcctatatccatattcaccattggctaatttgaggccctgagtgggccttgaatgctaaaaagaagcagggtacgcagggctacatgtagataccacaccaaggctggaggctggtctgtcataagacagaaagaaagacgctgggcccaattttgacttggccaggggacaccttggtgtgtttgttatctttatctgtgggtaggctagctgacccatctccttgagtcattccctttgggaaaccccactgccagtattgatctcctttttgccttgtactgaatgacacattacctccacactctcccggactaggtggtcaacagggccacagggttgctttctgtctttggtggggcaggggagttgacagggatgagggtccaaggaataagcatgaatgacaagaaaacaagggaaagagttaacctgtcacatagcaggttaactttttcagggtttgcagttagaggtattcgaccattcactggctgagccagatcacgggaacttgagagcttttactgtgattcttcaatgtaaaaaataaacaacaatgtcaaactgtgtttatatgatttgtataaagcctttttaagattactatttaaataaacattataccagag

SEQ ID NO: 2807 - DNA, 3521 bp, Homo sapiens
cagagatcgcgagcgaggcaccagcctgcagccggcccccagcacatcctcagccgcacagacactcggcgaggtggaggtgagggcgggcgccagcgaactcggagaggggctcgctcactcccaggcgatcccagccgccaccgccgccgcaccagcagcagcaacagcagcagcagcttccttcctcagactcccctcgagaggctggccaagcgggtgtagccgttgggggaggctcccgccgggggaacccggcgaggacaagagcagggcggccgccttccactcgggctgtccggcggcggctgcctccgcccgtgtgtccgtcaagggtgccgcgggatgtgtgtcagtttacgcctctgagatcacacagctgcctgggggccgtgtgatgcccaaggcaagtcttggttttaattattattattatcattattgttacgcttggctttcgggaaatactcgtgatatttgtaggataaaggaaatgacactttgaggaactggagagaacatatatgcgttttgtttttaagaggaaaaccgtgttctcttcccggcttgttccctctttgctgatttcaggagctactctcctcctggtgaggtggaaattccagcaagaatagaggtgaagacaagccaccaggactcaggagggaaacgctgaccattagaaacctctgcataagacgttgtaaggaggaaaataaaagagagaaaaacacaaagatttaaacaagaaacctacgaacccagctctggaaagagccaccttctccaaaatggatatgtttcctctcacctgggttttcttagccctctacttttcaagacaccaagtgagaggccaaccagacccaccgtgcggaggtcgtttgaattccaaagatgctggctatatcacctctcccggttacccccaggactacccctcccaccagaactgcgagtggattgtttacgcccccgaacccaaccagaagattgtcctcaacttcaaccctcactttgaaatcgagaagcacgactgcaagtatgactttatcgagattcgggatggggacagtgaatccgcagacctcctgggcaaacactgtgggaacatcgccccgcccaccatcatctcctcgggctccatgctctacatcaggttcacctccgactacgcccggcagggggcaggcttctctctgcgctacgagatcttcaagacaggctctgaagattgctcaaaaaacttcacaagccccaacgggaccatcgaatctcctgggtttcctgagaagtatccacacaacttggactgcacctttaccatcctggccaaacccaagatggagatcatcctgcagttcctgatctttgacctggagcatgaccctttgcaggtgggagagggggactgcaagtacgattggctggacatctgggatggcattccacatgttggccccctgattggcaagtactgtgggaccaaaacaccctctgaacttcgttcatcgacggggatcctctccctgacctttcacacggacatggcggtggccaaggatggcttctctgcgcgttactacctggtccaccaagagccactagagaactttcagtgcaatgttcctctgggcatggagtctggccggattgctaatgaacagatcagtgcctcatctacctactctgatgggaggtggacccctcaacaaagccggctccatggtgatgacaatggctggacccccaacttggattccaacaaggagtatctccaggtggacctgcgctttttaaccatgctcacggccatcgcaacacagggagcgatttccagggaaacacagaatggctactatgtcaaatcctacaagctggaagtcagcactaatggagaggactggatggtgtaccggcatggcaaaaaccacaaggtatttcaagccaacaacgatgcaactgaggtggttctgaacaagctccacgctccactgctgacaaggtttgttagaatccgccctcagacctggcactcaggtatcgccctccggctggagctcttcggctgccgggtcacagatgctccctgctccaacatgctggggatgctctcaggcctcattgcagactcccagatctccgcctcttccacccaggaatacctctggagccccagtgcagcccgcctggttagcagccgctcgggctggttccctcgaatccctcaggcccagcccggtgaggagtggcttcaggtagatctgggaacacccaagacagtgaaaggtgtcatcatccagggagcccgcggaggagacagtatcactgctgtggaagccagagcatttgtgcgcaagttcaaagtctcctacagcctaaacggcaaggactgggaatacattcaggaccccaggacccagcagccaaagctgttcgaagggaacatgcactatgacacccctgacatccgaaggtttgaccccattccggcacagtatgtgcgggtatacccggagaggtggtcgccggcggggattgggatgcggctggaggtgctgggctgtgactggacagactccaagcccacggtagagacgctgggacccactgtgaagagcgaagagacaaccaccccctaccccaccgaagaggaggccacagagtgtggggagaactgcagctttgaggatgacaaagatttgcagctcccttcgggattcaattgcaacttcgatttcctcgaggagccctgtggttggatgtatgaccatgccaagtggctccggaccacctgggccagcagctccagcccaaacgaccggacgtttccagatgacaggaatttcttgcggctgcagagtgacagccagagagagggccagtatgcccggctcatcagcccccctgtccacctgccccgaagcccggtgtgcatggagttccagtaccaggccacgggcggccgcggggtggcgctgcaggtggtgcgggaagccagccaggagagcaagttgctgtgggtcatccgtgaggaccagggcggcgagtggaagcacgggcggatcatcctgcccagctacgacatggagtaccagattgtgttcgagggagtgatagggaaaggacgttccggagagattgccattgatgacattcggataagcactgatgtcccactggagaactgcatgggtcccaaagcatgtatcgcagatgaatacgaggtggactggagcaattcttcttctgcaacctcagggtctggcgccccctcgaccgacaaagaaaagagctggctgtacaccctggatcccatcctcatcaccatcatcgccatgagctcactgggcgtcctcctgggggccacctgtgcaggcctcctgctctactgcacctgttcctactcgggcctgagctcccgaagctgcaccacactggagaactacaacttcgagctctacgatggccttaagcacaaggtcaagatgaaccaccaaaagtgctgctccgaggcatga

SEQ ID NO: 2808 - DNA, 865 bp, Homo sapiens
gtcaacgattgggctgagtcggagacttcctttcctgattggccgtgttgtacggcggcttctcgcgcagctgatgacctggaagtgatgcctaaagctgtggaccgcgtgggctcgcctccctgggactaggtttcagcggccgctgcgatgaccaaaataaaggcagatcccgacgggcccgaggctcaggcggaggcgtgttccggggagcgcacctaccaggagctgctggtcaaccagaaccccatcgcgcagcccctggcttctcgccgcctcacgcggaagctctacaaatgcatcaagaaagcggtgaagcagaagcagattcggcgcggggtgaaagaggttcagaaatttgtcaacaaaggagaaaaagggatcatggttttggcaggagacacactgcccattgaggtatactgccatctcccagtcatgtgtgaggaccgaaatttgccctatgtctatatcccctctaagacggacctgggtgcagccgcaggctccaagcgccccacctgtgtgataatggtcaagccccatgaggagtaccaggaggcttacgatgagtgcctggaggaggtgcagtccctgcccctacccctatgaggggctccggtagcacctgggcacctgccgctggaagctattgggctggcagcaggacgactggctgtcctcctgcccacccacactgacggcatcttcccagttccccaaggcacgccttcttcccaggcagctctaacagccctttcatgaaggtaatgctagtcttctgtccatcagtgccatttcctgtagaactaaaggctgttccaagaatgtggggtggggaaagtaaatgctaagactaaaatgt

SEQ ID NO: 2809 - DNA, 599 bp, Homo sapiens
gcggccgctgcgatgaccaaaataaaggcagatcccgacgggcccgaggctcaggcggaggcgtgttccggggagcgcacctaccaggagctgctggtcaaccagaaccccatcgcgcagcccctggcttctcgccgcctcacgcggaagctctacaaatgcatcaagaaagcggtgaagcagaagcagattcggcgcggggtgaaagaggttcagaaatttgtcaacaaaggagaaaaagggacctgggtgcagccgcaggctccaagcgccccacctgtgtgataatggtcaagccccatgaggagtaccaggaggcttacgatgagtgcctggaggaggtgcagtccctgcccctacccctatgaggggctccggtagcacctgggcacctgccgctggaagctattgggctggcagcaggacgactggctgtcctcctgcccacccacactgacggcatcttcccagttccccaaggcacgccttcttcccaggcagctctaacagccctttcatgaaggtaatgctagtcttctgtccatcagtgccatttcctgtagaactaaaggctgttccaagaatgtggggtggggaaa

SEQ ID NO: 2810 - DNA, 4666 bp, Homo sapiens
aagtcgcactcccgcctcatccaaggcagcctgcgtggctcccgggagcgcgcacgtcccggagcccatgccgaccgcaggcgccgtatccgcgctcgtctagcagccccggttacgcggttgcacgtcggccccagccctgaggagccggaccgatgtggaaactgctgcccgccgcgggcccggcaggaggagaaccatacagacttttgactggcgttgagtacgttgttggaaggaaaaactgtgccattctgattgaaaatgatcagtcgatcagccgaaatcatgctgtgttaactgctaacttttctgtaaccaacctgagtcaaacagatgaaatccctgtattgacattaaaagataattctaagtatggtacctttgttaatgaggaaaaaatgcagaatggcttttcccgaactttgaagtcgggggatggtattacttttggagtgtttggaagtaaattcagaatagagtatgagcctttggttgcatgctcttcttgtttagatgtctctgggaaaactgctttaaatcaagctatattgcaacttggaggatttactgtaaacaattggacagaagaatgcactcaccttgtcatggtatcagtgaaagttaccattaaaacaatatgtgcactcatttgtggacgtccaattgtaaagccagaatattttactgaattcctgaaagcagttgagtccaagaagcagcctccacaaattgaaagtttttacccacctcttgatgaaccatctattggaagtaaaaatgttgatctgtcaggacggcaggaaagaaaacaaatcttcaaagggaaaacatttatatttttgaatgccaaacagcataagaaattgagttccgcagttgtctttggaggtggggaagctaggttgataacagaagagaatgaagaagaacataatttctttttggctccgggaacgtgtgttgttgatacaggaataacaaactcacagaccttaattcctgactgtcagaagaaatggattcagtcaataatggatatgctccaaaggcaaggtcttagacctattcctgaagcagaaattggattggcggtgattttcatgactacaaagaattactgtgatcctcagggccatcccagtacaggattaaagacaacaactccaggaccaagcctttcacaaggcgtgtcagttgatgaaaaactaatgccaagcgccccagtgaacactacaacatacgtagctgacacagaatcagagcaagcagatacatgggatttgagtgaaaggccaaaagaaatcaaagtctccaaaatggaacaaaaattcagaatgctttcacaagatgcacccactgtaaaggagtcctgcaaaacaagctctaataataatagtatggtatcaaatactttggctaagatgagaatcccaaactatcagctttcaccaactaaattgccaagtataaataaaagtaaagatagggcttctcagcagcagcagaccaactccatcagaaactactttcagccgtctaccaaaaaaagggaaagggatgaagaaaatcaagaaatgtcttcatgcaaatcagcaagaatagaaacgtcttgttctcttttagaacaaacacaacctgctacaccctcattgtggaaaaataaggagcagcatctatctgagaatgagcctgtggacacaaactcagacaataacttatttacagatacagatttaaaatctattgtgaaaaattctgccagtaaatctcatgctgcagaaaagctaagatcaaataaaaaaagggaaatggatgatgtggccatagaagatgaagtattggaacagttattcaaggacacaaaaccagagttagaaattgatgtgaaagttcaaaaacaggaggaagatgtcaatgttagaaaaaggccaaggatggatatagaaacaaatgacactttcagtgatgaagcagtaccagaaagtagcaaaatatctcaagaaaatgaaattgggaagaaacgtgaactcaaggaagactcactatggtcagctaaagaaatatctaacaatgacaaacttcaggatgatagtgagatgcttccaaaaaagctgttattgactgaatttagatcactggtgattaaaaactctacttccagaaatccatctggcataaatgatgattatggtcaactaaaaaatttcaagaaattcaaaaaggtcacatatcctggagcaggaaaacttccacacatcattggaggatcagatctaatagctcatcatgctcgaaagaatacagaactagaagagtggctaaggcaggaaatggaggtacaaaatcaacatgcaaaagaagagtctcttgctgatgatctttttagatacaatccttatttaaaaaggagaagataactgaggattttaaaaagaagccatggaaaaacttcctagtaagcatctacttcaggccaacaaggttatatgaatatatagtgtatagaagcgatttaagttacaatgttttatggcctaaatttattaaataaaatgcacaaaactttgattcttttgtatgtaacaattgtttgttctgttttcaggctttgtcattgcatctttttttcatttttaaatgtgttttgtttattaaatagttaatatagtcacagttcaaaattctaaatgtacgtaaggtaaagactaaagtcacccttccaccattgtcctagctacttggttcccctcagaaaaaaattcatgatactcatttcttatgaatctttccagggatttttgagtcctattcaaattcctatttttaaataatttcctacacaaatgatagcataacatatgcagtgttctacaccttgcttttttacttagtagattaaaaattataggaatatcaatataatgtttttaatattttttcttttccattatgctgtagtcttacctaaactctggtgatccaaacaaaatggcttcagtggtgcagatgtcacctacatgttattctagtactagaaactgaagaccatgtggagacttcatcaaacatgggtttagttttcaccagaatggaaagacctgtacccctttttggtggtcttactgagctgggtgggtgtctgttttgagcttatttagagtcctagttttcctacttataaagtagaaatggtgagattgttttctttttctaccttaaagggagatggtaagaaacaatgaatgtcttttttcaaactttattgacaagtgattttcaagtctgtgttcaaaaatatattcatgtacctgtgatccagcaagaagggagttccagtcaagagtcactacaactgattagttgtttagagaatgagaaatggaacagtgaggaatggaggccatatttccatgacttcccttgtaaacagaagcaacagaagggacaagaggctggcctctacatcactctcaccttccaaatcttgtggaagtgcatctacttgccagaaccaaattaacttacttccaagttctggctgcttgcaggtggaactccagctgcaagggagttagggaaatgaaggtctttttttaaaagcttctcagccttcctagggaacagaaattgggtgagccaatctgcaatttctactacaggcattgagaccagttagattattgaaatattatagagagttatgaacacttaaattatgatagtggtatgacattggatagaacatgggatactttagaagtagaattgacagggcatattagttgatgaaatggagtcatttgagtctcttaatagccatgtatcataattaccaagtgaagctggtggaacatatggtctccattttacagttaaggaatataatggacagattaatattgttctctgtcatgcccacaatccctttctaaggaagactgccctactatagcagtttttatatttgtcaatttatgaatataatgaatgagagttctggtacctcctgtctttacaaatattggtgttgtcagtatttttcctttttaaccattccaatcggtgtgtagtgatgtttcattttggttttaatttgtatatccctgatagctataattgggtcatagaaattctttatacattctagatgcaagtctcttgtcggatatatgtattgagatattacacctagtctgtggcttgactgttttctttatgtcttttgatgaatagaagttttaaattttgacaaggtcaaatttatttttttcttttgtttgatattttttctctccaatttaaccccaagatttcagatattctgctctattatataaactttatatttttatatttgtgatctaccttgaattgatatgtatgttgtgaattatggatcagggttctttttttcccccatacaagtatccagtcattgtaacactgtttattgaaagaattatcctttcctcattaaattaccttgccaattagtaaaaaatcaattaaccataatggtggatctgtttctggactttctgtttggttacactgaaatgtttgtccatccttgcactcactcataccatactgccttgaattactgtagctgcatagatgctccttaagttgggattacattgtaataaacgcaatgtaagtt

SEQ ID NO: 2811 - DNA, 1544 bp, Homo sapiens
gagcgcgcacgtcccggagcccatgccgaccgcaggcgccgtatccgcgctcgtctagcagccccggttacgcggttgcacgtcggccccagccctgaggagccggaccgatgtggaaactgctgcccgccgcgggcccggcaggaggagaaccatacagacttttgactggcgttgagtacgttgttggaaggaaaaactgtgccattctgattgaaaatgatcagtcgatcagccgaaatcatgctgtgttaactgctaacttttctgtaaccaacctgagtcaaacagatgaaatccctgtattgacattaaaagataattctaagtatggtacctttgttaatgaggaaaaaatgcagaatggcttttcccgaactttgaagtcgggggatggtattacttttggagtgtttggaagtaaattcagaatagagtatgagcctttggttgcatgctcttcttgtttagatgtctctgggaaaactgctttaaatcaagctatattgcaacttggaggatttactgtaaacaattggacagaagaatgcactcaccttgtcatggtatcagtgaaagttaccattaaaacaatatgtgcactcatttgtggacgtccaattgtaaagccagaatattttactgaattcctgaaagcagttgagtccaagaagcagcctccacaaattgaaagtttttacccacctcttgatgaaccatctattggaagtaaaaatgttgatctgtcaggacggcaggaaagaaaacaaatcttcaaagggaaaacatttatatttttgaatgccaaacagcataagaaattgagttccgcagttgtctttggaggtggggaagctaggttgataacagaagagaatgaagaagaacataatttctttttggctccgggaacgtgtgttgttgatacaggaataacaaactcacagaccttaattcctgactgtcagaagaaatggattcagtcaataatggatatgctccaaaggcaaggtcttagacctattcctgaagcagaaattggattggcggtgattttcatgactacaaagaattactgtgatcctcagggccatcccagtacaggattaaagacaacaactccaggaccaagcctttcacaaggcgtgtcagttgatgaaaaactaatgccaagcgccccagtgaacactacaacatacgtagctgacacagaatcagagcaagcagatacatgggatttgagtgaaaggccaaaagaaatcaaagtctccaaaatggaacaaaaattcagaatgctttcacaagatgcacccactgtaaaggagtcctgcaaaacaagctctaataataatagtatggtatcaaatactttggctaagatgagaatcccaaactatcagctttcaccaactaaattgccaagtataaataaaagtaaagatagggcttctcagcagcagcagaccaactccatcagaaactactttcagccgtctaccaaaaaaagagagagactccatctcaaaaaaaaaaaaaaaaaaaag

SEQ ID NO: 2812 - DNA, 1700 bp, Homo sapiens
atggaaattgtagttccctgctgcggtcccagttacagcgtgaatcccttagcgcaccgcctccccaagtgctgccagcatgctgcccctccacgctagggacttgcctgcctctgccgcagcgcagatctgatgcggtggtttcctccaaagaaagcgggatactccgggccctgccgcgcgcaccgccgctccgtcacggagccgctttacttccgggtgcgacgtctacccacccaggacttcctgggacgagccgtcccccgccccagccacgcctctgagtcgcgctgcgcaggcgccattgggcagagggattggcaagcttgcgtgccccagcgacacaggcctcgaggctgtctctgacaagtgttcacaggaggtggggacgcctctgcgcgaggaacgaggagctacgggcctgggcccggttattgccatgggcagcggctgccgcatcgaatgcatattcttcagcgagttccaccccacgctgggacccaagatcacctatcaggtccctgaagacttcatctcccgagagctgtttgacacagtccaagtgtacatcatcaccaagccagagctgcagaacaagcttatcactgtcacagctatggaaaagaagctgatcggctgtcctgtgtgcatcgaacacaagaagtacagccgcaatgctctcctcttcaacctgggcttcgtgtgtgatgcccaggccaagacctgcgccctcgagcccattgttaaaaagctggctggctatctgaccacactagagctagagagcagcttcgtgtccatggaggagagcaagcagaagttggtgcccatcatgaccatcttgctggaggagctaaatgcctcaggccggtgcactctgcccattgatgagtccaacaccatccacttgaaggtgattgagcagcggccagaccctccggtggcccaggagtatgatgtacctgtctttaccaaagacaaggaggatttcttcaactcacagtgggacctcactacacaacaaatcctgccctacattgatgggttccgccacatccagaagatttcagcagaggcagatgtggagctcaacctggtgcgcattgctatccagaacctgctgtactacggcgttgtgacactggtgtccatcctccagtactccaatgtatactgcccaacgcccaaggtccaggacctggtagatgacaagtccctgcaagaggcatgtctatcctacgtgaccaagcaagggcacaagagggccagtctccgggatgtgttccagctatactgcagcctgagccctggcactaccgtgcgagacctcattggccgccacccccagcagctgcagcatgttgatgaacggaagctgatccagttcgggcttatgaagaacctcatcaggcgactacagaagtatcctgtgcgggtgactcgggaagagcagagccaccctgcccggctttatacaggctgccacagctatgacgagatctgctgcaagacaggcatgagctaccatgagctggatgagcggcttgaaaatgaccccaacatcatcatctgctggaagtgaggctggtagtgactggatggacacattgctgtgggtagtccctcctactaggaggcttgtcatactgtctagaggttgactcttagttctgtaaataaagacatccatttcaaacagc

SEQ ID NO: 2813 - DNA, 2186 bp, Homo sapiens
agactgacagacacgtagaccaacagtgcggccccagggttcgtccccagactcgctcgctcatttgttggcgactggggctcagcgcagcgaagcccgatgtggtccggaggcagtgggaaggcgcggggctgggaggccgcggcgggagggaggagcagccccggcaggctcagccgccgccgaatcatgtcgatgagtccaaagcacacgactccgttctcagtgtctgacatcttgagtcccctggaggaaagctacaagaaagtgggcatggagggcggcggcctcggggctccgctggcggcgtacaggcagggccaggcggcaccgccaacagcggccatgcagcagcacgccgtggggcaccacggcgccgtcaccgccgcctaccacatgacggcggcgggggtgccccagctctcgcactccgccgtggggggctactgcaacggcaacctgggcaacatgagcgagctgccgccgtaccaggacaccatgaggaacagcgcctctggccccggatggtacggcgccaacccagacccgcgcttccccgccatctcccgcttcatgggcccggcgagcggcatgaacatgagcggcatgggcggcctgggctcgctgggggacgtgagcaagaacatggccccgctgccaagcgcgccgcgcaggaagcgccgggtgctcttctcgcaggcgcaggtgtacgagctggagcgacgcttcaagcaacagaagtacctgtcggcgccggagcgcgagcacctggccagcatgatccacctgacgcccacgcaggtcaagatctggttccagaaccaccgctacaaaatgaagcgccaggccaaggacaaggcggcgcagcagcaactgcagcaggacagcggcggcggcgggggcggcgggggcaccgggtgcccgcagcagcaacaggctcagcagcagtcgccgcgacgcgtggcggtgccggtcctggtgaaagacggcaaaccgtgccaggcgggtgcccccgcgccgggcgccgccagcctacaaggccacgcgcagcagcaggcgcagcaccaggcgcaggccgcgcaggcggcggcagcggccatctccgtgggcagcggtggcgccggccttggcgcacacccgggccaccagccaggcagcgcaggccagtctccggacctggcgcaccacgccgccagccccgcggcgctgcagggccaggtatccagcctgtcccacctgaactcctcgggctcggactacggcaccatgtcctgctccaccttgctatacggtcggacctggtgagaggacgccgggccggccctagcccagcgctctgcctcaccgcttccctcctgcccgccacacagaccaccatccaccgctgctccacgcgcttcgacttttcttaacaacctggccgcgtttagaccaaggaacaaaaaaaccacaaaggccaaactgctggacgtctttctttttttccccccctaaaatttgtgggtttttttttttaaaaaaagaaaatgaaaaacaaccaagcgcatccaatctcaaggaatctttaagcagagaagggcataaaacagctttggggtgtctttttttggtgattcaaatgggttttccacgctagggcggggcacagattggagagggctctgtgctgacatggctctggactctaaagaccaaacttcactctgggcacactctgccagcaaagaggactcgcttgtaaataccaggatttttttttttttttgaagggaggacgggagctggggagaggaaagagtcttcaacataacccacttgtcactgacacaaaggaagtgccccctccccggcaccctctggccgcctaggctcagcggcgaccgccctccgcgaaaatagtttgtttaatgtgaacttgtagctgtaaaacgctgtcaaaagttggactaaatgcctagtttttagtaatctgtacattttgttgtaaaaagaaaaaccactcccagtccccagcccttcacattttttatgggcattgacaaatctgtgtatattatttggcagtttggtatttgcggcgtcagtctttttctgttgtaacttatgtagatatttggcttaaatatagttcctaagaagcttctaataaattatacaaattaaaaagattctttttctgattaaaa

SEQ ID NO: 2814 - DNA, 2330 bp, Homo sapiens
ttaaaggtgtttaccttgtcatcagcatgtaagctaattatctcgggcaagatgtaggcttctattgtcttgttgctttagcgcttacgccccgcctctggtggctgcctaaaacctggcgccgggctaaaacaaacgcgaggcagcccccgagcctccactcaagccaattaaggaggactcggtccactccgttacgtgtacatccaacaagatcggcgttaaggtaacaccagaatatttggcaaagggagaaaaaaaaagcagcgaggcttcgccttccccctctcccttttttttcctcctcttccttcctcctccagccgccgccgaatcatgtcgatgagtccaaagcacacgactccgttctcagtgtctgacatcttgagtcccctggaggaaagctacaagaaagtgggcatggagggcggcggcctcggggctccgctggcggcgtacaggcagggccaggcggcaccgccaacagcggccatgcagcagcacgccgtggggcaccacggcgccgtcaccgccgcctaccacatgacggcggcgggggtgccccagctctcgcactccgccgtggggggctactgcaacggcaacctgggcaacatgagcgagctgccgccgtaccaggacaccatgaggaacagcgcctctggccccggatggtacggcgccaacccagacccgcgcttccccgccatctcccgcttcatgggcccggcgagcggcatgaacatgagcggcatgggcggcctgggctcgctgggggacgtgagcaagaacatggccccgctgccaagcgcgccgcgcaggaagcgccgggtgctcttctcgcaggcgcaggtgtacgagctggagcgacgcttcaagcaacagaagtacctgtcggcgccggagcgcgagcacctggccagcatgatccacctgacgcccacgcaggtcaagatctggttccagaaccaccgctacaaaatgaagcgccaggccaaggacaaggcggcgcagcagcaactgcagcaggacagcggcggcggcgggggcggcgggggcaccgggtgcccgcagcagcaacaggctcagcagcagtcgccgcgacgcgtggcggtgccggtcctggtgaaagacggcaaaccgtgccaggcgggtgcccccgcgccgggcgccgccagcctacaaggccacgcgcagcagcaggcgcagcaccaggcgcaggccgcgcaggcggcggcagcggccatctccgtgggcagcggtggcgccggccttggcgcacacccgggccaccagccaggcagcgcaggccagtctccggacctggcgcaccacgccgccagccccgcggcgctgcagggccaggtatccagcctgtcccacctgaactcctcgggctcggactacggcaccatgtcctgctccaccttgctatacggtcggacctggtgagaggacgccgggccggccctagcccagcgctctgcctcaccgcttccctcctgcccgccacacagaccaccatccaccgctgctccacgcgcttcgacttttcttaacaacctggccgcgtttagaccaaggaacaaaaaaaccacaaaggccaaactgctggacgtctttctttttttccccccctaaaatttgtgggtttttttttttaaaaaaagaaaatgaaaaacaaccaagcgcatccaatctcaaggaatctttaagcagagaagggcataaaacagctttggggtgtctttttttggtgattcaaatgggttttccacgctagggcggggcacagattggagagggctctgtgctgacatggctctggactctaaagaccaaacttcactctgggcacactctgccagcaaagaggactcgcttgtaaataccaggatttttttttttttttgaagggaggacgggagctggggagaggaaagagtcttcaacataacccacttgtcactgacacaaaggaagtgccccctccccggcaccctctggccgcctaggctcagcggcgaccgccctccgcgaaaatagtttgtttaatgtgaacttgtagctgtaaaacgctgtcaaaagttggactaaatgcctagtttttagtaatctgtacattttgttgtaaaaagaaaaaccactcccagtccccagcccttcacattttttatgggcattgacaaatctgtgtatattatttggcagtttggtatttgcggcgtcagtctttttctgttgtaacttatgtagatatttggcttaaatatagttcctaagaagcttctaataaattatacaaattaaaaagattctttttctgatta

SEQ ID NO: 2815 - DNA, 2583 bp, Homo sapiens
agcaacgcgggggacacccccgattccgctggggagcgcagcccacagctccccctcgccaggcgcccaaggaccctcaaggcgcggggcccacacttgaagcctgggaacgcgcagacaggaaaccctcttcctcctaagcagtttcttgctcgtcggatgagaggcgcccaattgaagcagaatgatcctcatctactaatatccagcgtggccacaaagcgactggccatttacgccaccactttaaacaaagatatttggttattcccgggaagcaagagcacttttgcatggctgagctgcgggcggaggcgagcctcggcccagcctcccgcccgctgagctgcccgcacctcggcattcgccccctcctggccagcgctccagccgccggggttcaggctcagttccgcccggcaacagacagacgggcactcacgccgctccctgctcgcgcgctccctgaagcatcagaggggaaaacagcgtggctctgggctcgggtgctggggctgtgatgtcctcggaaagtcagctccagccccagatccccgcgtgtctgggagatgggcgagggtcagggacaccagccgccgccgaatcatgtcgatgagtccaaagcacacgactccgttctcagtgtctgacatcttgagtcccctggaggaaagctacaagaaagtgggcatggagggcggcggcctcggggctccgctggcggcgtacaggcagggccaggcggcaccgccaacagcggccatgcagcagcacgccgtggggcaccacggcgccgtcaccgccgcctaccacatgacggcggcgggggtgccccagctctcgcactccgccgtggggggctactgcaacggcaacctgggcaacatgagcgagctgccgccgtaccaggacaccatgaggaacagcgcctctggccccggatggtacggcgccaacccagacccgcgcttccccgccatctcccgcttcatgggcccggcgagcggcatgaacatgagcggcatgggcggcctgggctcgctgggggacgtgagcaagaacatggccccgctgccaagcgcgccgcgcaggaagcgccgggtgctcttctcgcaggcgcaggtgtacgagctggagcgacgcttcaagcaacagaagtacctgtcggcgccggagcgcgagcacctggccagcatgatccacctgacgcccacgcaggtcaagatctggttccagaaccaccgctacaaaatgaagcgccaggccaaggacaaggcggcgcagcagcaactgcagcaggacagcggcggcggcgggggcggcgggggcaccgggtgcccgcagcagcaacaggctcagcagcagtcgccgcgacgcgtggcggtgccggtcctggtgaaagacggcaaaccgtgccaggcgggtgcccccgcgccgggcgccgccagcctacaaggccacgcgcagcagcaggcgcagcaccaggcgcaggccgcgcaggcggcggcagcggccatctccgtgggcagcggtggcgccggccttggcgcacacccgggccaccagccaggcagcgcaggccagtctccggacctggcgcaccacgccgccagccccgcggcgctgcagggccaggtatccagcctgtcccacctgaactcctcgggctcggactacggcaccatgtcctgctccaccttgctatacggtcggacctggtgagaggacgccgggccggccctagcccagcgctctgcctcaccgcttccctcctgcccgccacacagaccaccatccaccgctgctccacgcgcttcgacttttcttaacaacctggccgcgtttagaccaaggaacaaaaaaaccacaaaggccaaactgctggacgtctttctttttttccccccctaaaatttgtgggtttttttttttaaaaaaagaaaatgaaaaacaaccaagcgcatccaatctcaaggaatctttaagcagagaagggcataaaacagctttggggtgtctttttttggtgattcaaatgggttttccacgctagggcggggcacagattggagagggctctgtgctgacatggctctggactctaaagaccaaacttcactctgggcacactctgccagcaaagaggactcgcttgtaaataccaggatttttttttttttttgaagggaggacgggagctggggagaggaaagagtcttcaacataacccacttgtcactgacacaaaggaagtgccccctccccggcaccctctggccgcctaggctcagcggcgaccgccctccgcgaaaatagtttgtttaatgtgaacttgtagctgtaaaacgctgtcaaaagttggactaaatgcctagtttttagtaatctgtacattttgttgtaaaaagaaaaaccactcccagtccccagcccttcacattttttatgggcattgacaaatctgtgtatattatttggcagtttggtatttgcggcgtcagtctttttctgttgtaacttatgtagatatttggcttaaatatagttcctaagaagcttctaataaattatacaaattaaaaa

SEQ ID NO: 2816 - DNA, 1417 bp, Homo sapiens
gcccgatgtggtccggaggcagtgggaaggcgcggggctgggaggccgcggcgggagggaggagcagccccggcaggctcagcgcttacgccccgcctctggtggctgcctaaaacctggcgccgggctaaaacaaacgcgaggcagcccccgagcctccactcaagccaattaaggaggactcggtccactccgttacgtgtacatccaacaagatcggcgttaagccgccgccgaatcatgtcgatgagtccaaagcacacgactccgttctcagtgtctgacatcttgagtcccctggaggaaagctacaagaaagtgggcatggagggcggcggcctcggggctccgctggcggcgtacaggcagggccaggcggcaccgccaacagcggccatgcagcagcacgccgtggggcaccacggcgccgtcaccgccgcctaccacatgacggcggcgggggtgccccagctctcgcactccgccgtggggggctactgcaacggcaacctgggcaacatgagcgagctgccgccgtaccaggacaccatgaggaacagcgcctctggccccggatggtacggcgccaacccagacccgcgcttccccgccatctcccgcttcatgggcccggcgagcggcatgaacatgagcggcatgggcggcctgggctcgctgggggacgtgagcaagaacatggccccgctgccaagcgcgccgcgcaggaagcgccgggtgctcttctcgcaggcgcaggtgtacgagctggagcgacgcttcaagcaacagaagtacctgtcggcgccggagcgcgagcacctggccagcatgatccacctgacgcccacgcaggtcaagatctggttccagaaccaccgctacaaaatgaagcgccaggccaaggacaaggcggcgcagcagcaactgcagcaggacagcggcggcggcgggggcggcgggggcaccgggtgcccgcagcagcaacaggctcagcagcagtcgccgcgacgcgtggcggtgccggtcctggtgaaagacggcaaaccgtgccaggcgggtgcccccgcgccgggcgccgccagcctacaaggccacgcgcagcagcaggcgcagcaccaggcgcaggccgcgcaggcggcggcagcggccatctccgtgggcagcggtggcgccggccttggcgcacacccgggccaccagccaggcagcgcaggccagtctccggacctggcgcaccacgccgccagccccgcggcgctgcagggccaggtatccagcctgtcccacctgaactcctcgggctcggactacggcaccatgtcctgctccaccttgctatacggtcggacctggtgagaggacgccgggccggccctagcccagcgctctgcctcaccgcttccctcctgcccgccac

SEQ ID NO: 2817 - DNA, 653 bp, Homo sapiens
aatatccagcgtggccacaaagcgactggccatttacgccaccactttaaacaaagatatttggttattcccgggaagcaagagcacttttgcatggctgagctgcgggcggaggcgagcctcggcccagcctcccgcccgctgagctgcccgcacctcggcattcgccccctcctggccagcgctccagccgccggggttcaggctcagttccgcccggcaacagacagacgggcactcacgccgctccctgctcgcgcgctccctgaagcatcagaggggaaaacagcgtggctctgggctcgggtgctggggctgtgatgtcctcggaaagtcagctccagccccagatccccgcgtgtctgggagatgggcgagggtcagggacaccagggggaaagggggcggggagcagaggtgtccctctgacggcggcagaagagaggcagacagactgacagacacgtagaccaacagtgcggccccagggttcgtccccagactcgctcgctcatttgttggcgactggggctcagcgcagcgaagcccgatgtggtccggaggcagtgggaaggcgcggggctgggaggccgcggcgggagggaggagcagccccggcaggctcagcgcttacgccccgcctctggtggctg

SEQ ID NO: 2818 - DNA, 3101 bp, Homo sapiens
atgctcagggttccggagccgcggcccggggaggcgaaagcggagggggccgcgccgccgaccccgtccaagccgctcacgtccttcctcatccaggacatcctgcgggacggcgcgccggaggaggccgagacgctggcagagaccgagccagaaaggcacttggggtcttatctgttggactctgaaaacacttcaggcgcccttccaaggcttccccaaacccctaagcagccgcagaagcgctcccgagctgccttctcccacactcaggtgatcgagttggagaggaagttcagccatcagaagtacctgtcggcccctgaacgggcccacctggccaagaacctcaagctcacggagacccaagtgaagatatggttccagaacagacgctataagactaagcgaaagcagctctcctcggagctgggagacttggagaagcactcctctttgccggccctgaaagaggaggccttctcccgggcctccctggtctccgtgtataacagctatccttactacccatacctgtactgcgtgggcagctggagcccagctttttggtaatgccagctcaggtgacaaccattatgatcaaaaactgccttccccagggtgtctctatgaaaagcacaaggggccaaggtcagggagcaagaggtgtgcacaccaaagctattggagatttgcgtggaaatctcagattcttcactggtgagacaatgaaacaacagagacagtgaaagttttaatacctaagtcattcctccagtgcatactgtaggtcattttttttgcttctggctacctgtttgaaggggagagagggaaaatcaagtggtattttccagcactttgtatgattttggatgagttgtacacccaaggattctgttctgcaactccatcctcctgtgtcactgaatatcaactctgaaagagcaaacctaacaggagaaaggacaaccaggatgaggatgtcaccaactgaattaaacttaagtccagaagcctcctgttggccttggaatatggccaaggctctctctgtccctgtaaaagagaggggcaaatagagagtctccaagagaacgccctcatgctcagcacatatttgcatgggagggggagatgggtgggaggagatgaaaatatcagcttttcttattcctttttattccttttaaaatggtatgccaacttaagtatttacagggtggcccaaatagaacaagatgcactcgctgtgattttaagacaagctgtataaacagaactccactgcaagagggggggccgggccaggagaatctccgcttgtccaagacaggggcctaaggagggtctccacactgctgctaggggctgttgcatttttttattagtagaaagtggaaaggcctcttctcaacttttttcccttgggctggagaatttagaatcagaagtttcctggagttttcaggctatcatatatactgtatcctgaaaggcaacataattcttccttccctccttttaaaattttgtgttcctttttgcagcaattactcactaaagggcttcattttagtccagatttttagtctggctgcacctaacttatgcctcgcttatttagcccgagatctggtctttttttttttttttttttttttttttccgtctccccaaagctttatctgtcttgactttttaaaaaagtttgggggcagattctgaattggctaaaagacatgcatttttaaaactagcaactcttatttctttcctttaaaaatacatagcattaaatcccaaatcctatttaaagacctgacagcttgagaaggtcactactgcatttataggaccttctggtggttctgctgttacgtttgaagtctgacaatccttgagaatctttgcatgcagaggaggtaagaggtattggattttcacagaggaagaacacagcgcagaatgaagggccaggcttactgagctgtccagtggagggctcatgggtgggacatggaaaagaaggcagcctaggccctggggagcccagtccactgagcaagcaagggactgagtgagccttttgcaggaaaaggctaagaaaaaggaaaaccattctaaaacacaacaagaaactgtccaaatgctttgggaactgtgtttattgcctataatgggtccccaaaatgggtaacctagacttcagagagaatgagcagagagcaaaggagaaatctggctgtccttccattttcattctgttatctcaggtgagctggtagaggggagacattagaaaaaaatgaaacaacaaaacaattactaatgaggtacgctgaggcctgggagtctcttgactccactacttaattccgtttagtgagaaacctttcaattttcttttattagaagggccagcttactgttggtggcaaaattgccaacataagttaatagaaagttggccaatttcaccccattttctgtggtttgggctccacattgcaatgttcaatgccacgtgctgctgacaccgaccggagtactagccagcacaaaaggcagggtagcctgaattgctttctgctctttacatttcttttaaaataagcatttagtgctcagtccctactgagtactctttctctcccctcctctgaatttaattctttcaacttgcaatttgcaaggattacacatttcactgtgatgtatattgtgttgcaaaaaaaaaaaaaaagtgtctttgtttaaaattacttggtttgtgaatccatcttgctttttccccattggaactagtcattaacccatctctgaactggtagaaaaacatctgaagagctagtctatcagcatctgacaggtgaattggatggttctcagaaccatttcacccagacagcctgtttctatcctgtttaataaattagtttgggttctctacatgcataacaaaccctgctccaatctgtcacataaaagtctgtgacttgaagtttagtcagcacccccaccaaactttatttttctatgtgttttttgcaacatatgagtgttttgaaaataaagtacccatgtctttattagattta

SEQ ID NO: 2819 - DNA, 3271 bp, Homo sapiens
ccgggcgggtgcattcaggccaaggcggggccgccgggatgctcagggttccggagccgcggcccggggaggcgaaagcggagggggccgcgccgccgaccccgtccaagccgctcacgtccttcctcatccaggacatcctgcgggacggcgcgcagcggcaaggcggccgcacgagcagccagagacagcgcgacccggagccggagccagagccagagccagagggaggacgcagccgcgccggggcgcagaacgaccagctgagcaccgggccccgcgccgcgccggaggaggccgagacgctggcagagaccgagccagaaaggcacttggggtcttatctgttggactctgaaaacacttcaggcgcccttccaaggcttccccaaacccctaagcagccgcagaagcgctcccgagctgccttctcccacactcaggtgatcgagttggagaggaagttcagccatcagaagtacctgtcggcccctgaacgggcccacctggccaagaacctcaagctcacggagacccaagtgaagatatggttccagaacagacgctataagactaagcgaaagcagctctcctcggagctgggagacttggagaagcactcctctttgccggccctgaaagaggaggccttctcccgggcctccctggtctccgtgtataacagctatccttactacccatacctgtactgcgtgggcagctggagcccagctttttggtaatgccagctcaggtgacaaccattatgatcaaaaactgccttccccagggtgtctctatgaaaagcacaaggggccaaggtcagggagcaagaggtgtgcacaccaaagctattggagatttgcgtggaaatctcagattcttcactggtgagacaatgaaacaacagagacagtgaaagttttaatacctaagtcattcctccagtgcatactgtaggtcattttttttgcttctggctacctgtttgaaggggagagagggaaaatcaagtggtattttccagcactttgtatgattttggatgagttgtacacccaaggattctgttctgcaactccatcctcctgtgtcactgaatatcaactctgaaagagcaaacctaacaggagaaaggacaaccaggatgaggatgtcaccaactgaattaaacttaagtccagaagcctcctgttggccttggaatatggccaaggctctctctgtccctgtaaaagagaggggcaaatagagagtctccaagagaacgccctcatgctcagcacatatttgcatgggagggggagatgggtgggaggagatgaaaatatcagcttttcttattcctttttattccttttaaaatggtatgccaacttaagtatttacagggtggcccaaatagaacaagatgcactcgctgtgattttaagacaagctgtataaacagaactccactgcaagagggggggccgggccaggagaatctccgcttgtccaagacaggggcctaaggagggtctccacactgctgctaggggctgttgcatttttttattagtagaaagtggaaaggcctcttctcaacttttttcccttgggctggagaatttagaatcagaagtttcctggagttttcaggctatcatatatactgtatcctgaaaggcaacataattcttccttccctccttttaaaattttgtgttcctttttgcagcaattactcactaaagggcttcattttagtccagatttttagtctggctgcacctaacttatgcctcgcttatttagcccgagatctggtctttttttttttttttttttttttttttccgtctccccaaagctttatctgtcttgactttttaaaaaagtttgggggcagattctgaattggctaaaagacatgcatttttaaaactagcaactcttatttctttcctttaaaaatacatagcattaaatcccaaatcctatttaaagacctgacagcttgagaaggtcactactgcatttataggaccttctggtggttctgctgttacgtttgaagtctgacaatccttgagaatctttgcatgcagaggaggtaagaggtattggattttcacagaggaagaacacagcgcagaatgaagggccaggcttactgagctgtccagtggagggctcatgggtgggacatggaaaagaaggcagcctaggccctggggagcccagtccactgagcaagcaagggactgagtgagccttttgcaggaaaaggctaagaaaaaggaaaaccattctaaaacacaacaagaaactgtccaaatgctttgggaactgtgtttattgcctataatgggtccccaaaatgggtaacctagacttcagagagaatgagcagagagcaaaggagaaatctggctgtccttccattttcattctgttatctcaggtgagctggtagaggggagacattagaaaaaaatgaaacaacaaaacaattactaatgaggtacgctgaggcctgggagtctcttgactccactacttaattccgtttagtgagaaacctttcaattttcttttattagaagggccagcttactgttggtggcaaaattgccaacataagttaatagaaagttggccaatttcaccccattttctgtggtttgggctccacattgcaatgttcaatgccacgtgctgctgacaccgaccggagtactagccagcacaaaaggcagggtagcctgaattgctttctgctctttacatttcttttaaaataagcatttagtgctcagtccctactgagtactctttctctcccctcctctgaatttaattctttcaacttgcaatttgcaaggattacacatttcactgtgatgtatattgtgttgcaaaaaaaaaaaaaaagtgtctttgtttaaaattacttggtttgtgaatccatcttgctttttccccattggaactagtcattaacccatctctgaactggtagaaaaacatctgaagagctagtctatcagcatctgacaggtgaattggatggttctcagaaccatttcacccagacagcctgtttctatcctgtttaataaattagtttgggttctctacatgcataacaaaccctgctccaatctgtcacataaaagtctgtgacttgaagtttagtcagcacccccaccaaactttatttttctatgtgttttttgcaacatatgagtgttttgaaaataaagtacccatgtctttattagattta

SEQ ID NO: 2820 - DNA, 713 bp, Homo sapiens
atgctcagggttccggagccgcggcccggggaggccgagacgctggcagagaccgagccagaaaggcacttggggtcttatctgttggactctgaaaacacttcaggcgcccttccaaggcttccccaaacccctaagcagccgcagaagcgctcccgagctgccttctcccacactcaggtgatcgagttggagaggaagttcagccatcagaagtacctgtcggcccctgaacgggcccacctggccaagaacctcaagctcacggagacccaagtgaagatatggttccagaacagacgctataagactaagcgaaagcagctctcctcggagctgggagacttggagaagcactcctctttgccggccctgaaagaggaggccttctcccgggcctccctggtctccgtgtataacagctatccttactacccatacctgtactgcgtgggcagctggagcccagctttttggtaatgccagctcaggtgacaaccattatgatcaaaaactgccttccccagggtgtctctatgaaaagcacaaggggccaaggtcagggagcaagaggtgtgcacaccaaagctattggagatttgcgtggaaatctcagattcttcactggtgagacaatgaaacaacagagacagtgaaagttttaatacctaagtcattcctccagtgcatactgtaggtcattttttttgctt

SEQ ID NO: 2821 - DNA, 6088 bp, Homo sapiens
cttctggtgtgagactctgtaggtttcattactccttttgggtcctgattaaatcctgttgactcaagaccttagagcatttactggtaaagtctctgactgcgcgattttttttttgcattttagttccttaaatattttctcactgcttcctactaaaggacggacagagcatttgttcttcagccacatactttccttccactggccagcattctcctctattagactagaactgtggataaacctcagaaaatggccacccagcagaaagcctctgacgagaggatctcccagtttgatcacaatttgctgccagagctgtctgctcttctgggcctagatgcagttcagttggcaaaggaactagaagaagaggagcagaaggagcgagcaaaaatgcagaaaggctacaactctcaaatgcgcagtgaagcaaaaaggttaaagacttttgtgacttatgagccgtacagctcatggataccacaggagatggcggccgctgggttttacttcactggggtaaaatctgggattcagtgcttctgctgtagcctaatcctctttggtgccggcctcacgagactccccatagaagaccacaagaggtttcatccagattgtgggttccttttgaacaaggatgttggtaacattgccaagtacgacataagggtgaagaatctgaagagcaggctgagaggaggtaaaatgaggtaccaagaagaggaggctagacttgcgtccttcaggaactggccattttatgtccaagggatatccccttgtgtgctctcagaggctggctttgtctttacaggtaaacaggacacggtacagtgtttttcctgtggtggatgtttaggaaattgggaagaaggagatgatccttggaaggaacatgccaaatggttccccaaatgtgaatttcttcggagtaagaaatcctcagaggaaattacccagtatattcaaagctacaagggatttgttgacataacgggagaacattttgtgaattcctgggtccagagagaattacctatggcatcagcttattgcaatgacagcatctttgcttacgaagaactacggctggactcttttaaggactggccccgggaatcagctgtgggagttgcagcactggccaaagcaggtcttttctacacaggtataaaggacatcgtccagtgcttttcctgtggagggtgtttagagaaatggcaggaaggtgatgacccattagacgatcacaccagatgttttcccaattgtccatttctccaaaatatgaagtcctctgcggaagtgactccagaccttcagagccgtggtgaactttgtgaattactggaaaccacaagtgaaagcaatcttgaagattcaatagcagttggtcctatagtgccagaaatggcacagggtgaagcccagtggtttcaagaggcaaagaatctgaatgagcagctgagagcagcttataccagcgccagtttccgccacatgtctttgcttgatatctcttccgatctggccacggaccacttgctgggctgtgatctgtctattgcttcaaaacacatcagcaaacctgtgcaagaacctctggtgctgcctgaggtctttggcaacttgaactctgtcatgtgtgtggagggtgaagctggaagtggaaagacggtcctcctgaagaaaatagcttttctgtgggcatctggatgctgtcccctgttaaacaggttccagctggttttctacctctcccttagttccaccagaccagacgaggggctggccagtatcatctgtgaccagctcctagagaaagaaggatctgttactgaaatgtgcgtgaggaacattatccagcagttaaagaatcaggtcttattccttttagatgactacaaagaaatatgttcaatccctcaagtcataggaaaactgattcaaaaaaaccacttatcccggacctgcctattgattgctgtccgtacaaacagggccagggacatccgccgatacctagagaccattctagagatcaaagcatttcccttttataatactgtctgtatattacggaagctcttttcacataatatgactcgtctgcgaaagtttatggtttactttggaaagaaccaaagtttgcagaagatacagaaaactcctctctttgtggcggcgatctgtgctcattggtttcagtatccttttgacccatcctttgatgatgtggctgttttcaagtcctatatggaacgcctttccttaaggaacaaagcgacagctgaaattctcaaagcaactgtgtcctcctgtggtgagctggccttgaaagggtttttttcatgttgctttgagtttaatgatgatgatctcgcagaagcaggggttgatgaagatgaagatctaaccatgtgcttgatgagcaaatttacagcccagagactaagaccattctaccggtttttaagtcctgccttccaagaatttcttgcggggatgaggctgattgaactcctggattcagataggcaggaacatcaagatttgggactgtatcatttgaaacaaatcaactcacccatgatgactgtaagcgcctacaacaattttttgaactatgtctccagcctcccttcaacaaaagcagggcccaaaattgtgtctcatttgctccatttagtggataacaaagagtcattggagaatatatctgaaaatgatgactacttaaagcaccagccagaaatttcactgcagatgcagttacttaggggattgtggcaaatttgtccacaagcttacttttcaatggtttcagaacatttactggttcttgccctgaaaactgcttatcaaagcaacactgttgctgcgtgttctccatttgttttgcaattccttcaagggagaacactgactttgggtgcgcttaacttacagtactttttcgaccacccagaaagcttgtcattgttgaggagcatccacttcccaatacgaggaaataagacatcacccagagcacatttttcagttctggaaacatgttttgacaaatcacaggtgccaactatagatcaggactatgcttctgcctttgaacctatgaatgaatgggagcgaaatttagctgaaaaagaggataatgtaaagagctatatggatatgcagcgcagggcatcaccagaccttagtactggctattggaaactttctccaaagcagtacaagattccctgtctagaagtcgatgtgaatgatattgatgttgtaggccaggatatgcttgagattctaatgacagttttctcagcttcacagcgcatcgaactccatttaaaccacagcagaggctttatagaaagcatccgcccagctcttgagctgtctaaggcctctgtcaccaagtgctccataagcaagttggaactcagcgcagccgaacaggaactgcttctcaccctgccttccctggaatctcttgaagtctcagggacaatccagtcacaagaccaaatctttcctaatctggataagttcctgtgcctgaaagaactgtctgtggatctggagggcaatataaatgttttttcagtcattcctgaagaatttccaaacttccaccatatggagaaattattgatccaaatttcagctgagtatgatccttccaaactagtaaaattaattcaaaattctccaaaccttcatgttttccatctgaagtgtaacttcttttcggattttgggtctctcatgactatgcttgtttcctgtaagaaactcacagaaattaagttttcggattcattttttcaagccgtcccatttgttgccagtttgccaaattttatttctctgaagatattaaatcttgaaggccagcaatttcctgatgaggaaacatcagaaaaatttgcctacattttaggttctcttagtaacctggaagaattgatccttcctactggggatggaatttatcgagtggccaaactgatcatccagcagtgtcagcagcttcattgtctccgagtcctctcatttttcaagactttgaatgatgacagcgtggtggaaattgccaaagtagcaatcagtggaggtttccagaaacttgagaacctaaagctttcaatcaatcacaagattacagaggaaggatacagaaatttctttcaagcactggacaacatgccaaacttgcaggagttggacatctccaggcatttcacagagtgtatcaaagctcaggccacaacagtcaagtctttgagtcaatgtgtgttacgactaccaaggctcattagactgaacatgttaagttggctcttggatgcagatgatattgcattgcttaatgtcatgaaagaaagacatcctcaatctaagtacttaactattctccagaaatggatactgccgttctctccaatcattcagaaataaaagattcagctaaaaactgctgaatcaataatttgtcttggggcatattgaggatgtaaaaaaagttgttgattaatgctaaaaaccaaattatccaaaattattttattaaatattgcatacaaaagaaaatgtgtaaggcttgctaaaaaacaaaacaaaacaaaacacagtcctgcatactcaccaccaagctcaagaaataaatcatcaccaatacctttgaggtccctgagtaatccaccccagctaaaggcaaacccttcaatcaagtttatacagcaaaccctccattgtccatggtcaacagggaaggggttggggacaggtctgccaatctatctaaaagccacaatatggaagaagtattcaatttatataataaatggctaacttaacggttgaatcactttcatacatggatgaaacgggtttaacacaggatccacatgaatcttctgtgggccaagagatgttccttaatccttgtagaacctgttttctatattgaactagctttggtacagtagagttaacttactttccatttatccactgccaatataaagaggaaacaggggttagggaaaaatgacttcattccagaggcttctcagagttcaacatatgctataatttagaattttcttatgaatccactctacttgggtagaaaatattttatctctagtgattgcatattatttccatatcatagtatttcatagtattatatttgatatgagtgtctatatcaatgtcagtgtccagaatttcgttcctaccagttaagtagttttctgaacggccagaagaccattcgaaattcatgatactactataagttggtaaacaaccatacttttatcctcatttttattctcactaagaaaaaagtcaactcccctccccttgcccaagtatgaaatatagggacagtatgtatggtgtggtctcatttgtttagaaaaccacttatgactgggtgcggtggctcacacctgtaatcccagcactttgggaggctgaggcgggcgaatcatttgaggtgaggaattcgagaccagcctggccagcatggtgaaaccccatctctactaaaaatacaaaaattagccaggtgtggtggcacatgcctgtagtcccagccactagggcggctgagacgcaagacttgcttgaacccgggaggcagaggttgcagtgagccaagatggcgccactgcattccagcctgggcaacagagcaagaccctgtctgtctcaaaacaaaaaacaaaaccacttatattgctagctacattaagaatttctgaatatgttactgagcttgcttgtggtaaccatttataatatcagaaagtatatgtacaccaaaacatgttgaacatccatgttgtacaactgaaatataaataattttgtcaattatacctaaataaaactggaaaaaaatttctggaagtttatatctaaaaatgttaatagtgcgtacctctaggaagtgggcctggaagccattcttacttttcagtctctcccattctgtactgttttttgttttactttcgtgcctgcattatttttctatttaaaacaaaaataaatctagtttagcact

SEQ ID NO: 2822 - DNA, 3777 bp, Homo sapiens
atgccacttcatattggggacttcgtctgggattccaaggtgcattcattgcaaagttccttaaatattttctcactgcttcctactaaaggacggacagagcatttgttcttcagccacatactttccttccactggccagcattctcctctattagactagaactgtggataaacctcagatgtgaatttcttcggagtaagaaatcctcagaggaaattacccagtatattcaaagctacaagggatttgttgacataacgggagaacattttgtgaattcctgggtccagagagaattacctatggcatcagcttattgcaatgacagcatctttgcttacgaagaactacggctggactcttttaaggactggccccgggaatcagctgtgggagttgcagcactggccaaagcaggtcttttctacacaggtataaaggacatcgtccagtgcttttcctgtggagggtgtttagagaaatggcaggaaggtgatgacccattagacgatcacaccagatgttttcccaattgtccatttctccaaaatatgaagtcctctgcggaagtgactccagaccttcagagccgtggtgaactttgtgaattactggaaaccacaagtgaaagcaatcttgaagattcaatagcagttggtcctatagtgccagaaatggcacagggtgaagcccagtggtttcaagaggcaaagaatctgaatgagcagctgagagcagcttataccagcgccagtttccgccacatgtctttgcttgatatctcttccgatctggccacggaccacttgctgggctgtgatctgtctattgcttcaaaacacatcagcaaacctgtgcaagaacctctggtgctgcctgaggtctttggcaacttgaactctgtcatgtgtgtggagggtgaagctggaagtggaaagacggtcctcctgaagaaaatagcttttctgtgggcatctggatgctgtcccctgttaaacaggttccagctggttttctacctctcccttagttccaccagaccagacgaggggctggccagtatcatctgtgaccagctcctagagaaagaaggatctgttactgaaatgtgcgtgaggaacattatccagcagttaaagaatcaggtcttattccttttagatgactacaaagaaatatgttcaatccctcaagtcataggaaaactgattcaaaaaaaccacttatcccggacctgcctattgattgctgtccgtacaaacagggccagggacatccgccgatacctagagaccattctagagatcaaagcatttcccttttataatactgtctgtatattacggaagctcttttcacataatatgactcgtctgcgaaagtttatggtttactttggaaagaaccaaagtttgcagaagatacagaaaactcctctctttgtggcggcgatctgtgctcattggtttcagtatccttttgacccatcctttgatgatgtggctgttttcaagtcctatatggaacgcctttccttaaggaacaaagcgacagctgaaattctcaaagcaactgtgtcctcctgtggtgagctggccttgaaagggtttttttcatgttgctttgagtttaatgatgatgatctcgcagaagcaggggttgatgaagatgaagatctaaccatgtgcttgatgagcaaatttacagcccagagactaagaccattctaccggtttttaagtcctgccttccaagaatttcttgcggggatgaggctgattgaactcctggattcagataggcaggaacatcaagatttgggactgtatcatttgaaacaaatcaactcacccatgatgactgtaagcgcctacaacaattttttgaactatgtctccagcctcccttcaacaaaagcagggcccaaaattgtgtctcatttgctccatttagtggataacaaagagtcattggagaatatatctgaaaatgatgactacttaaagcaccagccagaaatttcactgcagatgcagttacttaggggattgtggcaaatttgtccacaagcttacttttcaatggtttcagaacatttactggttcttgccctgaaaactgcttatcaaagcaacactgttgctgcgtgttctccatttgttttgcaattccttcaagggagaacactgactttgggtgcgcttaacttacagtactttttcgaccacccagaaagcttgtcattgttgaggagcatccacttcccaatacgaggaaataagacatcacccagagcacatttttcagttctggaaacatgttttgacaaatcacaggtgccaactatagatcaggactatgcttctgcctttgaacctatgaatgaatgggagcgaaatttagctgaaaaagaggataatgtaaagagctatatggatatgcagcgcagggcatcaccagaccttagtactggctattggaaactttctccaaagcagtacaagattccctgtctagaagtcgatgtgaatgatattgatgttgtaggccaggatatgcttgagattctaatgacagttttctcagcttcacagcgcatcgaactccatttaaaccacagcagaggctttatagaaagcatccgcccagctcttgagctgtctaaggcctctgtcaccaagtgctccataagcaagttggaactcagcgcagccgaacaggaactgcttctcaccctgccttccctggaatctcttgaagtctcagggacaatccagtcacaagaccaaatctttcctaatctggataagttcctgtgcctgaaagaactgtctgtggatctggagggcaatataaatgttttttcagtcattcctgaagaatttccaaacttccaccatatggagaaattattgatccaaatttcagctgagtatgatccttccaaactagtaaaattaattcaaaattctccaaaccttcatgttttccatctgaagtgtaacttcttttcggattttgggtctctcatgactatgcttgtttcctgtaagaaactcacagaaattaagttttcggattcattttttcaagccgtcccatttgttgccagtttgccaaattttatttctctgaagatattaaatcttgaaggccagcaatttcctgatgaggaaacatcagaaaaatttgcctacattttaggttctcttagtaacctggaagaattgatccttcctactggggatggaatttatcgagtggccaaactgatcatccagcagtgtcagcagcttcattgtctccgagtcctctcatttttcaagactttgaatgatgacagcgtggtggaaattgccaaagtagcaatcagtggaggtttccagaaacttgagaacctaaagctttcaatcaatcacaagattacagaggaaggatacagaaatttctttcaagcactggacaacatgccaaacttgcaggagttggacatctccaggcatttcacagagtgtatcaaagctcaggccacaacagtcaagtctttgagtcaatgtgtgttacgactaccaaggctcattagactgaacatgttaagttggctcttggatgcagatgatattgcattgcttaatgtcatgaaagaaagacatcctcaatctaagtacttaactattctccagaaatggatactgccgttctctccaatcattcagaaataaaagattcagctaaaaactgctgaatcaataatttgtcttggggcatattga

SEQ ID NO: 2823 - DNA, 6124 bp, Homo sapiens
acaaaaggtcctgtgctcacctgggacccttctggacgttgccctgtgtacctcttcgactgcctgttcatctacgacgaaccccgggtattgaccccagacaacaatgccacttcatattggggacttcgtctgggattccaaggtgcattcattgcaaagttccttaaatattttctcactgcttcctactaaaggacggacagagcatttgttcttcagccacatactttccttccactggccagcattctcctctattagactagaactgtggataaacctcagaaaatggccacccagcagaaagcctctgacgagaggatctcccagtttgatcacaatttgctgccagagctgtctgctcttctgggcctagatgcagttcagttggcaaaggaactagaagaagaggagcagaaggagcgagcaaaaatgcagaaaggctacaactctcaaatgcgcagtgaagcaaaaaggttaaagacttttgtgacttatgagccgtacagctcatggataccacaggagatggcggccgctgggttttacttcactggggtaaaatctgggattcagtgcttctgctgtagcctaatcctctttggtgccggcctcacgagactccccatagaagaccacaagaggtttcatccagattgtgggttccttttgaacaaggatgttggtaacattgccaagtacgacataagggtgaagaatctgaagagcaggctgagaggaggtaaaatgaggtaccaagaagaggaggctagacttgcgtccttcaggaactggccattttatgtccaagggatatccccttgtgtgctctcagaggctggctttgtctttacaggtaaacaggacacggtacagtgtttttcctgtggtggatgtttaggaaattgggaagaaggagatgatccttggaaggaacatgccaaatggttccccaaatgtgaatttcttcggagtaagaaatcctcagaggaaattacccagtatattcaaagctacaagggatttgttgacataacgggagaacattttgtgaattcctgggtccagagagaattacctatggcatcagcttattgcaatgacagcatctttgcttacgaagaactacggctggactcttttaaggactggccccgggaatcagctgtgggagttgcagcactggccaaagcaggtcttttctacacaggtataaaggacatcgtccagtgcttttcctgtggagggtgtttagagaaatggcaggaaggtgatgacccattagacgatcacaccagatgttttcccaattgtccatttctccaaaatatgaagtcctctgcggaagtgactccagaccttcagagccgtggtgaactttgtgaattactggaaaccacaagtgaaagcaatcttgaagattcaatagcagttggtcctatagtgccagaaatggcacagggtgaagcccagtggtttcaagaggcaaagaatctgaatgagcagctgagagcagcttataccagcgccagtttccgccacatgtctttgcttgatatctcttccgatctggccacggaccacttgctgggctgtgatctgtctattgcttcaaaacacatcagcaaacctgtgcaagaacctctggtgctgcctgaggtctttggcaacttgaactctgtcatgtgtgtggagggtgaagctggaagtggaaagacggtcctcctgaagaaaatagcttttctgtgggcatctggatgctgtcccctgttaaacaggttccagctggttttctacctctcccttagttccaccagaccagacgaggggctggccagtatcatctgtgaccagctcctagagaaagaaggatctgttactgaaatgtgcgtgaggaacattatccagcagttaaagaatcaggtcttattccttttagatgactacaaagaaatatgttcaatccctcaagtcataggaaaactgattcaaaaaaaccacttatcccggacctgcctattgattgctgtccgtacaaacagggccagggacatccgccgatacctagagaccattctagagatcaaagcatttcccttttataatactgtctgtatattacggaagctcttttcacataatatgactcgtctgcgaaagtttatggtttactttggaaagaaccaaagtttgcagaagatacagaaaactcctctctttgtggcggcgatctgtgctcattggtttcagtatccttttgacccatcctttgatgatgtggctgttttcaagtcctatatggaacgcctttccttaaggaacaaagcgacagctgaaattctcaaagcaactgtgtcctcctgtggtgagctggccttgaaagggtttttttcatgttgctttgagtttaatgatgatgatctcgcagaagcaggggttgatgaagatgaagatctaaccatgtgcttgatgagcaaatttacagcccagagactaagaccattctaccggtttttaagtcctgccttccaagaatttcttgcggggatgaggctgattgaactcctggattcagataggcaggaacatcaagatttgggactgtatcatttgaaacaaatcaactcacccatgatgactgtaagcgcctacaacaattttttgaactatgtctccagcctcccttcaacaaaagcagggcccaaaattgtgtctcatttgctccatttagtggataacaaagagtcattggagaatatatctgaaaatgatgactacttaaagcaccagccagaaatttcactgcagatgcagttacttaggggattgtggcaaatttgtccacaagcttacttttcaatggtttcagaacatttactggttcttgccctgaaaactgcttatcaaagcaacactgttgctgcgtgttctccatttgttttgcaattccttcaagggagaacactgactttgggtgcgcttaacttacagtactttttcgaccacccagaaagcttgtcattgttgaggagcatccacttcccaatacgaggaaataagacatcacccagagcacatttttcagttctggaaacatgttttgacaaatcacaggtgccaactatagatcaggactatgcttctgcctttgaacctatgaatgaatgggagcgaaatttagctgaaaaagaggataatgtaaagagctatatggatatgcagcgcagggcatcaccagaccttagtactggctattggaaactttctccaaagcagtacaagattccctgtctagaagtcgatgtgaatgatattgatgttgtaggccaggatatgcttgagattctaatgacagttttctcagcttcacagcgcatcgaactccatttaaaccacagcagaggctttatagaaagcatccgcccagctcttgagctgtctaaggcctctgtcaccaagtgctccataagcaagttggaactcagcgcagccgaacaggaactgcttctcaccctgccttccctggaatctcttgaagtctcagggacaatccagtcacaagaccaaatctttcctaatctggataagttcctgtgcctgaaagaactgtctgtggatctggagggcaatataaatgttttttcagtcattcctgaagaatttccaaacttccaccatatggagaaattattgatccaaatttcagctgagtatgatccttccaaactagtaaaattaattcaaaattctccaaaccttcatgttttccatctgaagtgtaacttcttttcggattttgggtctctcatgactatgcttgtttcctgtaagaaactcacagaaattaagttttcggattcattttttcaagccgtcccatttgttgccagtttgccaaattttatttctctgaagatattaaatcttgaaggccagcaatttcctgatgaggaaacatcagaaaaatttgcctacattttaggttctcttagtaacctggaagaattgatccttcctactggggatggaatttatcgagtggccaaactgatcatccagcagtgtcagcagcttcattgtctccgagtcctctcatttttcaagactttgaatgatgacagcgtggtggaaattgccaaagtagcaatcagtggaggtttccagaaacttgagaacctaaagctttcaatcaatcacaagattacagaggaaggatacagaaatttctttcaagcactggacaacatgccaaacttgcaggagttggacatctccaggcatttcacagagtgtatcaaagctcaggccacaacagtcaagtctttgagtcaatgtgtgttacgactaccaaggctcattagactgaacatgttaagttggctcttggatgcagatgatattgcattgcttaatgtcatgaaagaaagacatcctcaatctaagtacttaactattctccagaaatggatactgccgttctctccaatcattcagaaataaaagattcagctaaaaactgctgaatcaataatttgtcttggggcatattgaggatgtaaaaaaagttgttgattaatgctaaaaaccaaattatccaaaattattttattaaatattgcatacaaaagaaaatgtgtaaggcttgctaaaaaacaaaacaaaacaaaacacagtcctgcatactcaccaccaagctcaagaaataaatcatcaccaatacctttgaggtccctgagtaatccaccccagctaaaggcaaacccttcaatcaagtttatacagcaaaccctccattgtccatggtcaacagggaaggggttggggacaggtctgccaatctatctaaaagccacaatatggaagaagtattcaatttatataataaatggctaacttaacggttgaatcactttcatacatggatgaaacgggtttaacacaggatccacatgaatcttctgtgggccaagagatgttccttaatccttgtagaacctgttttctatattgaactagctttggtacagtagagttaacttactttccatttatccactgccaatataaagaggaaacaggggttagggaaaaatgacttcattccagaggcttctcagagttcaacatatgctataatttagaattttcttatgaatccactctacttgggtagaaaatattttatctctagtgattgcatattatttccatatcatagtatttcatagtattatatttgatatgagtgtctatatcaatgtcagtgtccagaatttcgttcctaccagttaagtagttttctgaacggccagaagaccattcgaaattcatgatactactataagttggtaaacaaccatacttttatcctcatttttattctcactaagaaaaaagtcaactcccctccccttgcccaagtatgaaatatagggacagtatgtatggtgtggtctcatttgtttagaaaaccacttatgactgggtgcggtggctcacacctgtaatcccagcactttgggaggctgaggcgggcgaatcatttgaggtgaggaattcgagaccagcctggccagcatggtgaaaccccatctctactaaaaatacaaaaattagccaggtgtggtggcacatgcctgtagtcccagccactagggcggctgagacgcaagacttgcttgaacccgggaggcagaggttgcagtgagccaagatggcgccactgcattccagcctgggcaacagagcaagaccctgtctgtctcaaaacaaaaaacaaaaccacttatattgctagctacattaagaatttctgaatatgttactgagcttgcttgtggtaaccatttataatatcagaaagtatatgtacaccaaaacatgttgaacatccatgttgtacaactgaaatataaataattttgtcaattatacctaaataaaactggaaaaaaatttctggaagtttatatctaaaaatgttaatagtgcgtacctctaggaagtgggcctggaagccattcttacttttcagtctctcccattctgtactgttttttgttttactttcgtgcctgcattatttttctatttaaaacaaaaataaatctagtttagcact

SEQ ID NO: 2824 - DNA, 4543 bp, Homo sapiens
tggcacagatctccagaaacccttgtaatttcctgagtgacaggggtgatagaaacatcttttattagaatacttggtcttggttcctgacacaagagcttctaagacctttggaatctccaagtgataagagtgtatgacagtgagctaactggtggctgggatcctttagacaacttcaggatgggggctatcccctgaaagactaaggcatgattagaggtctgggatttgcagccccacgcctcgacctccagagagggtaaaagggctggagattgattaaccaccagttgccagtgatttaaccaatcatgcctaagtgatggcacctccattaaaaaataaaccacaggtttggagagctttcggtttggttaaccccaaccacataccaagaaggcgatgcacctcaaactgcatgaagacaaaaggtcctgtgctcacctgggacccttctggacgttgccctgtgtacctcttcgactgcctgttcatctacgacgaaccccgggtattgaccccagacaacaatgccacttcatattggggacttcgtctgggattccaaggtgcattcattgcaaagttccttaaatattttctcactgcttcctactaaaggacggacagagcatttgttcttcagccacatactttccttccactggccagcattctcctctattagactagaactgtggataaacctcagatgtgaatttcttcggagtaagaaatcctcagaggaaattacccagtatattcaaagctacaagggatttgttgacataacgggagaacattttgtgaattcctgggtccagagagaattacctatggcatcagcttattgcaatgacagcatctttgcttacgaagaactacggctggactcttttaaggactggccccgggaatcagctgtgggagttgcagcactggccaaagcaggtcttttctacacaggtataaaggacatcgtccagtgcttttcctgtggagggtgtttagagaaatggcaggaaggtgatgacccattagacgatcacaccagatgttttcccaattgtccatttctccaaaatatgaagtcctctgcggaagtgactccagaccttcagagccgtggtgaactttgtgaattactggaaaccacaagtgaaagcaatcttgaagattcaatagcagttggtcctatagtgccagaaatggcacagggtgaagcccagtggtttcaagaggcaaagaatctgaatgagcagctgagagcagcttataccagcgccagtttccgccacatgtctttgcttgatatctcttccgatctggccacggaccacttgctgggctgtgatctgtctattgcttcaaaacacatcagcaaacctgtgcaagaacctctggtgctgcctgaggtctttggcaacttgaactctgtcatgtgtgtggagggtgaagctggaagtggaaagacggtcctcctgaagaaaatagcttttctgtgggcatctggatgctgtcccctgttaaacaggttccagctggttttctacctctcccttagttccaccagaccagacgaggggctggccagtatcatctgtgaccagctcctagagaaagaaggatctgttactgaaatgtgcgtgaggaacattatccagcagttaaagaatcaggtcttattccttttagatgactacaaagaaatatgttcaatccctcaagtcataggaaaactgattcaaaaaaaccacttatcccggacctgcctattgattgctgtccgtacaaacagggccagggacatccgccgatacctagagaccattctagagatcaaagcatttcccttttataatactgtctgtatattacggaagctcttttcacataatatgactcgtctgcgaaagtttatggtttactttggaaagaaccaaagtttgcagaagatacagaaaactcctctctttgtggcggcgatctgtgctcattggtttcagtatccttttgacccatcctttgatgatgtggctgttttcaagtcctatatggaacgcctttccttaaggaacaaagcgacagctgaaattctcaaagcaactgtgtcctcctgtggtgagctggccttgaaagggtttttttcatgttgctttgagtttaatgatgatgatctcgcagaagcaggggttgatgaagatgaagatctaaccatgtgcttgatgagcaaatttacagcccagagactaagaccattctaccggtttttaagtcctgccttccaagaatttcttgcggggatgaggctgattgaactcctggattcagataggcaggaacatcaagatttgggactgtatcatttgaaacaaatcaactcacccatgatgactgtaagcgcctacaacaattttttgaactatgtctccagcctcccttcaacaaaagcagggcccaaaattgtgtctcatttgctccatttagtggataacaaagagtcattggagaatatatctgaaaatgatgactacttaaagcaccagccagaaatttcactgcagatgcagttacttaggggattgtggcaaatttgtccacaagcttacttttcaatggtttcagaacatttactggttcttgccctgaaaactgcttatcaaagcaacactgttgctgcgtgttctccatttgttttgcaattccttcaagggagaacactgactttgggtgcgcttaacttacagtactttttcgaccacccagaaagcttgtcattgttgaggagcatccacttcccaatacgaggaaataagacatcacccagagcacatttttcagttctggaaacatgttttgacaaatcacaggtgccaactatagatcaggactatgcttctgcctttgaacctatgaatgaatgggagcgaaatttagctgaaaaagaggataatgtaaagagctatatggatatgcagcgcagggcatcaccagaccttagtactggctattggaaactttctccaaagcagtacaagattccctgtctagaagtcgatgtgaatgatattgatgttgtaggccaggatatgcttgagattctaatgacagttttctcagcttcacagcgcatcgaactccatttaaaccacagcagaggctttatagaaagcatccgcccagctcttgagctgtctaaggcctctgtcaccaagtgctccataagcaagttggaactcagcgcagccgaacaggaactgcttctcaccctgccttccctggaatctcttgaagtctcagggacaatccagtcacaagaccaaatctttcctaatctggataagttcctgtgcctgaaagaactgtctgtggatctggagggcaatataaatgttttttcagtcattcctgaagaatttccaaacttccaccatatggagaaattattgatccaaatttcagctgagtatgatccttccaaactagtaaaattaattcaaaattctccaaaccttcatgttttccatctgaagtgtaacttcttttcggattttgggtctctcatgactatgcttgtttcctgtaagaaactcacagaaattaagttttcggattcattttttcaagccgtcccatttgttgccagtttgccaaattttatttctctgaagatattaaatcttgaaggccagcaatttcctgatgaggaaacatcagaaaaatttgcctacattttaggttctcttagtaacctggaagaattgatccttcctactggggatggaatttatcgagtggccaaactgatcatccagcagtgtcagcagcttcattgtctccgagtcctctcatttttcaagactttgaatgatgacagcgtggtggaaattgccaaagtagcaatcagtggaggtttccagaaacttgagaacctaaagctttcaatcaatcacaagattacagaggaaggatacagaaatttctttcaagcactggacaacatgccaaacttgcaggagttggacatctccaggcatttcacagagtgtatcaaagctcaggccacaacagtcaagtctttgagtcaatgtgtgttacgactaccaaggctcattagactgaacatgttaagttggctcttggatgcagatgatattgcattgcttaatgtcatgaaagaaagacatcctcaatctaagtacttaactattctccagaaatggatactgccgttctctccaatcattcagaaataaaagattcagctaaaaactgctgaatcaataatttgtcttggggcatattgaggatgtaaaaaaagttgttgattaatgctaaaaaccaaattatccaaaattattttattaaatattgcatacaaaagaaaatgtgtaaggcttgctaaaaaacaaaacaaaacaaaacacagtcctgcatactcaccaccaagctcaagaaataaatcatcaccaatacctttgaggtccctgagtaatccaccccagctaaaggcaaacccttcaatcaagtttatacagca

SEQ ID NO: 2825 - DNA, 1193 bp, Homo sapiens
ctgggctccgcgccggggtccgagtcccacgaagccccggcccgagccgccggatgcccgcgcgcagcggggcccaggtcatgcagcctgggcccccatgccgtgcagctcgcacatatgtggggcagagcagccaccctgcccccagcagcagccgtccatcgtcagacgtgatcatttcctgaggcctcgagtgtgtcagggtgtttgtgcctcataacaacccacaggatggtcacccccgctttgcagatgaagaaaccaaagcagttttgccgacggatggggcaaaagaagcagcgaccagctagagcagggcagccacacagctcgtccgacgcagcccaggcacctgcagagcagccacacagctcgtccgatgcagcccaggcaccttgccccagggagcgctgcttgggaccgcccaccactccgggcccataccgcagcatctatttctcaagcccaaagggccaccttacccgactggggttggagttcttcgaccagccggcagtccccctggcccgggcatttctgggacaggtcctagtccggcgacttcctaatggcacagaactccgaggccgcatcgtggagaccgaggcatacctggggccagaggatgaagccgcccactcaaggggtggccggcagaccccccgcaaccgaggcatgttcatgaagccggggaccctgtacgtgtacatcatttacggcatgtacttctgcatgaacatctccagccagggggacggggcttgcgtcttgctgcgagcactggagcccctggaaggtctggagaccatgcgtcagcttcgcagcaccctccggaaaggcaccgccagccgtgtcctcaaggaccgcgagctctgcagtggcccctccaagctgtgccaggccctggccatcaacaagagctttgaccagagggacctggcacaggatgaagctgtatggctggagcgtggtcccctggagcccagtgagccggctgtagtggcagcagcccgggtgggcgtcggccatgcaggggagtgggcccggaaacccctccgcttctatgtccggggcagcccctgggtcagtgtggtcgacagagtggctgagcaggacacacaggcctgagcaaagggcctgcccagacaagattttttaattgtttaaaaaccgaataaatgttttatttctag

SEQ ID NO: 2826 - DNA, 1205 bp, Homo sapiens
cgcatcgggcccgggaatcggtccggacctggcggtgggcgctgggaagaggatccacctccacgtggcccgccccgccccgggggcgcagccagttcccggcgctcactgccccccttctcccggcttccgtccccttctgcgcaggcgccgctccgccccggtcctaggggtgcttccgtggtcggcggctgctgggctccgcgccggggtccgagtcccacgaagccccggcccgagccgccggatgcccgcgcgcagcggggcccagttttgccgacggatggggcaaaagaagcagcgaccagctagagcagggcagccacacagctcgtccgacgcagcccaggcacctgcagagcagccacacagctcgtccgatgcagcccaggcaccttgccccagggagcgctgcttgggaccgcccaccactccgggcccataccgcagcatctatttctcaagcccaaagggccaccttacccgactggggttggagttcttcgaccagccggcagtccccctggcccgggcatttctgggacaggtcctagtccggcgacttcctaatggcacagaactccgaggccgcatcgtggagaccgaggcatacctggggccagaggatgaagccgcccactcaaggggtggccggcagaccccccgcaaccgaggcatgttcatgaagccggggaccctgtacgtgtacatcatttacggcatgtacttctgcatgaacatctccagccagggggacggggcttgcgtcttgctgcgagcactggagcccctggaaggtctggagaccatgcgtcagcttcgcagcaccctccggaaaggcaccgccagccgtgtcctcaaggaccgcgagctctgcagtggcccctccaagctgtgccaggccctggccatcaacaagagctttgaccagagggacctggcacaggatgaagctgtatggctggagcgtggtcccctggagcccagtgagccggctgtagtggcagcagcccgggtgggcgtcggccatgcaggggagtgggcccggaaacccctccgcttctatgtccggggcagcccctgggtcagtgtggtcgacagagtggctgagcaggacacacaggcctgagcaaagggcctgcccagacaagattttttaattgtttaaaaaccgaataaatgttttatttctagaaaactgtgcc

SEQ ID NO: 2827 - DNA, 1028 bp, Homo sapiens
gtcacactcatctgagggctccagacacatggcctgtgcgtctgtcctgcccagcgtctcccacctgacgcggccaggtgcccagttgctcttcaaggccttttcagttttgccgacggatggggcaaaagaagcagcgaccagctagagcagggcagccacacagctcgtccgacgcagcccaggcacctgcagagcagccacacagctcgtccgatgcagcccaggcaccttgccccagggagcgctgcttgggaccgcccaccactccgggcccataccgcagcatctatttctcaagcccaaagggccaccttacccgactggggttggagttcttcgaccagccggcagtccccctggcccgggcatttctgggacaggtcctagtccggcgacttcctaatggcacagaactccgaggccgcatcgtggagaccgaggcatacctggggccagaggatgaagccgcccactcaaggggtggccggcagaccccccgcaaccgaggcatgttcatgaagccggggaccctgtacgtgtacatcatttacggcatgtacttctgcatgaacatctccagccagggggacggggcttgcgtcttgctgcgagcactggagcccctggaaggtctggagaccatgcgtcagcttcgcagcaccctccggaaaggcaccgccagccgtgtcctcaaggaccgcgagctctgcagtggcccctccaagctgtgccaggccctggccatcaacaagagctttgaccagagggacctggcacaggatgaagctgtatggctggagcgtggtcccctggagcccagtgagccggctgtagtggcagcagcccgggtgggcgtcggccatgcaggggagtgggcccggaaacccctccgcttctatgtccggggcagcccctgggtcagtgtggtcgacagagtggctgagcaggacacacaggcctgagcaaagggcctgcccagacaagattttttaattgtttaaaaaccgaataaatgttttatttct

SEQ ID NO: 2828 - DNA, 884 bp, Homo sapiens
gtaggaccaggtgtcacactcatctgagggctccagacacatggcctgtgcgtctgtcctgcccagcgtctcccacctgacgcggccaggtgcccagttgctcttcaaggccttttcagttttgccgacggatggggcaaaagaagcagcgaccagctagagcagggcagccacacagctcgtccgacgcagcccaggcacctgcagagcagccacacagctcgtccgatgcagcccaggcaccttgccccagggagcgctgcttgggaccgcccaccactccgggcccataccgcagcatctatttctcaagcccaaagggccaccttacccgactggggttggagttcttcgaccagccggcagtccccctggcccgggcatttctgggacaggtcctagtccggcgacttcctaatggcacagaactccgaggccgcatcgtggagaccgaggcatacctggggccagaggatgaagccgcccactcaaggggtggccggcagaccccccgcaaccgaggcatgttcatgaagccggggaccctgtacgtgtacatcatttacggcatgtacttctgcatgaacatctccagccagggggacggggcttgcgtcttgctgcgagcactggagcccctggaaggtctggagaccatgcgtcagcttcgcagcaccctccggaaaggcaccgccagccgtgtcctcaaggaccgcgagctctgcagtggcccctccaagctgtgccaggccctggccatcaacaagagctttgaccagagggacctggcacaggatgaagctgtatggctggagcgtggtcccctggagcccagtgagccggctgtagtggcagcagcccgggtgggcgtcggccatgcaggg

SEQ ID NO: 2829 - DNA, 1665 bp, Homo sapiens
atgcacgcccactgcctgcccttccttctgcacgcctggtgggccctactccaggcgggtgctgcgacggtggccactgcgctcctgcgtacgcgggggcagccctcgtcgccatcccctctggcgtacatgctgagcctctaccgcgacccgctgccgagggcagacatcatccgcagcctacaggcagaagatgtggcagtggatgggcagaactggacgtttgcttttgacttctccttcctgagccaacaagaggatctggcatgggctgagctccggctgcagctgtccagccctgtggacctccccactgagggctcacttgccattgagattttccaccagccaaagcccgacacagagcaggcttcagacagctgcttagagcggtttcagatggacctattcactgtcactttgtcccaggtcaccttttccttgggcagcatggttttggaggtgaccaggcctctctccaagtggctgaagcaccctggggccctggagaagcagatgtccagggtagctggagagtgctggccgcggccccccacaccgcctgccaccaatgtgctccttatgctctactccaacctctcgcaggagcagaggcagctgggtgggtccaccttgctgtgggaagccgagagctcctggcgggcccaggagggacagctgtcctgggagtggggcaagaggcaccgtcgacatcacttgccagacagaagtcaactgtgtcggaaggtcaagttccaggtggacttcaacctgatcggatggggctcctggatcatctaccccaagcagtacaacgcctatcgctgtgagggcgagtgtcctaatcctgttggggaggagtttcatccgaccaaccatgcatacatccagagtctgctgaaacgttaccagccccaccgagtcccttccacttgttgtgccccagtgaagaccaagccgctgagcatgctgtatgtggataatggcagagtgctcctagatcaccataaagacatgatcgtggaagaatgtgggtgcctctgatgacatcctggagggagactggatttgcctgcactctggaaggctgggaaactcctggaagacatgataaccatctaatccagtaaggagaaacagagaggggcaaagttgctctgcccaccagaactgaagaggaggggctgcccactctgtaaatgaagggctcagtggagtctggccaagcacagaggctgctgtcaggaagagggaggaagaagcctgtgcagggggctggctggatgttctctttactgaaaagacagtggcaaggaaaagcacaagtgcatgagttctttactggattttttaaaaacctgtgaaccccccgaaactgtatgtgaaagttgagacatatgtgcatgtattttggaggtgggatgaagtcacctatagctttcatgtattctccaaagtagtctgtgtgtgacctgtccccctccccaaagattaaggatcactgtatagattaaaaagagtccgtcaatctcattgcctcaggctgggttgggggagccccacagctttctggctggccagtggcaatctactggccttgtccagaggctcactggagtggttctctgctaatgagctgtacaacaataaagccattgtctagtt

SEQ ID NO: 2830 - DNA, 1066 bp, Homo sapiens
gaccaacagttggggatacagactaaagatgtggcagtggatgggcagaactggacgtttgcttttgacttctccttcctgagccaacaagaggatctggcatgggctgagctccggctgcagctgtccagccctgtggacctccccactgagggctcacttgccattgagattttccaccagccaaagcccgacacagagcaggcttcagacagctgcttagagcggtttcagatggacctattcactgtcactttgtcccaggtcaccttttccttgggcagcatggttttggaggtgaccaggcctctctccaagtggctgaagcaccctggggccctggagaagcagatgtccagggtagctggagagtgctggccgcggccccccacaccgcctgccaccaatgtgctccttatgctctactccaacctctcgcaggagcagaggcagctgggtgggtccaccttgctgtgggaagccgagagctcctggcgggcccaggagggacagctgtcctgggagtggggcaagaggcaccgtcgacatcacttgccagacagaagtcaactgtgtcggaaggtcaagttccaggtggacttcaacctgatcggatggggctcctggatcatctaccccaagcagtacaacgcctatcgctgtgagggcgagtgtcctaatcctgttggggaggagtttcatccgaccaaccatgcatacatccagagtctgctgaaacgttaccagccccaccgagtcccttccacttgttgtgccccagtgaagaccaagccgctgagcatgctgtatgtggataatggcagagtgctcctagatcaccataaagacatgatcgtggaagaatgtgggtgcctctgatgacatcctggagggagactggatttgcctgcactctggaaggctgggaaactcctggaagacatgataaccatctaatccagtaaggagaaacagagaggggcaaagttgctctgcccaccagaactgaagaggaggggctgcccactctgtaaatgaagggctcagtggagtctggccaagcaca

SEQ ID NO: 2831 - DNA, 796 bp, Homo sapiens
aagaggtgttcgggatcctgagaggaaaaagaaaggagtgtagtcgcgggagtgggttaggccctgtggctaggtaccatagagtctctacacaggactaagtcagcctggtgtgcaggggaggcagacacacaaacagaaaattggactacagtgctaagatgctgtaagaagaggttaactaaaggacaggaagatggggccaagagatggtgctactgtctactttagggatcgtctttcaaggcgaggggcctcctatctcaagctgtgatacaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaacattatacatggcagtgattctgtggagagtgcagagaaggagatcggcttgtggtttcaccctgaggaactggtagattacacgagctgtgctcagaactggatctatgaatgacaggagggcagaccacattgcttttcacatccatttcccctccttcccatggg

SEQ ID NO: 2832 - DNA, 986 bp, Homo sapiens
gtgcaagtgctgcgaaccacgtgggtcccgggcgcgtttcgggtgctggcggctgcagccggagttcaaacctaagcagctggaagggccctgtggctaggtaccatagagtctctacacaggactaagtcagcctggtgtgcaggggaggcagacacacaaacagaaaattggactacagtgctaagatgctgtaagaagaggttaactaaaggacaggaagatggggccaagagatggtgctactgtctactttagggatcgtctttcaaggcgaggggcctcctatctcaagctgtgatacaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaacattatacatggcagtgattctgtggagagtgcagagaaggagatcggcttgtggtttcaccctgaggaactggtagattacacgagctgtgctcagaactggatctatgaatgacaggagggcagaccacattgcttttcacatccatttcccctccttcccatgggcagaggaccaggctgtaggaaatctagttatttacaggaacttcatcataatttggagggaagctcttggagctgtgagttctccctgtacagtgttaccatccccgaccatctgattaaaatgcttcctcccagcataggattcattgagttggttacttca

SEQ ID NO: 2833 - DNA, 940 bp, Homo sapiens
gggctctccggcagcggatctgcgcagaagcgttccgtgcgtgcaagtgctgcgaaccacgtgggtcccgggcgcgtttcgggtgctggcggctgcagccggagttcaaacctaagcagctggaaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaacattatacatggcagtgattctgtggagagtgcagagaaggagatcggcttgtggtttcaccctgaggaactggtagattacacgagctgtgctcagaactggatctatgaatgacaggagggcagaccacattgcttttcacatccatttcccctccttcccatgggcagaggaccaggctgtaggaaatctagttatttacaggaacttcatcataatttggagggaagctcttggagctgtgagttctccctgtacagtgttaccatccccgaccatctgattaaaatgcttcctcccagcataggattcattgagttggttacttcatattgttgcattgcttttttttccttcttttcatgtacactgaataacctgacctaatagagagtgtaaatactataaaaatgatttattttgaggtctcacatacacacaggcattctttgcctgcccttctt

SEQ ID NO: 2834 - DNA, 510 bp, Homo sapiens
ggacatttttagggtgtatttctggcgctttagtcctgttttctcctggacaatttatgcttgccccgcaccccatcgtgcgattctccgcagtctttgggctttgtctctctctctttttttttttttggaagttgcagaatggtgataaatgattttctttgctcctattgactgctaggccctgtggctaggtaccatagagtctctacacaggactaagtcagcctggtgtgcaggggaggcagacacacaaacagaaaattggactacagtgctaagatgctgtaagaagaggttaactaaaggacaggaagatggggccaagagatggtgctactgtctactttagggatcgtctttcaaggcgaggggcctcctatctcaagctgtgatacaggaaccatggccaactgtgagcgtaccttcattgcgatcaaaccagatggggtccagcggggtcttgtgggagagattatcaagcgttttgagcagaaaggattccgcctt

SEQ ID NO: 2835 - DNA, 995 bp, Homo sapiens
gcgggccgggcgtcatgggcggcctcttctggcgctccgcgctgcgggggctgcgctgcggcccgcgggccccgggcccgagcctgctagtgcgccacggctcgggagggccctcctggacccgggagcggaccctggtggcggtgaagcccgatggcgtgcaacggcggctcgttggggacgtgatccagcgctttgagaggcggggcttcacgctggtggggatgaagatgctgcaggcaccagagagcgtccttgccgagcactaccaggacctgcggaggaagcccttctaccctgccctcatccgctacatgagctctgggcctgtggtggccatggtctgggaagggtacaatgtcgtccgcgcctcgagggccatgattggacacaccgactcggctgaggctgccccaggaaccataaggggtgacttcagcgtccacatcagcaggaatgtcatccacgccagcgactccgtggagggggcccagcgggagatccagctgtggttccagagcagtgagctggtgagctgggcagacgggggccagcacagcagcatccacccagcctgaggctcaagctgcccttaccaccccatcccccacgcaggaccaactacctccgtcagcaagaacccaagcccacatccaaacctgcctgtcccaaaccacttacttccctgttcacctctgccccaccccagcccagaggagtttgagccaccaacttcagtgcctttctgtaccccaagccagcacaagattggaccaatcctttttgcaccaaagtgccggacaacctttgtggtgggggggggtcttcacattatcataacctctcctctaaaggggaggcattaaaattcactgtgcccagcacatgggtggtacactaattatgacttcccccagctctgaggtagaaatgacgcctttatgcaagttgtaaggagttgaacagtaaagaggaagttttgcacacccagttcc

SEQ ID NO: 2836 - DNA, 766 bp, Homo sapiens
gcgggccgggcgtcatgggcggcctcttctggcgctccgcgctgcgggggctgcgctgcggcccgcgggccccgggcccgagcctgctagtgcgccacggctcggggctccctccatcggctctgaaaagagggccctcctggacccgggagcggaccctggtggcggtgaagcccgatggcgtgcaacggcggctcgttggggacgtgatccagcgctttgagaggcggggcttcacgctggtggggatgaagatgctgcaggcaccagagagcgtccttgccgagcactaccaggacctgcggaggaagcccttctaccctgccctcatccgctacatgagctctgggcctgtggtggccatggtctgggaagggtacaatgtcgtccgcgcctcgagggccatgattggacacaccgactcggctgaggctgccccaggaaccataaggggtgacttcagcgtccacatcagcaggaatgtcatccacgccagcgactccgtggagggggcccagcgggagatccagctgtggttccagagcagtgagctggtgagctgggcagacgggggccagcacagcagcatccacccagcctgaggctcaagctgcccttaccaccccatcccccacgcaggaccaactacctccgtcagcaagaacccaagcccacatccaaacctgcctgtcccaaaccacttacttccctgttcacctctgccccaccccagcccagaggagtttgagccaccaacttcagtgcc

SEQ ID NO: 2837 - DNA, 1232 bp, Homo sapiens
cctccttctcccgccctggggctcacgtgggaatttcaccctccattggagggggctcagaccagggcttctagacctccttttggtccgtgaatttatttttgagacagagtcttgctctattgctcaggctggagtgcagcggtgcagtcacagctcactgcagcctcaatctcctgggctcacgcgatcctcctgcctcagcctcccgagtgggccttcctccgtgggaaagcgttaaaacgatagttaacggttgcgtcggtgtaaagacgaatgcaattcgagaaggattcattattattttgttttttcttctgatttttaacagaaattggcgttgaacatttcccccgagggccctcctggacccgggagcggaccctggtggcggtgaagcccgatggcgtgcaacggcggctcgttggggacgtgatccagcgctttgagaggcggggcttcacgctggtggggatgaagatgctgcaggcaccagagagcgtccttgccgagcactaccaggacctgcggaggaagcccttctaccctgccctcatccgctacatgagctctgggcctgtggtggccatggtctgggaagggtacaatgtcgtccgcgcctcgagggccatgattggacacaccgactcggctgaggctgccccaggaaccataaggggtgacttcagcgtccacatcagcaggaatgtcatccacgccagcgactccgtggagggggcccagcgggagatccagctgtggttccagagcagtgagctggtgagctgggcagacgggggccagcacagcagcatccacccagcctgaggctcaagctgcccttaccaccccatcccccacgcaggaccaactacctccgtcagcaagaacccaagcccacatccaaacctgcctgtcccaaaccacttacttccctgttcacctctgccccaccccagcccagaggagtttgagccaccaacttcagtgcctttctgtaccccaagccagcacaagattggaccaatcctttttgcaccaaagtgccggacaacctttgtggtgggggggggtcttcacattatcataacctctcctctaaaggggaggcattaaaattcactgtgcccagcacatgggtggtacactaattatgacttcccccagctctgaggtagaaatgacgcctttatgcaagttgtaaggagttgaacagtaaagaggaagttttg

SEQ ID NO: 2838 - DNA, 966 bp, Homo sapiens
ctggcgctccgcgctgcgggggctgcgctgcggcccgcgggccccgggcccgagcctgctagtgcgccacggctcgggagggccctcctggacccgggagcggaccctggtggcggtgaagcccgatggcgtgcaacggcggctcgttggggacgtgatccagcgctttgagaggcggggcttcacgctggtggggatgaagatgctgcaggcaccagagagcgtccttgccgagcactaccaggacctgcggaggaagcccttctaccctgccctcatccgctacatgagctctgggcctgtggtggccatggtctgggaagggtacaatgtcgtccgcgcctcgagggccatgattggacacaccgactcggctgaggctgccccaggaaccataaggggtgacttcagcgtccacatcagcagtcacaggcttgctcccctagacagagggcaacgggagcagcagatggtccctgggattcctcagggtgcacatgaagcctgagcctcacattgctcctgtcctggcacaggaatgtcatccacgccagcgactccgtggagggggcccagcgggagatccagctgtggttccagagcagtgagctggtgagctgggcagacgggggccagcacagcagcatccacccagcctgaggctcaagctgcccttaccaccccatcccccacgcaggaccaactacctccgtcagcaagaacccaagcccacatccaaacctgcctgtcccaaaccacttacttccctgttcacctctgccccaccccagcccagaggagtttgagccaccaacttcagtgcctttctgtaccccaagccagcacaagattggaccaatcctttttgcaccaaagtgccggacaacctttgtggtgggggggggtcttcacattatcataacctctcctctaaaggggaggcattaaaattcactgtgcccagca

SEQ ID NO: 2839 - DNA, 1111 bp, Homo sapiens
cagcggcccgcgggccgggcgtcatgggcggcctcttctggcgctccgcgctgcgggggctgcgctgcggcccgcgggccccgggcccgagcctgctagtgcgccacggctcgggagggccctcctggacccgggagcggaccctggtggcggtgaagcccgatggcgtgcaacggcggctcgttggggacgtgatccagcgctttgagaggcggggcttcacgctggtggggatgaagatgctgcaggcaccagagagcgtccttgccgagcactaccaggacctgcggaggaagcccttctaccctgccctcatccgctacatgagctctgggcctgtggtggccatggtctgggaagggtacaatgtcgtccgcgcctcgagggccatgattggacacaccgactcggctgaggctgccccaggaaccataaggggtgacttcagcgtccacatcagcaggaatgtcatccacgccagcgactccgtggagggggcccagcgggagatccagctgtggttccagagcagtgagctgtccccgacgggagcgccatggcccagccgccgcccgacgtggagggggacgactgtctccccgcgtaccgccacctcttctgcccggacctgctgcgggacaaagtggccttcatcacaggaggcggctctgggattgggttccggattgctgagattttcatgcggcacggctgccatacggtgattgccagtaggagcctgccgcgagtgctgacgagatgggttttcaccacgttgaccaggctggtctcgaattcctgacctcaggtgatccgcccacctcagcctcccaaagtgccaggattacaggccgccaggaagctggctggggccaccggccggcgctgcctccctctctctatggacgtccgagcgcccccagctgtcatggccgccgtggaccaggctctgaaggagtttggcagaatcgacattctcattaactgtgcggccgggaacttcctgtgccccgctggcgccttgtccttcaacgccttcaagaccgtgatggacatcgataccagcggcaccttcaatgtgtctcgtgtgctctatgagaagttcttccgg

SEQ ID NO: 2840 - DNA, 985 bp, Homo sapiens
ggggagccgctccgctggggcgttcgctgaaggccaagttaggccagaatctgactgggacgtcaggccccaagtccccggccccgccgctgcccggcccccccagctgccacctcacaggacgatccatgtcccagggctccctccatcggctctgaaaagtgagccgccgcctgcaatgcccgcaccagccgcagcagagccccaggctacacaaggcgccctgcaaactgggttttgggggaacaaaccaaccagggggtcttcctcccgtgggcttcagccgcctgctggggttaacttttcctcctggcctggcggagcccctttggctctgtccagattctgtgggacatacagggtctgggctcctctggaaaccagggacccgatgccggagggtagcttggctctggagcagcctgggactataggaaggagggccctcctggacccgggagcggaccctggtggcggtgaagcccgatggcgtgcaacggcggctcgttggggacgtgatccagcgctttgagaggcggggcttcacgctggtggggatgaagatgctgcaggcaccagagagcgtccttgccgagcactaccaggacctgcggaggaagcccttctaccctgccctcatccgctacatgagctctgggcctgtggtggccatggtctgggaagggtacaatgtcgtccgcgcctcgagggccatgattggacacaccgactcggctgaggctgccccaggaaccataaggggtgacttcagcgtccacatcagcaggaatgtcatccacgccagcgactccgtggagggggcccagcgggagatccagctgtggttccagagcagtgagctggtgagctgggcagacgggggccagcacagcagcatccacccagcctgaggctcaagctgcccttaccaccccatcccccacgcaggaccaactacctccgtcagcaagaacccaagcccaca

SEQ ID NO: 2841 - DNA, 719 bp, Homo sapiens
attggagggggctcagaccagggcttctagacctccttttggtccgtgaatttatttttgagacagagtcttgctctattgctcaggctggagtgcagcggtgcagtcacagctcactgcagcctcaatctcctgggctcacgcgatcctcctgcctcagcctcccgagtgggccttcctccgtgggaaagcgttaaaacgatagttaacggttgcgtcggtgtaaagacgaatgcaattcgagaaggattcattattattttgttttttcttctgatttttaacagaaattggcgttgaacatttccccccgtcccctccagaggaggacggctggggcggagctcagcgctgaccctgggtctggaagcgacaggccttgaaactccacagcagcacaggccccgtctcctggctcggacagaaccctgctaccttccctcttcaatcttcaggcccctttttgtccgtgtttccagggctcacctggagggccctcctggacccgggagcggaccctggtggcggtgaagcccgatggcgtgcaacggcggctcgttggggacgtgatccagcgctttgagaggcggggcttcacgctggtggggatgaagatgctgcaggcaccagagagcgtccttgccgagcactaccaggacctgcggaggaagcccttctaccctgccctcatccgctacatgagctctgggcctgtggtg

SEQ ID NO: 2842 - DNA, 551 bp, Homo sapiens
ttccggttatgcaggaaggaaattgacgaacacgtgacgcggtcgggcggaccactgcagactgagcggtggaccgaattgggaccgctggcttataagcgatcatgtttctccagtattacctcaacgagcagggagatcgagtctatacgctgaagaaatttgacccgatgggacaacagacctgctcagcccatcctgctcggttctccccagatgacaaatactctcgacaccgaatcaccatcaagaaacgcttcaaggtgctcatgacccagcaaccgcgccctgtcctctgagggtcccttaaactgatgtcttttctgccacctgttacccctcggagactccgtaaccaaactcttcggactgtgagccctgatgcctttttgccagccatactctttggcatccagtctctcgtggcgattgattatgcttgtgtgaggcaatcatggtggcatcacccataaagggaacacatttgacttttttttctcatattttaaattactacaagattattaaagataaaatgatttgaaaaactc

SEQ ID NO: 2843 - DNA, 9371 bp, Homo sapiens
gcgcgtgtgcgtcccagccccgccggccagcgcaggaggccgccgcccgggcgcagagggcagccggtggggaggcatgccgccgctcctggcgcccctgctctgcctggcgctgctgcccgcgctcgccgcacgaggcccgcgatgctcccagcccggtgagacctgcctgaatggcgggaagtgtgaagcggccaatggcacggaggcctgcgtctgtggcggggccttcgtgggcccgcgatgccaggaccccaacccgtgcctcagcaccccctgcaagaacgccgggacatgccacgtggtggaccgcagaggcgtggcagactatgcctgcagctgtgccctgggcttctctgggcccctctgcctgacacccctggacaatgcctgcctcaccaacccctgccgcaacgggggcacctgcgacctgctcacgctgacggagtacaagtgccgctgcccgcccggctggtcagggaaatcgtgccagcaggctgacccgtgcgcctccaacccctgcgccaacggtggccagtgcctgcccttcgaggcctcctacatctgccactgcccacccagcttccatggccccacctgccggcaggatgtcaacgagtgtggccagaagcccgggctttgccgccacggaggcacctgccacaacgaggtcggctcctaccgctgcgtctgccgcgccacccacactggccccaactgcgagcggccctacgtgccctgcagcccctcgccctgccagaacgggggcacctgccgccccacgggcgacgtcacccacgagtgtgcctgcctgccaggcttcaccggccagaactgtgaggaaaatatcgacgattgtccaggaaacaactgcaagaacgggggtgcctgtgtggacggcgtgaacacctacaactgccgctgcccgccagagtggacaggtcagtactgtaccgaggatgtggacgagtgccagctgatgccaaatgcctgccagaacggcgggacctgccacaacacccacggtggctacaactgcgtgtgtgtcaacggctggactggtgaggactgcagcgagaacattgatgactgtgccagcgccgcctgcttccacggcgccacctgccatgaccgtgtggcctccttctactgcgagtgtccccatggccgcacaggtctgctgtgccacctcaacgacgcatgcatcagcaacccctgtaacgagggctccaactgcgacaccaaccctgtcaatggcaaggccatctgcacctgcccctcggggtacacgggcccggcctgcagccaggacgtggatgagtgctcgctgggtgccaacccctgcgagcatgcgggcaagtgcatcaacacgctgggctccttcgagtgccagtgtctgcagggctacacgggcccccgatgcgagatcgacgtcaacgagtgcgtctcgaacccgtgccagaacgacgccacctgcctggaccagattggggagttccagtgcatctgcatgcccggctacgagggtgtgcactgcgaggtcaacacagacgagtgtgccagcagcccctgcctgcacaatggccgctgcctggacaagatcaatgagttccagtgcgagtgccccacgggcttcactgggcatctgtgccagtacgatgtggacgagtgtgccagcaccccctgcaagaatggtgccaagtgcctggacggacccaacacttacacctgtgtgtgcacggaagggtacacggggacgcactgcgaggtggacatcgatgagtgcgaccccgacccctgccactacggctcctgcaaggacggcgtcgccaccttcacctgcctctgccgcccaggctacacgggccaccactgcgagaccaacatcaacgagtgctccagccagccctgccgccacgggggcacctgccaggaccgcgacaacgcctacctctgcttctgcctgaaggggaccacaggacccaactgcgagatcaacctggatgactgtgccagcagcccctgcgactcgggcacctgtctggacaagatcgatggctacgagtgtgcctgtgagccgggctacacagggagcatgtgtaacatcaacatcgatgagtgtgcgggcaacccctgccacaacgggggcacctgcgaggacggcatcaatggcttcacctgccgctgccccgagggctaccacgaccccacctgcctgtctgaggtcaatgagtgcaacagcaacccctgcgtccacggggcctgccgggacagcctcaacgggtacaagtgcgactgtgaccctgggtggagtgggaccaactgtgacatcaacaacaatgagtgtgaatccaacccttgtgtcaacggcggcacctgcaaagacatgaccagtggctacgtgtgcacctgccgggagggcttcagcggtcccaactgccagaccaacatcaacgagtgtgcgtccaacccatgtctgaaccagggcacgtgtattgacgacgttgccgggtacaagtgcaactgcctgctgccctacacaggtgccacgtgtgaggtggtgctggccccgtgtgcccccagcccctgcagaaacggcggggagtgcaggcaatccgaggactatgagagcttctcctgtgtctgccccacgggctggcaagggcagacctgtgaggtcgacatcaacgagtgcgttctgagcccgtgccggcacggcgcatcctgccagaacacccacggcggctaccgctgccactgccaggccggctacagtgggcgcaactgcgagaccgacatcgacgactgccggcccaacccgtgtcacaacgggggctcctgcacagacggcatcaacacggccttctgcgactgcctgcccggcttccggggcactttctgtgaggaggacatcaacgagtgtgccagtgacccctgccgcaacggggccaactgcacggactgcgtggacagctacacgtgcacctgccccgcaggcttcagcgggatccactgtgagaacaacacgcctgactgcacagagagctcctgcttcaacggtggcacctgcgtggacggcatcaactcgttcacctgcctgtgtccacccggcttcacgggcagctactgccagcacgatgtcaatgagtgcgactcacagccctgcctgcatggcggcacctgtcaggacggctgcggctcctacaggtgcacctgcccccagggctacactggccccaactgccagaaccttgtgcactggtgtgactcctcgccctgcaagaacggcggcaaatgctggcagacccacacccagtaccgctgcgagtgccccagcggctggaccggcctttactgcgacgtgcccagcgtgtcctgtgaggtggctgcgcagcgacaaggtgttgacgttgcccgcctgtgccagcatggagggctctgtgtggacgcgggcaacacgcaccactgccgctgccaggcgggctacacaggcagctactgtgaggacctggtggacgagtgctcacccagcccctgccagaacggggccacctgcacggactacctgggcggctactcctgcaagtgcgtggccggctaccacggggtgaactgctctgaggagatcgacgagtgcctctcccacccctgccagaacgggggcacctgcctcgacctccccaacacctacaagtgctcctgcccacggggcactcagggtgtgcactgtgagatcaacgtggacgactgcaatccccccgttgaccccgtgtcccggagccccaagtgctttaacaacggcacctgcgtggaccaggtgggcggctacagctgcacctgcccgccgggcttcgtgggtgagcgctgtgagggggatgtcaacgagtgcctgtccaatccctgcgacgcccgtggcacccagaactgcgtgcagcgcgtcaatgacttccactgcgagtgccgtgctggtcacaccgggcgccgctgcgagtccgtcatcaatggctgcaaaggcaagccctgcaagaatgggggcacctgcgccgtggcctccaacaccgcccgcgggttcatctgcaagtgccctgcgggcttcgagggcgccacgtgtgagaatgacgctcgtacctgcggcagcctgcgctgcctcaacggcggcacatgcatctccggcccgcgcagccccacctgcctgtgcctgggccccttcacgggccccgaatgccagttcccggccagcagcccctgcctgggcggcaacccctgctacaaccaggggacctgtgagcccacatccgagagccccttctaccgttgcctgtgccccgccaaattcaacgggctcttgtgccacatcctggactacagcttcgggggtggggccgggcgcgacatccccccgccgctgatcgaggaggcgtgcgagctgcccgagtgccaggaggacgcgggcaacaaggtctgcagcctgcagtgcaacaaccacgcgtgcggctgggacggcggtgactgctccctcaacttcaatgacccctggaagaactgcacgcagtctctgcagtgctggaagtacttcagtgacggccactgtgacagccagtgcaactcagccggctgcctcttcgacggctttgactgccagcgtgcggaaggccagtgcaaccccctgtacgaccagtactgcaaggaccacttcagcgacgggcactgcgaccagggctgcaacagcgcggagtgcgagtgggacgggctggactgtgcggagcatgtacccgagaggctggcggccggcacgctggtggtggtggtgctgatgccgccggagcagctgcgcaacagctccttccacttcctgcgggagctcagccgcgtgctgcacaccaacgtggtcttcaagcgtgacgcacacggccagcagatgatcttcccctactacggccgcgaggaggagctgcgcaagcaccccatcaagcgtgccgccgagggctgggccgcacctgacgccctgctgggccaggtgaaggcctcgctgctccctggtggcagcgagggtgggcggcggcggagggagctggaccccatggacgtccgcggctccatcgtctacctggagattgacaaccggcagtgtgtgcaggcctcctcgcagtgcttccagagtgccaccgacgtggccgcattcctgggagcgctcgcctcgctgggcagcctcaacatcccctacaagatcgaggccgtgcagagtgagaccgtggagccgcccccgccggcgcagctgcacttcatgtacgtggcggcggccgcctttgtgcttctgttcttcgtgggctgcggggtgctgctgtcccgcaagcgccggcggcagcatggccagctctggttccctgagggcttcaaagtgtctgaggccagcaagaagaagcggcgggagcccctcggcgaggactccgtgggcctcaagcccctgaagaacgcttcagacggtgccctcatggacgacaaccagaatgagtggggggacgaggacctggagaccaagaagttccggttcgaggagcccgtggttctgcctgacctggacgaccagacagaccaccggcagtggactcagcagcacctggatgccgctgacctgcgcatgtctgccatggcccccacaccgccccagggtgaggttgacgccgactgcatggacgtcaatgtccgcgggcctgatggcttcaccccgctcatgatcgcctcctgcagcgggggcggcctggagacgggcaacagcgaggaagaggaggacgcgccggccgtcatctccgacttcatctaccagggcgccagcctgcacaaccagacagaccgcacgggcgagaccgccttgcacctggccgcccgctactcacgctctgatgccgccaagcgcctgctggaggccagcgcagatgccaacatccaggacaacatgggccgcaccccgctgcatgcggctgtgtctgccgacgcacaaggtgtcttccagatcctgatccggaaccgagccacagacctggatgcccgcatgcatgatggcacgacgccactgatcctggctgcccgcctggccgtggagggcatgctggaggacctcatcaactcacacgccgacgtcaacgccgtagatgacctgggcaagtccgccctgcactgggccgccgccgtgaacaatgtggatgccgcagttgtgctcctgaagaacggggctaacaaagatatgcagaacaacagggaggagacacccctgtttctggccgcccgggagggcagctacgagaccgccaaggtgctgctggaccactttgccaaccgggacatcacggatcatatggaccgcctgccgcgcgacatcgcacaggagcgcatgcatcacgacatcgtgaggctgctggacgagtacaacctggtgcgcagcccgcagctgcacggagccccgctggggggcacgcccaccctgtcgcccccgctctgctcgcccaacggctacctgggcagcctcaagcccggcgtgcagggcaagaaggtccgcaagcccagcagcaaaggcctggcctgtggaagcaaggaggccaaggacctcaaggcacggaggaagaagtcccaggacggcaagggctgcctgctggacagctccggcatgctctcgcccgtggactccctggagtcaccccatggctacctgtcagacgtggcctcgccgccactgctgccctccccgttccagcagtctccgtccgtgcccctcaaccacctgcctgggatgcccgacacccacctgggcatcgggcacctgaacgtggcggccaagcccgagatggcggcgctgggtgggggcggccggctggcctttgagactggcccacctcgtctctcccacctgcctgtggcctctggcaccagcaccgtcctgggctccagcagcggaggggccctgaatttcactgtgggcgggtccaccagtttgaatggtcaatgcgagtggctgtcccggctgcagagcggcatggtgccgaaccaatacaaccctctgcgggggagtgtggcaccaggccccctgagcacacaggccccctccctgcagcatggcatggtaggcccgctgcacagtagccttgctgccagcgccctgtcccagatgatgagctaccagggcctgcccagcacccggctggccacccagcctcacctggtgcagacccagcaggtgcagccacaaaacttacagatgcagcagcagaacctgcagccagcaaacatccagcagcagcaaagcctgcagccgccaccaccaccaccacagccgcaccttggcgtgagctcagcagccagcggccacctgggccggagcttcctgagtggagagccgagccaggcagacgtgcagccactgggccccagcagcctggcggtgcacactattctgccccaggagagccccgccctgcccacgtcgctgccatcctcgctggtcccacccgtgaccgcagcccagttcctgacgcccccctcgcagcacagctactcctcgcctgtggacaacacccccagccaccagctacaggtgcctgagcaccccttcctcaccccgtcccctgagtcccctgaccagtggtccagctcgtccccgcattccaacgtctccgactggtccgagggcgtctccagccctcccaccagcatgcagtcccagatcgcccgcattccggaggccttcaagtaaacggcgcgccccacgagaccccggcttcctttcccaagccttcgggcgtctgtgtgcgctctgtggatgccagggccgaccagaggagcctttttaaaacacatgtttttatacaaaataagaacgaggattttaattttttttagtatttatttatgtacttttattttacacagaaacactgcctttttatttatatgtactgttttatctggccccaggtagaaacttttatctattctgagaaaacaagcaagttctgagagccagggttttcctacgtaggatgaaaagattcttctgtgtttataaaatataaacaaagattcatgatttataaatgccatttatttattgattccttttttcaaaatccaaaaagaaatgatgttggagaagggaagttgaacgagcatagtccaaaaagctcctggggcgtccaggccgcgccctttccccgacgcccacccaaccccaagccagcccggccgctccaccagcatcacctgcctgttaggagaagctgcatccagaggcaaacggaggcaaagctggctcaccttccgcacgcggattaatttgcatctgaaataggaaacaagtgaaagcatatgggttagatgttgccatgtgttttagatggtttcttgcaagcatgcttgtgaaaatgtgttctcggagtgtgtatgccaagagtgcacccatggtaccaatcatgaatctttgtttcaggttcagtattatgtagttgttcgttggttatacaagttcttggtccctccagaaccaccccggccccctgcccgttcttgaaatgtaggcatcatgcatgtcaaacatgagatgtgtggactgtggcacttgcctgggtcacacacggaggcatcctacccttttctggggaaagacactgcctgggctgaccccggtggcggccccagcacctcagcctgcacagtgtcccccaggttccgaagaagatgctccagcaacacagcctgggccccagctcgcgggacccgaccccccgtgggctcccgtgttttgtaggagacttgccagagccgggcacattgagctgtgcaacgccgtgggctgcgtcctttggtcctgtccccgcagccctggcagggggcatgcggtcgggcaggggctggagggaggcgggggctgcccttgggccacccctcctagtttgggaggagcagatttttgcaataccaagtatagcctatggcagaaaaaatgtctgtaaatatgtttttaaaggtggattttgtttaaaaaatcttaatgaatgagtctgttgtgtgtcatgccagtgagggacgtcagacttggctcagctcggggagccttagccgcccatgcactggggacgctccgctgccgtgccgcctgcactcctcagggcagcctcccccggctctacgggggccgcgtggtgccatccccagggggcatgaccagatgcgtcccaagatgttgatttttactgtgttttataaaatagagtgtagtttacagaaaaagactttaaaagtgatctacatgaggaactgtagatgatgtatttttttcatcttttttgttaactgatttgcaataaaaatgatactgatggtga

SEQ ID NO: 2844 - DNA, 6745 bp, Homo sapiens
agacgtgaggcttgcagcaggccgaggaggaagaagaggggcagtgggagcagaggaggtggctcctgccccagtgagagctctgagggtccctgcctgaagagggacagggaccggggcttggagaaggggctgtggaatgcagcccccttcactgctgctgctgctgctgctgctgctgctgctatgtgtctcagtggtcagacccagagggctgctgtgtgggagtttcccagaaccctgtgccaatggaggcacctgcctgagcctgtctctgggacaagggacctgccagtgtgcccctggcttcctgggtgagacgtgccagtttcctgacccctgccagaacgcccagctctgccaaaatggaggcagctgccaagccctgcttcctgctcccctagggctccccagctctccctctccattgacacccagcttcttgtgcacttgcctccctggcttcactggtgagagatgccaggccaagcttgaagacccttgtcctccctccttctgttccaaaaggggccgctgccacatccaggcctcgggccgcccacagtgctcctgcatgcctggatggacaggtgagcagtgccagcttcgggacttctgttcagccaacccatgtgttaatggaggggtgtgtctggccacatacccccagatccagtgccactgcccaccgggcttcgagggccatgcctgtgaacgtgatgtcaacgagtgcttccaggacccaggaccctgccccaaaggcacctcctgccataacaccctgggctccttccagtgcctctgccctgtggggcaggagggtccacgttgtgagctgcgggcaggaccctgccctcctaggggctgttcgaatgggggcacctgccagctgatgccagagaaagactccacctttcacctctgcctctgtcccccaggtttcataggcccagactgtgaggtgaatccagacaactgtgtcagccaccagtgtcagaatgggggcacttgccaggatgggctggacacctacacctgcctctgcccagaaacctggacaggctgggactgctccgaagatgtggatgagtgtgagacccagggtccccctcactgcagaaacgggggcacctgccagaactctgctggtagctttcactgcgtgtgtgtgagtggctggggcggcacaagctgtgaggagaacctggatgactgtattgctgccacctgtgccccgggatccacctgcattgaccgggtgggctctttctcctgcctctgcccacctggacgcacaggactcctgtgccacttggaagacatgtgtctgagccagccgtgccatggggatgcccaatgcagcaccaaccccctcacaggctccacactctgcctgtgtcagcctggctattcggggcccacctgccaccaggacctggacgagtgtctgatggcccagcaaggcccaagtccctgtgaacatggcggttcctgcctcaacactcctggctccttcaactgcctctgtccacctggctacacaggctcccgttgtgaggctgatcacaatgagtgcctctcccagccctgccacccaggaagcacctgtctggacctacttgccaccttccactgcctctgcccgccaggcttagaagggcagctctgtgaggtggagaccaacgagtgtgcctcagctccctgcctgaaccacgcggattgccatgacctgctcaacggcttccagtgcatctgcctgcctggattctccggcacccgatgtgaggaggatatcgatgagtgcagaagctctccctgtgccaatggtgggcagtgccaggaccagcctggagccttccactgcaagtgtctcccaggctttgaagggccacgctgtcaaacagaggtggatgagtgcctgagtgacccatgtcccgttggagccagctgccttgatcttccaggagccttcttttgcctctgcccctctggtttcacaggccagctctgtgaggttcccctgtgtgctcccaacctgtgccagcccaagcagatatgtaaggaccagaaagacaaggccaactgcctctgtcctgatggaagccctggctgtgccccacctgaggacaactgcacctgccaccacgggcactgccagagatcctcatgtgtgtgtgacgtgggttggacggggccagagtgtgaggcagagctagggggctgcatctctgcaccctgtgcccatggggggacctgctacccccagccctctggctacaactgcacctgccctacaggctacacaggacccacctgtagtgaggagatgacagcttgtcactcagggccatgtctcaatggcggctcctgcaaccctagccctggaggctactactgcacctgccctccaagccacacagggccccagtgccaaaccagcactgactactgtgtgtctgccccgtgcttcaatgggggtacctgtgtgaacaggcctggcaccttctcctgcctctgtgccatgggcttccagggcccgcgctgtgagggaaagctccgccccagctgtgcagacagcccctgtaggaatagggcaacctgccaggacagccctcagggtccccgctgcctctgccccactgtctacaccggaggcagctgccagactctgatggacttatgtgcccagaagccctgcccacgcaattcccactgcctccagactgggccctccttccactgcttgtgcctccagggatggaccgggcctctctgcaaccttccactgtcctcctgccagaaggctgcactgagccaaggcatagacgtctcttccctttgccacaatggaggcctctgtgtcgacagcggcccctcctatttctgccactgcccccctggattccaaggcagcctgtgccaggatcacgtgaacccatgtgagtccaggccttgccagaacggggccacctgcatggcccagcccagtgggtatctctgccagtgtgccccaggctacgatggacagaactgctcaaaggaactcgatgcttgtcagtcccaaccctgtcacaaccatggaacctgtactcccaaacctggaggcttccactgtgcctgccctccaggctttgtggggctacgctgtgagggagacgtggacgagtgtctggaccagccctgccaccccacaggcactgcagcctgccactctctggccaatgccttctactgccagtgtctgcctggacacacaggccagtggtgtgaggtggagatagacccctgccacagccaaccctgctttcatggagggacctgtgaggccacagcaggatcacccctgggtttcatctgccactgccccaagggttttgaaggccccacctgcagccacagggccccttcctgcggcttccatcactgccaccacggaggcctgtgtctgccctcccctaagccaggcttcccaccacgctgtgcctgcctcagtggctatgggggtcctgactgcctgaccccaccagctcctaaaggctgtggccctccctccccatgcctatacaatggcagctgctcagagaccacgggcttggggggcccaggctttcgatgctcctgccctcacagctctccagggccccggtgtcagaaacccggagccaaggggtgtgagggcagaagtggagatggggcctgcgatgctggctgcagtggcccgggaggaaactgggatggaggggactgctctctgggagtcccagacccctggaagggctgcccctcccactctcggtgctggcttctcttccgggacgggcagtgccacccacagtgtgactctgaagagtgtctgtttgatggctacgactgtgagacccctccagcctgcactccagcctatgaccagtactgccatgatcacttccacaacgggcactgtgagaaaggctgcaacactgcagagtgtggctgggatggaggtgactgcaggcctgaagatggggacccagagtgggggccctccctggccctgctggtggtactgagccccccagccctagaccagcagctgtttgccctggcccgggtgctgtccctgactctgagggtaggactctgggtaaggaaggatcgtgatggcagggacatggtgtacccctatcctggggcccgggctgaagaaaagctaggaggaactcgggaccccacctatcaggagagagcagcccctcaaacgcagcccctgggcaaggagaccgactccctcagtgctgggtttgtggtggtcatgggtgtggatttgtcccgctgtggccctgaccacccggcatcccgctgtccctgggaccctgggcttctactccgcttccttgctgcgatggctgcagtgggagccctggagcccctgctgcctggaccactgctggctgtccaccctcatgcagggaccgcaccccctgccaaccagcttccctggcctgtgctgtgctccccagtggccggggtgattctcctggccctaggggctcttctcgtcctccagctcatccggcgtcgacgccgagagcatggagctctctggctgccccctggtttcactcgacggcctcggactcagtcagctccccaccgacgccggcccccactaggcgaggacagcattggtctcaaggcactgaagccaaaggcagaagttgatgaggatggagttgtgatgtgctcaggccctgaggagggagaggaggtgggccaggctgaagaaacaggcccaccctccacgtgccagctctggtctctgagtggtggctgtggggcgctccctcaggcagccatgctaactcctccccaggaatctgagatggaagcccctgacctggacacccgtggacctgatggggtgacacccctgatgtcagcagtttgctgtggggaagtacagtccgggaccttccaaggggcatggttgggatgtcctgagccctgggaacctctgctggatggaggggcctgtccccaggctcacaccgtgggcactggggagacccccctgcacctggctgcccgattctcccggccaaccgctgcccgccgcctccttgaggctggagccaaccccaaccagccagaccgggcagggcgcacaccccttcatgctgctgtggctgctgatgctcgggaggtctgccagcttctgctccgtagcagacaaactgcagtggacgctcgcacagaggacgggaccacacccttgatgctggctgccaggctggcggtggaagacctggttgaagaactgattgcagcccaagcagacgtgggggccagagataaatgggggaaaactgcgctgcactgggctgctgccgtgaacaacgcccgagccgcccgctcgcttctccaggccggagccgataaagatgcccaggacaacagggagcagacgccgctattcctggcggcgcgggaaggagcggtggaagtagcccagctactgctggggctgggggcagcccgagagctgcgggaccaggctgggctagcgccggcggacgtcgctcaccaacgtaaccactgggatctgctgacgctgctggaaggggctgggccaccagaggcccgtcacaaagccacgccgggccgcgaggctgggcccttcccgcgcgcacggacggtgtcagtaagcgtgcccccgcatgggggcggggctctgccgcgctgccggacgctgtcagccggagcaggccctcgtgggggcggagcttgtctgcaggctcggacttggtccgtagacttggctgcgcgggggggcggggcctattctcattgccggagcctctcgggagtaggagcaggaggaggcccgacccctcgcggccgtaggttttctgcaggcatgcgcgggcctcggcccaaccctgcgataatgcgaggaagatacggagtggctgccgggcgcggaggcagggtctcaacggatgactggccctgtgattgggtggccctgggagcttgcggttctgcctccaacattccgatcccgcctccttgccttactccgtccccggagcggggatcacctcaacttgactgtggtcccccagccctccaagaaatgcccataaaccaaggaggagagggtaaaaaatagaagaatacatggtagggaggaattccaaaaatgattacccattaaaaggcaggctggaaggccttcctggttttaagatggatcccccaaaatgaagggttgtgagtttagtttctctcctaaaatgaatgtatgcccaccagagcagacatcttccacgtggagaagctgcagctctggaaagagggtttaagatgctaggatgaggcaggcccagtcctcctccagaaaataagacaggccacaggagggcagagtggagtggaaatacccctaagttggaaccaagaattgcaggcatatgggatgtaagatgttctttcctatatatggtttccaaagggtgcccctatgatccattgtccccactgcccacaaatggctgacaaatatttattgggcacctactatgtgccaggcactgtgtaggtgctgaaaagtggccaagggccacccccgctgatgactccttgcattccctcccctcacaacaaagaactccactgtggggatgaagcgcttcttctagccactgctatcgctatttaagaaccctaaatctgtcacccataataaagctgatttgaagtgtta

SEQ ID NO: 2845 - DNA, 957 bp, Homo sapiens
gatgtcagcagtttgctgtggggaagtacagtccgggaccttccaaggggcatggttgggatgtcctgagccctgggaacctctgctggatggaggggcctgtccccaggctcacaccgtgggcactggggagacccccctgcacctggctgcccgattctcccggccaaccgctgcccgccgcctccttgaggctggagccaaccccaaccagccagaccgggcagggcgcacaccccttcatgctgctgtggctgctgatgctcgggaggtctgccagcttctgctccgtagcagacaaactgcagtggacgctcgcacagaggacgggaccacacccttgatgctggctgccaggctggcggtggaagacctggttgaagaactgattgcagcccaagcagacgtgggggccagagataaatggggagcagacgccgctattcctggcggcgcgggaaggagcggtggaagtagcccagctactgctggggctgggggcagcccgagagctgcgggaccaggctgggctagcgccggcggacgtcgctcaccaacgtaaccactgggatctgctgacgctgctggaaggggctgggccaccagaggcccgtcacaaagccacgccgggccgcgaggctgggcccttcccgcgcgcacggacggtgtcagtaagcgtgcccccgcatgggggcggggctctgccgcgctgccggacgctgtcagccggagcaggccctcgtgggggcggagcttgtctgcaggctcggacttggtccgtagacttggctgcgcgggggggcggggcctattctcattgccggagcctctcgggagtaggagcaggaggaggcccgacccctcgcggccgtaggttttctgcaggcatgcgcgggcctcggcccaaccctgcgataatgcgaggaagatacggagtggctgccgggcgcggaggca

SEQ ID NO: 2846 - DNA, 1067 bp, Homo sapiens
ggccgcatgggccgccgggatgtgtagtccgcaggagtccggcatgaccgccttgagcgcgaggatgctgacccggagccggagcctgggacccggggctgggccgcgggggtgtagggaggagcccgggcctctccggagaagagaggctgcagcagaagcgaggaaaagccacagccccgtgaagcgtccgcggaaagcacagagactgcgtgtggcctatgagggctcggacagtgagaaaggtgagggggctgagcccctcaaggtgccagtctgggagccccaggactggcagcaacagctggtcaacatccgtgccatgaggaacaaaaaggatgcacctgtggaccatctggggactgagcactgctatgactccagtgcccccccaaaggtacgcaggtaccaggtgctgctgtcactgatgctctccagccaaaccaaagaccaggtgacggcgggcgccatgcagcgactgcgggcgcggggcctgacggtggacagcatcctgcagacagatgatgccacgctgggcaagctcatctaccccgtcggtttctggaggagcaaggtgaaatacatcaagcagaccagcgccatcctgcagcagcactacggtggggacatcccagcctctgtggccgagctggtggcgctgccgggtgttgggcccaagatggcacacctggctatggctgtggcctggggcactgtgtcaggcattgcagtggacacgcatgtgcacagaatcgccaacaggctgaggtggaccaagaaggcaaccaagtccccagaggagacccgcgccgccctggaggagtggctgcctagggagctgtggcacgagatcaatggactcttggtgggcttcggccagcagacctgtctgcctgtgcaccctcgctgccacgcctgcctcaaccaagccctctgcccggccgcccagggtctctgatggccgcatggctctggccgaggtgccgctgtggccaccgtctgtgaagtggctttacgcttcaggaagccacgcctgttgaataaagctttggtgtgtttgcagatgg

SEQ ID NO: 2847 - DNA, 4914 bp, Homo sapiens
cgcccaagtccctctactcgcgagaatctgtctatgatcttctcccaaaggagttacagttacctccatctagagaaacatctgtagcatcaatgagtcagacaagcggtggtgaggcaggctcgcctcctccagctgttgttgctgctggatttgcctctgaagcagggagtgtctgcattaaaaatgacctgtagttctctgcttcatagatgcttcttcagctccctcctcttcctccatgggcggtgcttgcagctcctttaccacctcttccagccctaccatttattctacctcagtcaccgacagcaaggctatgcaagtggagagctgctcctcagccgtgggggtaagtaacagaggggtaagtgaaaagcagttaaccagtaacacagttcagcagcatccatcaacaccgaagaggcacacagtcttgtacatctcaccaccacctgaggacttgctggataacagtcggatgtcctgccaggatgaggggtgtggattggaatctgagcagagctgcagtatgtggatggaggattccccctccaacttcagtaacatgagcaccagttcctacaatgataacactgaggtacctcgtaaatcacgaaaacgaaatccaaagcagaggccgggggtcaaacgacgagattgtgaagaatctaatatggatatatttgatgccgacagtgccaaagcacctcactatgtgctttctcagcttaccacggacaacaaaggcaactcaaaagcgggaaatggaacattggaaaaccaaaaaggaactggagtaaagaagagccctatgttgtgtggacaatatcctgttaaaagtgagggaaaggagctgaagatagttgtacaacctgagacacagcaccgagctcggtacctgactgagggcagccgtggctcagtgaaagatagaacacagcaaggctttcctacagtaaagctggaaggccataatgaacctgtagtgttgcaagtgtttgtgggcaacgactctggacgagtgaaaccacatggattttatcaggcctgcagagtaactggacgaaatacaactccttgcaaagaagtggacattgaaggcactactgttatagaagtcggccttgatcctagcaacaacatgacactggcggtggactgcgtagggatattgaaattgaggaatgctgatgtcgaagccagaataggaattgctggttccaagaagaaaagcactcgtgccagattggtttttcgagttaatatcatgaggaaagatggctccactttgacactgcaaacaccctcttctccaattttgtgtactcagccagcaggagtgccagaaatcttaaagaaaagcttgcatagctgttcagtgaaaggagaagaagaagtgtttttaatcggcaagaactttctgaaaggaactaaagttattttccaagaaaatgtttctgatgaaaactcttggaagtcagaagctgaaattgatatggaactatttcatcagaatcatcttattgtgaaggttcctccctatcatgaccaacatataactttgcctgtgtcagtgggaatatatgtagtgacaaatgctggaagatctcatgatgttcaaccattcacttacactccagacccagcagcagctggtgctttgaatgtaaatgtgaagaaggaaatatctagtccagcaagaccttgctcttttgaagaggccatgaaagcaatgaaaactactggatgtaatttagataaggtaaatattatccctaatgccctgatgactccactcataccaagcagtatgattaagagtgaagatgttactccaatggaagtaacagcagaaaaaagatcttccactatttttaagactacaaagtctgttggatcaactcagcaaacattagaaaacatctcaaacatagcaggaaatggctctttttcatcaccatcatcttcccacctaccttctgaaaatgaaaaacagcagcagattcagcccaaggcatacaacccagagaccctgacaactattcaaacccaggacatctcacagcctggtacttttccagcagtttctgcttctagtcagctgcccaacagcgatgcactattgcagcaggctacacagtttcagacaagagaaactcagtctagagagatattacagtcagatggtacagtggttaatttgtcacaactgactgaggcatcacaacaacagcagcagtcaccactacaagaacaagcacagactttacagcagcagatttcatcaaatatttttccatcaccaaatagtgtgagtcagcttcagaatactattcagcagctgcaagcagggagtttcacaggcagtactgctagtggcagcagtggaagtgttgacttggtccaacaagttttagaggcacagcagcagttatcttcagttttattttctgctccagatggtaatgagaatgttcaagagcagcttagtgcagatatttttcaacaagtcagtcaaattcagagtggtgtaagccctggaatgttttcctcaacagagccaacagtccataccagaccagataatttattacctggaagagctgaaagtgttcatccacagtctgaaaacacgttatctaatcaacagcagcagcagcagcagcaacagcaagtgatggaatcttcagccgcaatggtgatggagatgcaacagagtatctgccaggcagctgcccagattcagtcagagttattcccttcaactgcttcagcaaatggaaaccttcagcaatcgccagtttaccagcagacttctcacatgatgagtgcattgtctaccaatgaggatatgcaaatgcagtgtgaattgttttcttctcctcctgcagtttctggaaatgaaacttctacaactaccacacagcaggttgcaacccctggcactaccatgtttcagacatcaagttcaggagatggagaagaaactggaacacaagcaaaacagattcagaacagtgtctttcagaccatggtccaaatgcaacatagtggggacaatcaacctcaagttaaccttttttcatccacaaaaagtatgatgagtgttcagaatagtggtacccaacaacaaggtaatggtttattccagcaagggaatgagatgatgtcacttcaatctggaaattttttgcagcagtcttctcattcacaggcccaactttttcatcctcaaaatcctattgccgatgctcagaacctttcccaggaaactcaaggttctctctttcatagtccaaatcctattgtccacagtcagacttctacaacctcctctgaacaaatgcagcctccaatgtttcactctcaaagtaccattgctgtgttacagggctcttcagttcctcaagaccagcagtcaaccaacatatttctttcccagagtcccatgaataatcttcagactaacacagtagcccaagaagcattttttgcagcaccgaactcaatttctccacttcagtcaacatcaaacagtgaacaacaagctgctttccaacagcaagctccaatatcacacatccagactcctatgctttcccaagaacaggcacaacccccgcagcagggtttatttcagcctcaggtggccctgggctcccttccacctaatccaatgcctcaaagccaacaaggaaccatgttccagtcacagcactcaatagttgccatgcagagtaactctccatcccaggaacagcagcagcagcagcaacagcagcagcaacagcagcagcaacaacaacagagcattttattcagtaatcagaataccatggctacaatggcgtctccaaagcaaccaccaccaaacatgatattcaacccaaatcaaaatccaatggctaatcaggagcaacagaaccagtcaatttttcaccaacaaagtaacatggccccaatgaatcaagagcaacagcccatgcaatttcagagtcagtccacagtttcctcacttcagaacccaggtcctacccagtcggaatcatcacagacccccttgttccatagctctcctcagattcagttggtacaagggtcacctagttctcaagagcagcaagtaactctcttcttatctccagcatccatgtctgccttgcagaccagtataaatcaacaagatatgcaacagtctcctctttattcccctcagaacaacatgcctggaattcaaggagccacatcttcgcctcaaccacaggctactttatttcacaacacagcaggaggcacaatgaaccaactgcagaattctcctggctcatctcagcagacatcaggaatgttcttatttggcattcaaaataactgtagtcagcttttaacctctggaccagctacattgcctgatcagttgatggccataagtcagccaggccaaccacaaaacgagggccagccacctgtgacaacacttctttctcagcaaatgccagagaattctccactggcatcctctataaacaccaaccagaacatcgaaaagattgatttgcttgtttcattgcaaaaccaagggaacaacttgactggctccttttaactggatatgtaagtattgcattttggcttcttattgaaaagcatcagattttattcttcttaacagatttaggttaagtaatagtagttctaatcttttaaaatgtggctttctcacaagatgatacttttttactctgaataaaattattctgaatgatagcttatggtcatatagttaatacagaccaggccgggcgtggtggctcatgcctgtaatcccagcactttgagagaccaaggtgggcggatcacgaggtcaggcgatcgagaccatcctggctaacatggtgaaaccccgtctct

SEQ ID NO: 2848 - DNA, 6376 bp, Homo sapiens
ccgtcctgaacccctctcctggtcaccgagaatcagtccccgtggagttccccctccacctcgccatcgtttcctcggtcctcggcccagtggaagtcactaccctcgaggaggaggcagcggcagccgccctcgcgtcgccgcccccggttcggtgcccgcggtcccggagaggaggtgccgccgccaccgccgctccccccctcccgctgccctcgggccgggctgggtcgagctgcgatgccctcggacttcatctcattgctcagcgcggacctagacctggaatcgcccaagtccctctactcgcgagattctctgaagttacacccatcacagaattttcatagagctggactattggaagaatctgtctatgatcttctcccaaaggagttacagttacctccatctagagaaacatctgtagcatcaatgagtcagacaagcggtggtgaggcaggctcgcctcctccagctgttgttgctgctgatgcttcttcagctccctcctcttcctccatgggcggtgcttgcagctcctttaccacctcttccagccctaccatttattctacctcagtcaccgacagcaaggctatgcaagtggagagctgctcctcagccgtgggggtaagtaacagaggggtaagtgaaaagcagttaaccagtaacacagttcagcagcatccatcaacaccgaagaggcacacagtcttgtacatctcaccaccacctgaggacttgctggataacagtcggatgtcctgccaggatgaggggtgtggattggaatctgagcagagctgcagtatgtggatggaggattccccctccaacttcagtaacatgagcaccagttcctacaatgataacactgaggtacctcgtaaatcacgaaaacgaaatccaaagcagaggccgggggtcaaacgacgagattgtgaagaatctaatatggatatatttgatgccgacagtgccaaagcacctcactatgtgctttctcagcttaccacggacaacaaaggcaactcaaaagcgggaaatggaacattggaaaaccaaaaaggaactggagtaaagaagagccctatgttgtgtggacaatatcctgttaaaagtgagggaaaggagctgaagatagttgtacaacctgagacacagcaccgagctcggtacctgactgagggcagccgtggctcagtgaaagatagaacacagcaaggctttcctacagtaaagctggaaggccataatgaacctgtagtgttgcaagtgtttgtgggcaacgactctggacgagtgaaaccacatggattttatcaggcctgcagagtaactggacgaaatacaactccttgcaaagaagtggacattgaaggcactactgttatagaagtcggccttgatcctagcaacaacatgacactggcggtggactgcgtagggatattgaaattgaggaatgctgatgtcgaagccagaataggaattgctggttccaagaagaaaagcactcgtgccagattggtttttcgagttaatatcatgaggaaagatggctccactttgacactgcaaacaccctcttctccaattttgtgtactcagccagcaggagtgccagaaatcttaaagaaaagcttgcatagctgttcagtgaaaggagaagaagaagtgtttttaatcggcaagaactttctgaaaggaactaaagttattttccaagaaaatgtttctgatgaaaactcttggaagtcagaagctgaaattgatatggaactatttcatcagaatcatcttattgtgaaggttcctccctatcatgaccaacatataactttgcctgtgtcagtgggaatatatgtagtgacaaatgctggaagatctcatgatgttcaaccattcacttacactccagacccagcagctggtgctttgaatgtaaatgtgaagaaggaaatatctagtccagcaagaccttgctcttttgaagaggccatgaaagcaatgaaaactactggatgtaatttagataaggtaaatattatccctaatgccctgatgactccactcataccaagcagtatgattaagagtgaagatgttactccaatggaagtaacagcagaaaaaagatcttccactatttttaagactacaaagtctgttggatcaactcagcaaacattagaaaacatctcaaacatagcaggaaatggctctttttcatcaccatcatcttcccacctaccttctgaaaatgaaaaacagcagcagattcagcccaaggcatacaacccagagaccctgacaactattcaaacccaggacatctcacagcctggtacttttccagcagtttctgcttctagtcagctgcccaacagcgatgcactattgcagcaggctacacagtttcagacaagagaaactcagtctagagagatattacagtcagatggtacagtggttaatttgtcacaactgactgaggcatcacaacaacagcagcagtcaccactacaagaacaagcacagactttacagcagcagatttcatcaaatatttttccatcaccaaatagtgtgagtcagcttcagaatactattcagcagctgcaagcagggagtttcacaggcagtactgctagtggcagcagtggaagtgttgacttggtccaacaagttttagaggcacagcagcagttatcttcagttttattttctgctccagatggtaatgagaatgttcaagagcagcttagtgcagatatttttcaacaagtcagtcaaattcagagtggtgtaagccctggaatgttttcctcaacagagccaacagtccataccagaccagataatttattacctggaagagctgaaagtgttcatccacagtctgaaaacacgttatctaatcaacagcagcagcagcagcagcaacagcaagtgatggaatcttcagccgcaatggtgatggagatgcaacagagtatctgccaggcagctgcccagattcagtcagagttattcccttcaactgcttcagcaaatggaaaccttcagcaatcgccagtttaccagcagacttctcacatgatgagtgcattgtctaccaatgaggatatgcaaatgcagtgtgaattgttttcttctcctcctgcagtttctggaaatgaaacttctacaactaccacacagcaggttgcaacccctggcactaccatgtttcagacatcaagttcaggagatggagaagaaactggaacacaagcaaaacagattcagaacagtgtctttcagaccatggtccaaatgcaacatagtggggacaatcaacctcaagttaaccttttttcatccacaaaaagtatgatgagtgttcagaatagtggtacccaacaacaaggtaatggtttattccagcaagggaatgagatgatgtcacttcaatctggaaattttttgcagcagtcttctcattcacaggcccaactttttcatcctcaaaatcctattgccgatgctcagaacctttcccaggaaactcaaggttctctctttcatagtccaaatcctattgtccacagtcagacttctacaacctcctctgaacaaatgcagcctccaatgtttcactctcaaagtaccattgctgtgttacagggctcttcagttcctcaagaccagcagtcaaccaacatatttctttcccagagtcccatgaataatcttcagactaacacagtagcccaagaagcattttttgcagcaccgaactcaatttctccacttcagtcaacatcaaacagtgaacaacaagctgctttccaacagcaagctccaatatcacacatccagactcctatgctttcccaagaacaggcacaacccccgcagcagggtttatttcagcctcaggtggccctgggctcccttccacctaatccaatgcctcaaagccaacaaggaaccatgttccagtcacagcactcaatagttgccatgcagagtaactctccatcccaggaacagcagcagcagcagcaacagcagcagcaacagcagcagcaacaacaacagagcattttattcagtaatcagaataccatggctacaatggcgtctccaaagcaaccaccaccaaacatgatattcaacccaaatcaaaatccaatggctaatcaggagcaacagaaccagtcaatttttcaccaacaaagtaacatggccccaatgaatcaagagcaacagcccatgcaatttcagagtcagtccacagtttcctcacttcagaacccaggtcctacccagtcggaatcatcacagacccccttgttccatagctctcctcagattcagttggtacaagggtcacctagttctcaagagcagcaagtaactctcttcttatctccagcatccatgtctgccttgcagaccagtataaatcaacaagatatgcaacagtctcctctttattcccctcagaacaacatgcctggaattcaaggagccacatcttcgcctcaaccacaggctactttatttcacaacacagcaggaggcacaatgaaccaactgcagaattctcctggctcatctcagcagacatcaggaatgttcttatttggcattcaaaataactgtagtcagcttttaacctctggaccagctacattgcctgatcagttgatggccataagtcagccaggccaaccacaaaacgagggccagccacctgtgacaacacttctttctcagcaaatgccagagaattctccactggcatcctctataaacaccaaccagaacatcgaaaagattgatttgcttgtttcattgcaaaaccaagggaacaacttgactggctccttttaactggatataaattccacgaagaaaatcctgattccaagatgtcctgagatcttgtggttccatgagaattattactttaaaaacaaaacaaaatataaaaaactgtgtttgagtaaactgatagattttactctgactgcaaaagagcacacctatgctgcttgttgcagtaactaaccaccaatgttaacatcttcatattttatattcctaataacagtgatgactgagaatctatttgagtttccagctggcagaattaattgttattattttcctaggcgcaatttccttaaacgtacagtttaaattcaaggctggaccactcagttattattgctattagaaaataatatatcatgtttacttttgttcttcattattttctttcctgcattgttttagtcaagtaatggcttttgaaaaagtaaagttcaataataactaaggctgtgatttttttcaatataaaaggcacagctgttggccaaagtgaaggaatcttttttcagttttattggagaaactgaagggtaacattctaacaagtaaactgtatgtgcagataaaagtactcttgatttaacacaaaggcagatgatacacttataaaactgggaacagctggaatgcttcttgattttattttttcagagagttgttagttctctgggtttctactaaggggtttagccataactgtgcatagaaaaataattatctgtaaaaaatgaaggggataatatatgataaattatgttctgatatcctcctacagtagtttaaattgacagaaaaatttgaatgttttcttcttaacccagtcttaggctggtattccctttttatatatatctatattacttttcacctctttttcactttactttagagaactattaatatactactggcttcatgaccctgtagcatctttggccactttaatctagggtgacctagcaatcctgcagcacagggcagagagtactgtcttaggaattattaggagttgattcctgagaaacaacacatttttccccatgaacggtgctgttctgaagtcttcaaatttttccctctaataggaaacagtataaattttaattaaaaaaaaaaggcaaactaaaatttcttgaaatatcacttctccctgatctgcagtgagtataaattcacttgtcacctcagtgctttacagtttgaagtggtcacttacctgatggttcccacaagccttaggctttacagggttgtatcattgacttaaaatgaagaattaacttgtgttacatctataaagagcaaaataacacactccagaacttggcagttgtagcattagttatacagttttgggtgttcttgccacccgtgggatgcctgcttctcactaccacctgtgtctggacacatgcttatgtctcattttccttttggcatgtggaaagctgtcaatgcagtgtaaggccaacgtgtgtgtggcttc

SEQ ID NO: 2849 - DNA, 14219 bp, Homo sapiens
tgcaacggaaacttttggctccacgaacagaaaagcaagagcaaaaactcagttaaatgcgttcttcctccatctttgcctagtccaaaaggaaaaaaaaagaaacagaaaaaagaaaaactgtttggaagagtagcgttgaggtttgctttttacctgtttttcctctagaacagccaggtggattcacatgatccaattttttaattgtcttctatgtcccactccgaataacccggatgccccagcacaatcagagagatcgttttttttaaaaaaaatttcagcctccaaaggtaggaggggagtgttaggggagaaagtactttaattaaaaatcaataactcgaggtttttgggatacggtttgccatttcctaattaagaaatgggtttgacagtccctttgtacacactgctatgcaaaccccaaagggttggcggctgtccgggcgatgacactccggtcccctgcgagaccccgggccagccaggcccgtccgccgccggcctctggggtccgtccccggctcgcgcagacctctcgcttctctcggctctgtctcctgcgctcagctctgctcggggccggccgcctcaggctcgccgccaccaggtcgttgcaaataccttttccctccccggggccccagcgcgcggccacctcccagcctccccccctcccaccctggcagcggggccctttcccggctcaggaacagcagcagcccgggccgcgccggcaggaagcgaggcccatgttgctgctgttccctggcgcgcctccccgccctccgggggccgccacggctcttccgcgctcccgggcacccccctccgcgcctgcgctgtgccccacgggggcggggctcagattcctgtcagcggcggcggcggtggcggcgaccgtcagttttcgctgaggagaaacacgaaacggaccctttggctctcccccttccccttccccgtcctgaacccctctcctggtcaccgagaatcagtccccgtggagttccccctccacctcgccatcgtttcctcggtcctcggcccagtggaagtcactaccctcgaggaggaggcagcggcagccgccctcgcgtcgccgcccccggttcggtgcccgcggtcccggagaggaggtgccgccgccaccgccgctccccccctcccgctgccctcgggccgggctgggtcgagctgcgatgccctcggacttcatctcattgctcagcgcggacctagacctggaatcgcccaagtccctctactcgcgagattctctgaagttacacccatcacagaattttcatagagctggactattggaagaatctgtctatgatcttctcccaaaggagttacagttacctccatctagagaaacatctgtagcatcaatgagtcagacaagcggtggtgaggcaggctcgcctcctccagctgttgttgctgctggatttgcctctgaagcagggagtgtctgcattaaaaatgacctgtagttctctgcttcatagatgcttcttcagctccctcctcttcctccatgggcggtgcttgcagctcctttaccacctcttccagccctaccatttattctacctcagtcaccgacagcaaggctatgcaagtggagagctgctcctcagccgtgggggtaagtaacagaggggtaagtgaaaagcagttaaccagtaacacagttcagcagcatccatcaacaccgaagaggcacacagtcttgtacatctcaccaccacctgaggacttgctggataacagtcggatgtcctgccaggatgaggggtgtggattggaatctgagcagagctgcagtatgtggatggaggattccccctccaacttcagtaacatgagcaccagttcctacaatgataacactgaggtacctcgtaaatcacgaaaacgaaatccaaagcagaggccgggggtcaaacgacgagattgtgaagaatctaatatggatatatttgatgccgacagtgccaaagcacctcactatgtgctttctcagcttaccacggacaacaaaggcaactcaaaagcgggaaatggaacattggaaaaccaaaaaggaactggagtaaagaagagccctatgttgtgtggacaatatcctgttaaaagtgagggaaaggagctgaagatagttgtacaacctgagacacagcaccgagctcggtacctgactgagggcagccgtggctcagtgaaagatagaacacagcaaggctttcctacagtaaagctggaaggccataatgaacctgtagtgttgcaagtgtttgtgggcaacgactctggacgagtgaaaccacatggattttatcaggcctgcagagtaactggacgaaatacaactccttgcaaagaagtggacattgaaggcactactgttatagaagtcggccttgatcctagcaacaacatgacactggcggtggactgcgtagggatattgaaattgaggaatgctgatgtcgaagccagaataggaattgctggttccaagaagaaaagcactcgtgccagattggtttttcgagttaatatcatgaggaaagatggctccactttgacactgcaaacaccctcttctccaattttgtgtactcagccagcaggagtgccagaaatcttaaagaaaagcttgcatagctgttcagtgaaaggagaagaagaagtgtttttaatcggcaagaactttctgaaaggaactaaagttattttccaagaaaatgtttctgatgaaaactcttggaagtcagaagctgaaattgatatggaactatttcatcagaatcatcttattgtgaaggttcctccctatcatgaccaacatataactttgcctgtgtcagtgggaatatatgtagtgacaaatgctggaagatctcatgatgttcaaccattcacttacactccagacccagcagcagctggtgctttgaatgtaaatgtgaagaaggaaatatctagtccagcaagaccttgctcttttgaagaggccatgaaagcaatgaaaactactggatgtaatttagataaggtaaatattatccctaatgccctgatgactccactcataccaagcagtatgattaagagtgaagatgttactccaatggaagtaacagcagaaaaaagatcttccactatttttaagactacaaagtctgttggatcaactcagcaaacattagaaaacatctcaaacatagcaggaaatggctctttttcatcaccatcatcttcccacctaccttctgaaaatgaaaaacagcagcagattcagcccaaggcatacaacccagagaccctgacaactattcaaacccaggacatctcacagcctggtacttttccagcagtttctgcttctagtcagctgcccaacagcgatgcactattgcagcaggctacacagtttcagacaagagaaactcagtctagagagatattacagtcagatggtacagtggttaatttgtcacaactgactgaggcatcacaacaacagcagcagtcaccactacaagaacaagcacagactttacagcagcagatttcatcaaatatttttccatcaccaaatagtgtgagtcagcttcagaatactattcagcagctgcaagcagggagtttcacaggcagtactgctagtggcagcagtggaagtgttgacttggtccaacaagttttagaggcacagcagcagttatcttcagttttattttctgctccagatggtaatgagaatgttcaagagcagcttagtgcagatatttttcaacaagtcagtcaaattcagagtggtgtaagccctggaatgttttcctcaacagagccaacagtccataccagaccagataatttattacctggaagagctgaaagtgttcatccacagtctgaaaacacgttatctaatcaacagcagcagcagcagcagcaacagcaagtgatggaatcttcagccgcaatggtgatggagatgcaacagagtatctgccaggcagctgcccagattcagtcagagttattcccttcaactgcttcagcaaatggaaaccttcagcaatcgccagtttaccagcagacttctcacatgatgagtgcattgtctaccaatgaggatatgcaaatgcagtgtgaattgttttcttctcctcctgcagtttctggaaatgaaacttctacaactaccacacagcaggttgcaacccctggcactaccatgtttcagacatcaagttcaggagatggagaagaaactggaacacaagcaaaacagattcagaacagtgtctttcagaccatggtccaaatgcaacatagtggggacaatcaacctcaagttaaccttttttcatccacaaaaagtatgatgagtgttcagaatagtggtacccaacaacaaggtaatggtttattccagcaagggaatgagatgatgtcacttcaatctggaaattttttgcagcagtcttctcattcacaggcccaactttttcatcctcaaaatcctattgccgatgctcagaacctttcccaggaaactcaaggttctctctttcatagtccaaatcctattgtccacagtcagacttctacaacctcctctgaacaaatgcagcctccaatgtttcactctcaaagtaccattgctgtgttacagggctcttcagttcctcaagaccagcagtcaaccaacatatttctttcccagagtcccatgaataatcttcagactaacacagtagcccaagaagcattttttgcagcaccgaactcaatttctccacttcagtcaacatcaaacagtgaacaacaagctgctttccaacagcaagctccaatatcacacatccagactcctatgctttcccaagaacaggcacaacccccgcagcagggtttatttcagcctcaggtggccctgggctcccttccacctaatccaatgcctcaaagccaacaaggaaccatgttccagtcacagcactcaatagttgccatgcagagtaactctccatcccaggaacagcagcagcagcagcaacagcagcagcaacagcagcagcaacaacaacagagcattttattcagtaatcagaataccatggctacaatggcgtctccaaagcaaccaccaccaaacatgatattcaacccaaatcaaaatccaatggctaatcaggagcaacagaaccagtcaatttttcaccaacaaagtaacatggccccaatgaatcaagagcaacagcccatgcaatttcagagtcagtccacagtttcctcacttcagaacccaggtcctacccagtcggaatcatcacagacccccttgttccatagctctcctcagattcagttggtacaagggtcacctagttctcaagagcagcaagtaactctcttcttatctccagcatccatgtctgccttgcagaccagtataaatcaacaagatatgcaacagtctcctctttattcccctcagaacaacatgcctggaattcaaggagccacatcttcgcctcaaccacaggctactttatttcacaacacagcaggaggcacaatgaaccaactgcagaattctcctggctcatctcagcagacatcaggaatgttcttatttggcattcaaaataactgtagtcagcttttaacctctggaccagctacattgcctgatcagttgatggccataagtcagccaggccaaccacaaaacgagggccagccacctgtgacaacacttctttctcagcaaatgccagagaattctccactggcatcctctataaacaccaaccagaacatcgaaaagattgatttgcttgtttcattgcaaaaccaagggaacaacttgactggctccttttaactggatataaattccacgaagaaaatcctgattccaagatgtcctgagatcttgtggttccatgagaattattactttaaaaacaaaacaaaatataaaaaactgtgtttgagtaaactgatagattttactctgactgcaaaagagcacacctatgctgcttgttgcagtaactaaccaccaatgttaacatcttcatattttatattcctaataacagtgatgactgagaatctatttgagtttccagctggcagaattaattgttattattttcctaggcgcaatttccttaaacgtacagtttaaattcaaggctggaccactcagttattattgctattagaaaataatatatcatgtttacttttgttcttcattattttctttcctgcattgttttagtcaagtaatggcttttgaaaaagtaaagttcaataataactaaggctgtgatttttttcaatataaaaggcacagctgttggccaaagtgaaggaatcttttttcagttttattggagaaactgaagggtaacattctaacaagtaaactgtatgtgcagataaaagtactcttgatttaacacaaaggcagatgatacacttataaaactgggaacagctggaatgcttcttgattttattttttcagagagttgttagttctctgggtttctactaaggggtttagccataactgtgcatagaaaaataattatctgtaaaaaatgaaggggataatatatgataaattatgttctgatatcctcctacagtagtttaaattgacagaaaaatttgaatgttttcttcttaacccagtcttaggctggtattccctttttatatatatctatattacttttcacctctttttcactttactttagagaactattaatatactactggcttcatgaccctgtagcatctttggccactttaatctagggtgacctagcaatcctgcagcacagggcagagagtactgtcttaggaattattaggagttgattcctgagaaacaacacatttttccccatgaacggtgctgttctgaagtcttcaaatttttccctctaataggaaacagtataaattttaattaaaaaaaaaaggcaaactaaaatttcttgaaatatcacttctccctgatctgcagtgagtataaattcacttgtcacctcagtgctttacagtttgaagtggtcacttacctgatggttcccacaagccttaggctttacagggttgtatcattgacttaaaatgaagaattaacttgtgttacatctataaagagcaaaataacacactccagaacttggcagttgtagcattagttatacagttttgggtgttcttgccacccgtgggatgcctgcttctcactaccacctgtgtctggacacatgcttatgtctcattttccttttggcatgtggaaagctgtcaatgcagtgtaaggccaacgtgtgtgtggcttctatgtgttgagataatgttttggtatccttgtccgtttcatttattttttaagtgtacaaaaaataacctgttaattgttgaaggctacttttctgttctttttttttttttttttctatcctgtacatttagttgaactgtgcggaattgtggtgttggttttgtttacacagccagatttttccttctttttgttttgtgatgatcttcctttgttctttgaatgtgctcttttgtctttttctcttttttctcatgttttcttccctccacctccacccctttctttctttctctctctgattgagaggcattgaattacgttttcagtagtacaggcttcttgccgatatgaagggaacttttcagaaagagacctactctgggtcatttaattttgaatacagttttcaatcgttcaagttttggatggtttatatctaatgtgtgtttcatttttttggaaagctatattttgtatttaggaaatggtatactattttgctatttgtactgagtgagtacattggcataaatatagaaatttatatatatacatatatataaactattcttttttgccacacatttttgtggtaaatttgtgagtttgtctgatgttctaccacaacgtggcgtctgataacagtgagggggggtggggtttgttatgtctttattgagtatttaagtatcttttgaaacaaatgacctgttcatctgtggccattccatcaggcagttagttccttgatgtcagtagtgggctaaaggcagcttactgtgtgtttgctggagctttcactcagccaagtgttagagtcaggaaacccattgaggcaatggcgtcaaatggtgtttcacaagaatgagccattcagtctttgctcactatatatttaatattttattattgttgttattgttattattaattggctttctgtattctatgccttttatttataaagacactaagaaaacccatgtttgtaattttaataacatttttcccatcttgtaatatccagagctactttataaattctctgaaccaaaagtattttcctcagtgtatctcttctcccccagcccctattgggaaaaattacccagtatagttcaggttatgaggaggatcagccacacaatccagtgcttcagtttgaaaatgtaaaattctaaccctaaagtagggttggttgaaatttcagacaaagcaaacccagcaggtataaaaagtagtataaatacaaatctgtaagttatttttgaattttctgaacttttttctaagagattacataggagactaaagaaatctatctgttcaagttctaattaggatgattgttaatactgcactgtggatgaagtggcgactggcttgtgtgctgacttctgtggtttagcaagaggtttattgttatcaaatgctaattggcaatgccaagtcactgggaccaattttctgttttataatatctaagtttagaacagaatatatacctgaactgtagtggtttgatcggatggagacagaaaacccgatttttattctcataaattttgtggttatttatacaagggctgtgctatgctaccatattcttgttcaataataataggtttgttgttttttttacattgttaaatgttccttacccctaaaggtcaatgttaagtacaacattctgaaaatacaatttggctacgaagagtattcatcttctttgaagctcagtggttgatatttgtgctaataatgcaatttcctgattactgttacaagttatagctacatatgggagagactcagtgagccagcaaaggccatagaaacaacaatttattaaatgtatttatggcagaaggacctaaataaactgtgagccaccttttcttctttatattgttacatttaagtgttcttgctttcagcaactcacattaatgcttggagcttatctctttctctctctctctctctctctctgtgtgtgtgtgtgtatgtgtgtgtgtgtgtgtgtgtgtttccttattgtcattccattatatatccacaccaacatgggtgacgataattcaaagtcatattttgcctctaagcttgatcatgttacctttatgattaaagtatcatgttatttagccaatgcaaatctgttttaaaacaaatagtttaaaaaaagaacaagtttttaagggctttattatagaagaagtattaatgaaggactttccttcctccctccctttcctcccctccctgcctcccttcttcccttccatctccccctcctccctgccttctttgtttctccttcccttattcctccctccctcctttctcccttccttcctttcttccattcatccttccttgccttttatttttattttttgtaatatcacatgtgctgtagtttggaattttattctagtgcatttcttgctcatcagaacctcagctaatctacctaggaaaaatagtatcaaaggaaatgagaaagttgtatctgagtccctccagaactaagataattctttttgaccatttaagcctttataaatgcgttttgaccatttaagcctttataaatgcttgttttaggaaagtgaatctgttagatgcatcaacaaataatgaccaggacaaaacgatttaataattaaagtctcaaatcaccatggttatacattttcaccagaaatagtaatcttacaatttttcatttttctgatgaagatttctgttccaatatctgtttcctaatagattttttaaattaattagctttcctctgctttatgaccacaggttttatccctaaccgagacagctgtcttatatctgcatgccttagactgtgtggagggactccatgaagaaagaccataggttagaaaaataactcatagtatataccctagtaagtgggttagtagaatctcataacatgtattaaaaagaggttttcttctctgcttgtttgtgtcactagagcaaaattgtagagataatgctcataatgcagtaaatatcagaataatatctacaatatcatttgtggatggtcccaggtcccagtgctctagttactttacttctttttttttttttgagatggagtcttgctctgtctctcaggctagagcagtgtgcgatctcagctcactgcagcctccacctcccaggttcaagcgattctcctgcctcagcctcccaagtagccaggattacaggcaccctccactaggcccggctaattttttttgtatttttttagtagagatggggttttgccatgttggccaggctggtttcgaactcctaacctccagtgatccacctgcctcggcgtcccaaagtgctaggattacaggcatgagccaccacatccggcctaattacttctttaatccccatttatttttatgccattctagcctcatttattaataaaattatgtttttactttctctttcaggaaattttttaaattaatattttatatctagatctaatgctatggaaaagtgcctttttatcatttataatttcatttttcactatttccaaaaacacataaacaaatagtttcagtaggtcccagcttttactttttccatttaaaccttcttttctccatttcttccctttggcttaagaataaaagaaaaggtacattgctagaattgtttctttgggagagggtaaaagattacagaattagactgttcagcctttatataaactaaatttgtcttcatctcaaccagctaatggtaggtcttatctgaatactcatgagaattttagcatctgtgaaactccatgcaccagatgtgtgtaaatttcaggaagaaagtgttgaaagcattttctctgatgttaattagatggaaataaatcactaaaacatagtttaggtaaagcctgattatgccacttttttttaactagacagggcaaagttgtttatgttagtgtacttcttgtctatcctcagttaatttacctagacaaaaagtgtcaaaggaaatgagaaaaaggttatatctgactccctccagacctaagataattccttttgatcagatacagtcagatggagtgccttggtttttgttaattttgcctctattccagctccttaccacagcggtggtgcttaaagaaaggatcatcagcaacaggtcaggatagttctacctttgggatagggctgctttccccgtgctagtatttctgtgactgttagtggcactgaggactgcaaacttttatgcaatattcttaataccctattgatattatgcactttaatcattccaaagaagccaagaatgctgtatagtgatgattccttcctaatgaattcatcttaactatttagaatgttatgtcccttttcttttggatagccaacttggtataaatgttatatggatttttctaaaatgactatataggacttaagactttgaaatgtaatttacttataaggggaaataattatgctttagcacatcattttagaaacgtcacattttagaaacattcagcttgctaacctacatgtttgggaattcattaaaaccagttgtctatatattttgtgccatgtatataagaacattacaatatatctttttctacatatgtagtatgtgcaaccagtggttctcagagtatggttctcagcccaccagctagtatcagtatcacctgggaactagttagaaatgtaaattctttggccccatcccagacatactgagtcagaaactctggaatagggcccccgcaatctgttttcacaagccctccaggtgattctgatgcacactttaaagtttaggaaccactgggctaagactctgttgagatatagagtttttcttccactcagactgatatagttatacattgttcttcatgtaaattcagcttaacctggttatctataatcttttattggcaaaagttaattctcagtactgcctatagagatacagtgtattttatgtacatacacaattagtctaattcttgataattcagttaatttagtttggcattttcctaccacttactaaaaggtttacattaaatgactgatttaaatatataggtgcaatgttctatgtttattttaattgttatgacatttaagtagctaatataattgaccggtgctaaagtctcctgtttatccataaaatgggtacattatgggcagtgtaatacaagctttcttttcattgcctagtactttaccagcagaccacagttttgccctggctagaccaaccctcagaacaaaatcatcattccttgtatttatatttgtatctgagatagtaaacaagatggctggccaggtcaacatggcaccttaacttatttttttaataggtaaaacttcttcaaaagtagcttgctttgtataagaactaagctatcagtatagatatagctatccttggagcttatgtttcagacaagaattatttactaaaataaataataaacaagataatgcattatacaatttgggcatttctcgtttctcaagtgtatgcatcatggtaaatataaactaaccacaagataggtagattgattcatttcattttaatctccttgtgtaattcagtacctccataattgttctaatcttcttcccactgtttacaaattaccagttaattaactcgtgaaagaaaaattcacatatcagaataaaaataaatgtatactcactttataaaaatcaccactgctgtctttccttaatactagcagtggaaatgtaagtggcttactctacaaattttggtgctggcaaatacataggcaaactgttgggagctgctctagttacattcctcccttcttattccctttttctcttcctcactttattgcataacatattcctgtacccaaagcattctaccacagttctatttgactcccacttgtaataactcctttaaaaaattccatgtttaaccatatgaccctgcttgcttactcatattctccctccctctccccttcctttctctctcttccagaagtcatttgcctggtttgaaatattttgtagggattgcttattatattattttagctgatgaacctcaggacaacgtctacacacacacacatacatacacgcacacaaaatctcagctgttgaagagtgggcttggaatcagacttctgtgtccagtaaaaaactcctgcactgaagtcattgtgacttgagtagttacagactgattccagtgaacttgatctaatttcttttgatctaatgaatgtgtctgcttaccttgtttccttttaattgataagctccaagtagttgctaattttttgacaactttaaatgagtttcattcacttcttttacttaatgttttaagtatagtaccaataatttcattaacctgttctcaagtggtttagctaccattctgccatttttaatttttatttaattttatttgcttgagcacactgatcaaccactgaactgccttcttccattgtcctgcaatgatataagggttacatttttgtgtatatggctttcatagttgggatttcagagcactgataccagatattttcagtttgttctctgggggaatttcatttgcatctatgtttttagctatctgtgataacttgttaaatattaaaaagatattttgcttctattggaacatttgtatactcgcaactatatttctgtaaacagctgcagtcaaaaataaaacactgaaagtt

SEQ ID NO: 2850 - DNA, 13229 bp, Homo sapiens
gcggcggtggcggcgaccgtcagttttcgctgaggagaaacacgaaacggaccctttggctctcccccttccccttccccgtcctgaacccctctcctggtcaccgagaatcagtccccgtggagttccccctccacctcgccatcgtttcctcggtcctcggcccagtggaagtcactaccctcgaggaggaggcagcggcagccgccctcgcgtcgccgcccccggttcggtgcccgcggtcccggagaggaggtgccgccgccaccgccgctccccccctcccgctgccctcgggccgggctgggtcgagctgcgatgccctcggacttcatctcattgctcagcgcggacctagacctggaatcgcccaagtccctctactcgcgagaatctgtctatgatcttctcccaaaggagttacagttacctccatctagagaaacatctgtagcatcaatgagtcagacaagcggtggtgaggcaggctcgcctcctccagctgttgttgctgctgatgcttcttcagctccctcctcttcctccatgggcggtgcttgcagctcctttaccacctcttccagccctaccatttattctacctcagtcaccgacagcaaggctatgcaagtggagagctgctcctcagccgtgggggtaagtaacagaggggtaagtgaaaagcagttaaccagtaacacagttcagcagcatccatcaacaccgaagaggcacacagtcttgtacatctcaccaccacctgaggacttgctggataacagtcggatgtcctgccaggatgaggggtgtggattggaatctgagcagagctgcagtatgtggatggaggattccccctccaacttcagtaacatgagcaccagttcctacaatgataacactgaggtacctcgtaaatcacgaaaacgaaatccaaagcagaggccgggggtcaaacgacgagattgtgaagaatctaatatggatatatttgatgccgacagtgccaaagcacctcactatgtgctttctcagcttaccacggacaacaaaggcaactcaaaagcgggaaatggaacattggaaaaccaaaaaggaactggagtaaagaagagccctatgttgtgtggacaatatcctgttaaaagtgagggaaaggagctgaagatagttgtacaacctgagacacagcaccgagctcggtacctgactgagggcagccgtggctcagtgaaagatagaacacagcaaggctttcctacagtaaagctggaaggccataatgaacctgtagtgttgcaagtgtttgtgggcaacgactctggacgagtgaaaccacatggattttatcaggcctgcagagtaactggacgaaatacaactccttgcaaagaagtggacattgaaggcactactgttatagaagtcggccttgatcctagcaacaacatgacactggcggtggactgcgtagggatattgaaattgaggaatgctgatgtcgaagccagaataggaattgctggttccaagaagaaaagcactcgtgccagattggtttttcgagttaatatcatgaggaaagatggctccactttgacactgcaaacaccctcttctccaattttgtgtactcagccagcaggagtgccagaaatcttaaagaaaagcttgcatagctgttcagtgaaaggagaagaagaagtgtttttaatcggcaagaactttctgaaaggaactaaagttattttccaagaaaatgtttctgatgaaaactcttggaagtcagaagctgaaattgatatggaactatttcatcagaatcatcttattgtgaaggttcctccctatcatgaccaacatataactttgcctgtgtcagtgggaatatatgtagtgacaaatgctggaagatctcatgatgttcaaccattcacttacactccagacccagcagcagctggtgctttgaatgtaaatgtgaagaaggaaatatctagtccagcaagaccttgctcttttgaagaggccatgaaagcaatgaaaactactggatgtaatttagataaggtaaatattatccctaatgccctgatgactccactcataccaagcagtatgattaagagtgaagatgttactccaatggaagtaacagcagaaaaaagatcttccactatttttaagactacaaagtctgttggatcaactcagcaaacattagaaaacatctcaaacatagcaggaaatggctctttttcatcaccatcatcttcccacctaccttctgaaaatgaaaaacagcagcagattcagcccaaggcatacaacccagagaccctgacaactattcaaacccaggacatctcacagcctggtacttttccagcagtttctgcttctagtcagctgcccaacagcgatgcactattgcagcaggctacacagtttcagacaagagaaactcagtctagagagatattacagtcagatggtacagtggttaatttgtcacaactgactgaggcatcacaacaacagcagcagtcaccactacaagaacaagcacagactttacagcagcagatttcatcaaatatttttccatcaccaaatagtgtgagtcagcttcagaatactattcagcagctgcaagcagggagtttcacaggcagtactgctagtggcagcagtggaagtgttgacttggtccaacaagttttagaggcacagcagcagttatcttcagttttattttctgctccagatggtaatgagaatgttcaagagcagcttagtgcagatatttttcaacaagtcagtcaaattcagagtggtgtaagccctggaatgttttcctcaacagagccaacagtccataccagaccagataatttattacctggaagagctgaaagtgttcatccacagtctgaaaacacgttatctaatcaacagcagcagcagcagcagcaacagcaagtgatggaatcttcagccgcaatggtgatggagatgcaacagagtatctgccaggcagctgcccagattcagtcagagttattcccttcaactgcttcagcaaatggaaaccttcagcaatcgccagtttaccagcagacttctcacatgatgagtgcattgtctaccaatgaggatatgcaaatgcagtgtgaattgttttcttctcctcctgcagtttctggaaatgaaacttctacaactaccacacagcaggttgcaacccctggcactaccatgtttcagacatcaagttcaggagatggagaagaaactggaacacaagcaaaacagattcagaacagtgtctttcagaccatggtccaaatgcaacatagtggggacaatcaacctcaagttaaccttttttcatccacaaaaagtatgatgagtgttcagaatagtggtacccaacaacaaggtaatggtttattccagcaagggaatgagatgatgtcacttcaatctggaaattttttgcagcagtcttctcattcacaggcccaactttttcatcctcaaaatcctattgccgatgctcagaacctttcccaggaaactcaaggttctctctttcatagtccaaatcctattgtccacagtcagacttctacaacctcctctgaacaaatgcagcctccaatgtttcactctcaaagtaccattgctgtgttacagggctcttcagttcctcaagaccagcagtcaaccaacatatttctttcccagagtcccatgaataatcttcagactaacacagtagcccaagaagcattttttgcagcaccgaactcaatttctccacttcagtcaacatcaaacagtgaacaacaagctgctttccaacagcaagctccaatatcacacatccagactcctatgctttcccaagaacaggcacaacccccgcagcagggtttatttcagcctcaggtggccctgggctcccttccacctaatccaatgcctcaaagccaacaaggaaccatgttccagtcacagcactcaatagttgccatgcagagtaactctccatcccaggaacagcagcagcagcagcaacagcagcagcaacagcagcagcaacaacaacagagcattttattcagtaatcagaataccatggctacaatggcgtctccaaagcaaccaccaccaaacatgatattcaacccaaatcaaaatccaatggctaatcaggagcaacagaaccagtcaatttttcaccaacaaagtaacatggccccaatgaatcaagagcaacagcccatgcaatttcagagtcagtccacagtttcctcacttcagaacccaggtcctacccagtcggaatcatcacagacccccttgttccatagctctcctcagattcagttggtacaagggtcacctagttctcaagagcagcaagtaactctcttcttatctccagcatccatgtctgccttgcagaccagtataaatcaacaagatatgcaacagtctcctctttattcccctcagaacaacatgcctggaattcaaggagccacatcttcgcctcaaccacaggctactttatttcacaacacagcaggaggcacaatgaaccaactgcagaattctcctggctcatctcagcagacatcaggaatgttcttatttggcattcaaaataactgtagtcagcttttaacctctggaccagctacattgcctgatcagttgatggccataagtcagccaggccaaccacaaaacgagggccagccacctgtgacaacacttctttctcagcaaatgccagagaattctccactggcatcctctataaacaccaaccagaacatcgaaaagattgatttgcttgtttcattgcaaaaccaagggaacaacttgactggctccttttaactggatataaattccacgaagaaaatcctgattccaagatgtcctgagatcttgtggttccatgagaattattactttaaaaacaaaacaaaatataaaaaactgtgtttgagtaaactgatagattttactctgactgcaaaagagcacacctatgctgcttgttgcagtaactaaccaccaatgttaacatcttcatattttatattcctaataacagtgatgactgagaatctatttgagtttccagctggcagaattaattgttattattttcctaggcgcaatttccttaaacgtacagtttaaattcaaggctggaccactcagttattattgctattagaaaataatatatcatgtttacttttgttcttcattattttctttcctgcattgttttagtcaagtaatggcttttgaaaaagtaaagttcaataataactaaggctgtgatttttttcaatataaaaggcacagctgttggccaaagtgaaggaatcttttttcagttttattggagaaactgaagggtaacattctaacaagtaaactgtatgtgcagataaaagtactcttgatttaacacaaaggcagatgatacacttataaaactgggaacagctggaatgcttcttgattttattttttcagagagttgttagttctctgggtttctactaaggggtttagccataactgtgcatagaaaaataattatctgtaaaaaatgaaggggataatatatgataaattatgttctgatatcctcctacagtagtttaaattgacagaaaaatttgaatgttttcttcttaacccagtcttaggctggtattccctttttatatatatctatattacttttcacctctttttcactttactttagagaactattaatatactactggcttcatgaccctgtagcatctttggccactttaatctagggtgacctagcaatcctgcagcacagggcagagagtactgtcttaggaattattaggagttgattcctgagaaacaacacatttttccccatgaacggtgctgttctgaagtcttcaaatttttccctctaataggaaacagtataaattttaattaaaaaaaaaaggcaaactaaaatttcttgaaatatcacttctccctgatctgcagtgagtataaattcacttgtcacctcagtgctttacagtttgaagtggtcacttacctgatggttcccacaagccttaggctttacagggttgtatcattgacttaaaatgaagaattaacttgtgttacatctataaagagcaaaataacacactccagaacttggcagttgtagcattagttatacagttttgggtgttcttgccacccgtgggatgcctgcttctcactaccacctgtgtctggacacatgcttatgtctcattttccttttggcatgtggaaagctgtcaatgcagtgtaaggccaacgtgtgtgtggcttctatgtgttgagataatgttttggtatccttgtccgtttcatttattttttaagtgtacaaaaaataacctgttaattgttgaaggctacttttctgttctttttttttttttttttctatcctgtacatttagttgaactgtgcggaattgtggtgttggttttgtttacacagccagatttttccttctttttgttttgtgatgatcttcctttgttctttgaatgtgctcttttgtctttttctcttttttctcatgttttcttccctccacctccacccctttctttctttctctctctgattgagaggcattgaattacgttttcagtagtacaggcttcttgccgatatgaagggaacttttcagaaagagacctactctgggtcatttaattttgaatacagttttcaatcgttcaagttttggatggtttatatctaatgtgtgtttcatttttttggaaagctatattttgtatttaggaaatggtatactattttgctatttgtactgagtgagtacattggcataaatatagaaatttatatatatacatatatataaactattcttttttgccacacatttttgtggtaaatttgtgagtttgtctgatgttctaccacaacgtggcgtctgataacagtgagggggggtggggtttgttatgtctttattgagtatttaagtatcttttgaaacaaatgacctgttcatctgtggccattccatcaggcagttagttccttgatgtcagtagtgggctaaaggcagcttactgtgtgtttgctggagctttcactcagccaagtgttagagtcaggaaacccattgaggcaatggcgtcaaatggtgtttcacaagaatgagccattcagtctttgctcactatatatttaatattttattattgttgttattgttattattaattggctttctgtattctatgccttttatttataaagacactaagaaaacccatgtttgtaattttaataacatttttcccatcttgtaatatccagagctactttataaattctctgaaccaaaagtattttcctcagtgtatctcttctcccccagcccctattgggaaaaattacccagtatagttcaggttatgaggaggatcagccacacaatccagtgcttcagtttgaaaatgtaaaattctaaccctaaagtagggttggttgaaatttcagacaaagcaaacccagcaggtataaaaagtagtataaatacaaatctgtaagttatttttgaattttctgaacttttttctaagagattacataggagactaaagaaatctatctgttcaagttctaattaggatgattgttaatactgcactgtggatgaagtggcgactggcttgtgtgctgacttctgtggtttagcaagaggtttattgttatcaaatgctaattggcaatgccaagtcactgggaccaattttctgttttataatatctaagtttagaacagaatatatacctgaactgtagtggtttgatcggatggagacagaaaacccgatttttattctcataaattttgtggttatttatacaagggctgtgctatgctaccatattcttgttcaataataataggtttgttgttttttttacattgttaaatgttccttacccctaaaggtcaatgttaagtacaacattctgaaaatacaatttggctacgaagagtattcatcttctttgaagctcagtggttgatatttgtgctaataatgcaatttcctgattactgttacaagttatagctacatatgggagagactcagtgagccagcaaaggccatagaaacaacaatttattaaatgtatttatggcagaaggacctaaataaactgtgagccaccttttcttctttatattgttacatttaagtgttcttgctttcagcaactcacattaatgcttggagcttatctctttctctctctctctctctctctctgtgtgtgtgtgtgtatgtgtgtgtgtgtgtgtgtgtgtttccttattgtcattccattatatatccacaccaacatgggtgacgataattcaaagtcatattttgcctctaagcttgatcatgttacctttatgattaaagtatcatgttatttagccaatgcaaatctgttttaaaacaaatagtttaaaaaaagaacaagtttttaagggctttattatagaagaagtattaatgaaggactttccttcctccctccctttcctcccctccctgcctcccttcttcccttccatctccccctcctccctgccttctttgtttctccttcccttattcctccctccctcctttctcccttccttcctttcttccattcatccttccttgccttttatttttattttttgtaatatcacatgtgctgtagtttggaattttattctagtgcatttcttgctcatcagaacctcagctaatctacctaggaaaaatagtatcaaaggaaatgagaaagttgtatctgagtccctccagaactaagataattctttttgaccatttaagcctttataaatgcgttttgaccatttaagcctttataaatgcttgttttaggaaagtgaatctgttagatgcatcaacaaataatgaccaggacaaaacgatttaataattaaagtctcaaatcaccatggttatacattttcaccagaaatagtaatcttacaatttttcatttttctgatgaagatttctgttccaatatctgtttcctaatagattttttaaattaattagctttcctctgctttatgaccacaggttttatccctaaccgagacagctgtcttatatctgcatgccttagactgtgtggagggactccatgaagaaagaccataggttagaaaaataactcatagtatataccctagtaagtgggttagtagaatctcataacatgtattaaaaagaggttttcttctctgcttgtttgtgtcactagagcaaaattgtagagataatgctcataatgcagtaaatatcagaataatatctacaatatcatttgtggatggtcccaggtcccagtgctctagttactttacttctttttttttttttgagatggagtcttgctctgtctctcaggctagagcagtgtgcgatctcagctcactgcagcctccacctcccaggttcaagcgattctcctgcctcagcctcccaagtagccaggattacaggcaccctccactaggcccggctaattttttttgtatttttttagtagagatggggttttgccatgttggccaggctggtttcgaactcctaacctccagtgatccacctgcctcggcgtcccaaagtgctaggattacaggcatgagccaccacatccggcctaattacttctttaatccccatttatttttatgccattctagcctcatttattaataaaattatgtttttactttctctttcaggaaattttttaaattaatattttatatctagatctaatgctatggaaaagtgcctttttatcatttataatttcatttttcactatttccaaaaacacataaacaaatagtttcagtaggtcccagcttttactttttccatttaaaccttcttttctccatttcttccctttggcttaagaataaaagaaaaggtacattgctagaattgtttctttgggagagggtaaaagattacagaattagactgttcagcctttatataaactaaatttgtcttcatctcaaccagctaatggtaggtcttatctgaatactcatgagaattttagcatctgtgaaactccatgcaccagatgtgtgtaaatttcaggaagaaagtgttgaaagcattttctctgatgttaattagatggaaataaatcactaaaacatagtttaggtaaagcctgattatgccacttttttttaactagacagggcaaagttgtttatgttagtgtacttcttgtctatcctcagttaatttacctagacaaaaagtgtcaaaggaaatgagaaaaaggttatatctgactccctccagacctaagataattccttttgatcagatacagtcagatggagtgccttggtttttgttaattttgcctctattccagctccttaccacagcggtggtgcttaaagaaaggatcatcagcaacaggtcaggatagttctacctttgggatagggctgctttccccgtgctagtatttctgtgactgttagtggcactgaggactgcaaacttttatgcaatattcttaataccctattgatattatgcactttaatcattccaaagaagccaagaatgctgtatagtgatgattccttcctaatgaattcatcttaactatttagaatgttatgtcccttttcttttggatagccaacttggtataaatgttatatggatttttctaaaatgactatataggacttaagactttgaaatgtaatttacttataaggggaaataattatgctttagcacatcattttagaaacgtcacattttagaaacattcagcttgctaacctacatgtttgggaattcattaaaaccagttgtctatatattttgtgccatgtatataagaacattacaatatatctttttctacatatgtagtatgtgcaaccagtggttctcagagtatggttctcagcccaccagctagtatcagtatcacctgggaactagttagaaatgtaaattctttggccccatcccagacatactgagtcagaaactctggaatagggcccccgcaatctgttttcacaagccctccaggtgattctgatgcacactttaaagtttaggaaccactgggctaagactctgttgagatatagagtttttcttccactcagactgatatagttatacattgttcttcatgtaaattcagcttaacctggttatctataatcttttattggcaaaagttaattctcagtactgcctatagagatacagtgtattttatgtacatacacaattagtctaattcttgataattcagttaatttagtttggcattttcctaccacttactaaaaggtttacattaaatgactgatttaaatatataggtgcaatgttctatgtttattttaattgttatgacatttaagtagctaatataattgaccggtgctaaagtctcctgtttatccataaaatgggtacattatgggcagtgtaatacaagctttcttttcattgcctagtactttaccagcagaccacagttttgccctggctagaccaaccctcagaacaaaatcatcattccttgtatttatatttgtatctgagatagtaaacaagatggctggccaggtcaacatggcaccttaacttatttttttaataggtaaaacttcttcaaaagtagcttgctttgtataagaactaagctatcagtatagatatagctatccttggagcttatgtttcagacaagaattatttactaaaataaataataaacaagataatgcattatacaatttgggcatttctcgtttctcaagtgtatgcatcatggtaaatataaactaaccacaagataggtagattgattcatttcattttaatctccttgtgtaattcagtacctccataattgttctaatcttcttcccactgtttacaaattaccagttaattaactcgtgaaagaaaaattcacatatcagaataaaaataaatgtatactcactttataaaaatcaccactgctgtctttccttaatactagcagtggaaatgtaagtggcttactctacaaattttggtgctggcaaatacataggcaaactgttgggagctgctctagttacattcctcccttcttattccctttttctcttcctcactttattgcataacatattcctgtacccaaagcattctaccacagttctatttgactcccacttgtaataactcctttaaaaaattccatgtttaaccatatgaccctgcttgcttactcatattctccctccctctccccttcctttctctctcttccagaagtcatttgcctggtttgaaatattttgtagggattgcttattatattattttagctgatgaacctcaggacaacgtctacacacacacacatacatacacgcacacaaaatctcagctgttgaagagtgggcttggaatcagacttctgtgtccagtaaaaaactcctgcactgaagtcattgtgacttgagtagttacagactgattccagtgaacttgatctaatttcttttgatctaatgaatgtgtctgcttaccttgtttccttttaattgataagctccaagtagttgctaattttttgacaactttaaatgagtttcattcacttcttttacttaatgttttaagtatagtaccaataatttcattaacctgttctcaagtggtttagctaccattctgccatttttaatttttatttaattttatttgcttgagcacactgatcaaccactgaactgccttcttccattgtcctgcaatgatataagggttacatttttgtgtatatggctttcatagttgggatttcagagcactgataccagatattttcagtttgttctctgggggaatttcatttgcatctatgtttttagctatctgtgataacttgttaaatattaaaaagatattttgcttctattggaacatttgtatactcgcaactatatttctgtaaacagctgcagtcaaaaataaaacactgaaagttttcattttgcagtgga

SEQ ID NO: 2851 - DNA, 13067 bp, Homo sapiens
ccggttcggtgcccgcggtcccggagaggaggtgccgccgccaccgccgctccccccctcccgctgccctcgggccgggctgggtcgagctgcgatgccctcggacttcatctcattgctcagcgcggacctagacctggaatcgcccaagtccctctactcgcgagaatctgtctatgatcttctcccaaaggagttacagttacctccatctagagaaacatctgtagcatcaatgagtcagacaagcggtggtgaggcaggctcgcctcctccagctgttgttgctgctggatttgcctctgaagcagggagtgtctgcattaaaaatgacctgtagttctctgcttcatagatgcttcttcagctccctcctcttcctccatgggcggtgcttgcagctcctttaccacctcttccagccctaccatttattctacctcagtcaccgacagcaaggctatgcaagtggagagctgctcctcagccgtgggggtaagtaacagaggggtaagtgaaaagcagttaaccagtaacacagttcagcagcatccatcaacaccgaagaggcacacagtcttgtacatctcaccaccacctgaggacttgctggataacagtcggatgtcctgccaggatgaggggtgtggattggaatctgagcagagctgcagtatgtggatggaggattccccctccaacttcagtaacatgagcaccagttcctacaatgataacactgaggtacctcgtaaatcacgaaaacgaaatccaaagcagaggccgggggtcaaacgacgagattgtgaagaatctaatatggatatatttgatgccgacagtgccaaagcacctcactatgtgctttctcagcttaccacggacaacaaaggcaactcaaaagcgggaaatggaacattggaaaaccaaaaaggaactggagtaaagaagagccctatgttgtgtggacaatatcctgttaaaagtgagggaaaggagctgaagatagttgtacaacctgagacacagcaccgagctcggtacctgactgagggcagccgtggctcagtgaaagatagaacacagcaaggctttcctacagtaaagctggaaggccataatgaacctgtagtgttgcaagtgtttgtgggcaacgactctggacgagtgaaaccacatggattttatcaggcctgcagagtaactggacgaaatacaactccttgcaaagaagtggacattgaaggcactactgttatagaagtcggccttgatcctagcaacaacatgacactggcggtggactgcgtagggatattgaaattgaggaatgctgatgtcgaagccagaataggaattgctggttccaagaagaaaagcactcgtgccagattggtttttcgagttaatatcatgaggaaagatggctccactttgacactgcaaacaccctcttctccaattttgtgtactcagccagcaggagtgccagaaatcttaaagaaaagcttgcatagctgttcagtgaaaggagaagaagaagtgtttttaatcggcaagaactttctgaaaggaactaaagttattttccaagaaaatgtttctgatgaaaactcttggaagtcagaagctgaaattgatatggaactatttcatcagaatcatcttattgtgaaggttcctccctatcatgaccaacatataactttgcctgtgtcagtgggaatatatgtagtgacaaatgctggaagatctcatgatgttcaaccattcacttacactccagacccagcagcagctggtgctttgaatgtaaatgtgaagaaggaaatatctagtccagcaagaccttgctcttttgaagaggccatgaaagcaatgaaaactactggatgtaatttagataaggtaaatattatccctaatgccctgatgactccactcataccaagcagtatgattaagagtgaagatgttactccaatggaagtaacagcagaaaaaagatcttccactatttttaagactacaaagtctgttggatcaactcagcaaacattagaaaacatctcaaacatagcaggaaatggctctttttcatcaccatcatcttcccacctaccttctgaaaatgaaaaacagcagcagattcagcccaaggcatacaacccagagaccctgacaactattcaaacccaggacatctcacagcctggtacttttccagcagtttctgcttctagtcagctgcccaacagcgatgcactattgcagcaggctacacagtttcagacaagagaaactcagtctagagagatattacagtcagatggtacagtggttaatttgtcacaactgactgaggcatcacaacaacagcagcagtcaccactacaagaacaagcacagactttacagcagcagatttcatcaaatatttttccatcaccaaatagtgtgagtcagcttcagaatactattcagcagctgcaagcagggagtttcacaggcagtactgctagtggcagcagtggaagtgttgacttggtccaacaagttttagaggcacagcagcagttatcttcagttttattttctgctccagatggtaatgagaatgttcaagagcagcttagtgcagatatttttcaacaagtcagtcaaattcagagtggtgtaagccctggaatgttttcctcaacagagccaacagtccataccagaccagataatttattacctggaagagctgaaagtgttcatccacagtctgaaaacacgttatctaatcaacagcagcagcagcagcagcaacagcaagtgatggaatcttcagccgcaatggtgatggagatgcaacagagtatctgccaggcagctgcccagattcagtcagagttattcccttcaactgcttcagcaaatggaaaccttcagcaatcgccagtttaccagcagacttctcacatgatgagtgcattgtctaccaatgaggatatgcaaatgcagtgtgaattgttttcttctcctcctgcagtttctggaaatgaaacttctacaactaccacacagcaggttgcaacccctggcactaccatgtttcagacatcaagttcaggagatggagaagaaactggaacacaagcaaaacagattcagaacagtgtctttcagaccatggtccaaatgcaacatagtggggacaatcaacctcaagttaaccttttttcatccacaaaaagtatgatgagtgttcagaatagtggtacccaacaacaaggtaatggtttattccagcaagggaatgagatgatgtcacttcaatctggaaattttttgcagcagtcttctcattcacaggcccaactttttcatcctcaaaatcctattgccgatgctcagaacctttcccaggaaactcaaggttctctctttcatagtccaaatcctattgtccacagtcagacttctacaacctcctctgaacaaatgcagcctccaatgtttcactctcaaagtaccattgctgtgttacagggctcttcagttcctcaagaccagcagtcaaccaacatatttctttcccagagtcccatgaataatcttcagactaacacagtagcccaagaagcattttttgcagcaccgaactcaatttctccacttcagtcaacatcaaacagtgaacaacaagctgctttccaacagcaagctccaatatcacacatccagactcctatgctttcccaagaacaggcacaacccccgcagcagggtttatttcagcctcaggtggccctgggctcccttccacctaatccaatgcctcaaagccaacaaggaaccatgttccagtcacagcactcaatagttgccatgcagagtaactctccatcccaggaacagcagcagcagcagcaacagcagcagcaacagcagcagcaacaacaacagagcattttattcagtaatcagaataccatggctacaatggcgtctccaaagcaaccaccaccaaacatgatattcaacccaaatcaaaatccaatggctaatcaggagcaacagaaccagtcaatttttcaccaacaaagtaacatggccccaatgaatcaagagcaacagcccatgcaatttcagagtcagtccacagtttcctcacttcagaacccaggtcctacccagtcggaatcatcacagacccccttgttccatagctctcctcagattcagttggtacaagggtcacctagttctcaagagcagcaagtaactctcttcttatctccagcatccatgtctgccttgcagaccagtataaatcaacaagatatgcaacagtctcctctttattcccctcagaacaacatgcctggaattcaaggagccacatcttcgcctcaaccacaggctactttatttcacaacacagcaggaggcacaatgaaccaactgcagaattctcctggctcatctcagcagacatcaggaatgttcttatttggcattcaaaataactgtagtcagcttttaacctctggaccagctacattgcctgatcagttgatggccataagtcagccaggccaaccacaaaacgagggccagccacctgtgacaacacttctttctcagcaaatgccagagaattctccactggcatcctctataaacaccaaccagaacatcgaaaagattgatttgcttgtttcattgcaaaaccaagggaacaacttgactggctccttttaactggatataaattccacgaagaaaatcctgattccaagatgtcctgagatcttgtggttccatgagaattattactttaaaaacaaaacaaaatataaaaaactgtgtttgagtaaactgatagattttactctgactgcaaaagagcacacctatgctgcttgttgcagtaactaaccaccaatgttaacatcttcatattttatattcctaataacagtgatgactgagaatctatttgagtttccagctggcagaattaattgttattattttcctaggcgcaatttccttaaacgtacagtttaaattcaaggctggaccactcagttattattgctattagaaaataatatatcatgtttacttttgttcttcattattttctttcctgcattgttttagtcaagtaatggcttttgaaaaagtaaagttcaataataactaaggctgtgatttttttcaatataaaaggcacagctgttggccaaagtgaaggaatcttttttcagttttattggagaaactgaagggtaacattctaacaagtaaactgtatgtgcagataaaagtactcttgatttaacacaaaggcagatgatacacttataaaactgggaacagctggaatgcttcttgattttattttttcagagagttgttagttctctgggtttctactaaggggtttagccataactgtgcatagaaaaataattatctgtaaaaaatgaaggggataatatatgataaattatgttctgatatcctcctacagtagtttaaattgacagaaaaatttgaatgttttcttcttaacccagtcttaggctggtattccctttttatatatatctatattacttttcacctctttttcactttactttagagaactattaatatactactggcttcatgaccctgtagcatctttggccactttaatctagggtgacctagcaatcctgcagcacagggcagagagtactgtcttaggaattattaggagttgattcctgagaaacaacacatttttccccatgaacggtgctgttctgaagtcttcaaatttttccctctaataggaaacagtataaattttaattaaaaaaaaaaggcaaactaaaatttcttgaaatatcacttctccctgatctgcagtgagtataaattcacttgtcacctcagtgctttacagtttgaagtggtcacttacctgatggttcccacaagccttaggctttacagggttgtatcattgacttaaaatgaagaattaacttgtgttacatctataaagagcaaaataacacactccagaacttggcagttgtagcattagttatacagttttgggtgttcttgccacccgtgggatgcctgcttctcactaccacctgtgtctggacacatgcttatgtctcattttccttttggcatgtggaaagctgtcaatgcagtgtaaggccaacgtgtgtgtggcttctatgtgttgagataatgttttggtatccttgtccgtttcatttattttttaagtgtacaaaaaataacctgttaattgttgaaggctacttttctgttctttttttttttttttttctatcctgtacatttagttgaactgtgcggaattgtggtgttggttttgtttacacagccagatttttccttctttttgttttgtgatgatcttcctttgttctttgaatgtgctcttttgtctttttctcttttttctcatgttttcttccctccacctccacccctttctttctttctctctctgattgagaggcattgaattacgttttcagtagtacaggcttcttgccgatatgaagggaacttttcagaaagagacctactctgggtcatttaattttgaatacagttttcaatcgttcaagttttggatggtttatatctaatgtgtgtttcatttttttggaaagctatattttgtatttaggaaatggtatactattttgctatttgtactgagtgagtacattggcataaatatagaaatttatatatatacatatatataaactattcttttttgccacacatttttgtggtaaatttgtgagtttgtctgatgttctaccacaacgtggcgtctgataacagtgagggggggtggggtttgttatgtctttattgagtatttaagtatcttttgaaacaaatgacctgttcatctgtggccattccatcaggcagttagttccttgatgtcagtagtgggctaaaggcagcttactgtgtgtttgctggagctttcactcagccaagtgttagagtcaggaaacccattgaggcaatggcgtcaaatggtgtttcacaagaatgagccattcagtctttgctcactatatatttaatattttattattgttgttattgttattattaattggctttctgtattctatgccttttatttataaagacactaagaaaacccatgtttgtaattttaataacatttttcccatcttgtaatatccagagctactttataaattctctgaaccaaaagtattttcctcagtgtatctcttctcccccagcccctattgggaaaaattacccagtatagttcaggttatgaggaggatcagccacacaatccagtgcttcagtttgaaaatgtaaaattctaaccctaaagtagggttggttgaaatttcagacaaagcaaacccagcaggtataaaaagtagtataaatacaaatctgtaagttatttttgaattttctgaacttttttctaagagattacataggagactaaagaaatctatctgttcaagttctaattaggatgattgttaatactgcactgtggatgaagtggcgactggcttgtgtgctgacttctgtggtttagcaagaggtttattgttatcaaatgctaattggcaatgccaagtcactgggaccaattttctgttttataatatctaagtttagaacagaatatatacctgaactgtagtggtttgatcggatggagacagaaaacccgatttttattctcataaattttgtggttatttatacaagggctgtgctatgctaccatattcttgttcaataataataggtttgttgttttttttacattgttaaatgttccttacccctaaaggtcaatgttaagtacaacattctgaaaatacaatttggctacgaagagtattcatcttctttgaagctcagtggttgatatttgtgctaataatgcaatttcctgattactgttacaagttatagctacatatgggagagactcagtgagccagcaaaggccatagaaacaacaatttattaaatgtatttatggcagaaggacctaaataaactgtgagccaccttttcttctttatattgttacatttaagtgttcttgctttcagcaactcacattaatgcttggagcttatctctttctctctctctctctctctctctgtgtgtgtgtgtgtatgtgtgtgtgtgtgtgtgtgtgtttccttattgtcattccattatatatccacaccaacatgggtgacgataattcaaagtcatattttgcctctaagcttgatcatgttacctttatgattaaagtatcatgttatttagccaatgcaaatctgttttaaaacaaatagtttaaaaaaagaacaagtttttaagggctttattatagaagaagtattaatgaaggactttccttcctccctccctttcctcccctccctgcctcccttcttcccttccatctccccctcctccctgccttctttgtttctccttcccttattcctccctccctcctttctcccttccttcctttcttccattcatccttccttgccttttatttttattttttgtaatatcacatgtgctgtagtttggaattttattctagtgcatttcttgctcatcagaacctcagctaatctacctaggaaaaatagtatcaaaggaaatgagaaagttgtatctgagtccctccagaactaagataattctttttgaccatttaagcctttataaatgcgttttgaccatttaagcctttataaatgcttgttttaggaaagtgaatctgttagatgcatcaacaaataatgaccaggacaaaacgatttaataattaaagtctcaaatcaccatggttatacattttcaccagaaatagtaatcttacaatttttcatttttctgatgaagatttctgttccaatatctgtttcctaatagattttttaaattaattagctttcctctgctttatgaccacaggttttatccctaaccgagacagctgtcttatatctgcatgccttagactgtgtggagggactccatgaagaaagaccataggttagaaaaataactcatagtatataccctagtaagtgggttagtagaatctcataacatgtattaaaaagaggttttcttctctgcttgtttgtgtcactagagcaaaattgtagagataatgctcataatgcagtaaatatcagaataatatctacaatatcatttgtggatggtcccaggtcccagtgctctagttactttacttctttttttttttttgagatggagtcttgctctgtctctcaggctagagcagtgtgcgatctcagctcactgcagcctccacctcccaggttcaagcgattctcctgcctcagcctcccaagtagccaggattacaggcaccctccactaggcccggctaattttttttgtatttttttagtagagatggggttttgccatgttggccaggctggtttcgaactcctaacctccagtgatccacctgcctcggcgtcccaaagtgctaggattacaggcatgagccaccacatccggcctaattacttctttaatccccatttatttttatgccattctagcctcatttattaataaaattatgtttttactttctctttcaggaaattttttaaattaatattttatatctagatctaatgctatggaaaagtgcctttttatcatttataatttcatttttcactatttccaaaaacacataaacaaatagtttcagtaggtcccagcttttactttttccatttaaaccttcttttctccatttcttccctttggcttaagaataaaagaaaaggtacattgctagaattgtttctttgggagagggtaaaagattacagaattagactgttcagcctttatataaactaaatttgtcttcatctcaaccagctaatggtaggtcttatctgaatactcatgagaattttagcatctgtgaaactccatgcaccagatgtgtgtaaatttcaggaagaaagtgttgaaagcattttctctgatgttaattagatggaaataaatcactaaaacatagtttaggtaaagcctgattatgccacttttttttaactagacagggcaaagttgtttatgttagtgtacttcttgtctatcctcagttaatttacctagacaaaaagtgtcaaaggaaatgagaaaaaggttatatctgactccctccagacctaagataattccttttgatcagatacagtcagatggagtgccttggtttttgttaattttgcctctattccagctccttaccacagcggtggtgcttaaagaaaggatcatcagcaacaggtcaggatagttctacctttgggatagggctgctttccccgtgctagtatttctgtgactgttagtggcactgaggactgcaaacttttatgcaatattcttaataccctattgatattatgcactttaatcattccaaagaagccaagaatgctgtatagtgatgattccttcctaatgaattcatcttaactatttagaatgttatgtcccttttcttttggatagccaacttggtataaatgttatatggatttttctaaaatgactatataggacttaagactttgaaatgtaatttacttataaggggaaataattatgctttagcacatcattttagaaacgtcacattttagaaacattcagcttgctaacctacatgtttgggaattcattaaaaccagttgtctatatattttgtgccatgtatataagaacattacaatatatctttttctacatatgtagtatgtgcaaccagtggttctcagagtatggttctcagcccaccagctagtatcagtatcacctgggaactagttagaaatgtaaattctttggccccatcccagacatactgagtcagaaactctggaatagggcccccgcaatctgttttcacaagccctccaggtgattctgatgcacactttaaagtttaggaaccactgggctaagactctgttgagatatagagtttttcttccactcagactgatatagttatacattgttcttcatgtaaattcagcttaacctggttatctataatcttttattggcaaaagttaattctcagtactgcctatagagatacagtgtattttatgtacatacacaattagtctaattcttgataattcagttaatttagtttggcattttcctaccacttactaaaaggtttacattaaatgactgatttaaatatataggtgcaatgttctatgtttattttaattgttatgacatttaagtagctaatataattgaccggtgctaaagtctcctgtttatccataaaatgggtacattatgggcagtgtaatacaagctttcttttcattgcctagtactttaccagcagaccacagttttgccctggctagaccaaccctcagaacaaaatcatcattccttgtatttatatttgtatctgagatagtaaacaagatggctggccaggtcaacatggcaccttaacttatttttttaataggtaaaacttcttcaaaagtagcttgctttgtataagaactaagctatcagtatagatatagctatccttggagcttatgtttcagacaagaattatttactaaaataaataataaacaagataatgcattatacaatttgggcatttctcgtttctcaagtgtatgcatcatggtaaatataaactaaccacaagataggtagattgattcatttcattttaatctccttgtgtaattcagtacctccataattgttctaatcttcttcccactgtttacaaattaccagttaattaactcgtgaaagaaaaattcacatatcagaataaaaataaatgtatactcactttataaaaatcaccactgctgtctttccttaatactagcagtggaaatgtaagtggcttactctacaaattttggtgctggcaaatacataggcaaactgttgggagctgctctagttacattcctcccttcttattccctttttctcttcctcactttattgcataacatattcctgtacccaaagcattctaccacagttctatttgactcccacttgtaataactcctttaaaaaattccatgtttaaccatatgaccctgcttgcttactcatattctccctccctctccccttcctttctctctcttccagaagtcatttgcctggtttgaaatattttgtagggattgcttattatattattttagctgatgaacctcaggacaacgtctacacacacacacatacatacacgcacacaaaatctcagctgttgaagagtgggcttggaatcagacttctgtgtccagtaaaaaactcctgcactgaagtcattgtgacttgagtagttacagactgattccagtgaacttgatctaatttcttttgatctaatgaatgtgtctgcttaccttgtttccttttaattgataagctccaagtagttgctaattttttgacaactttaaatgagtttcattcacttcttttacttaatgttttaagtatagtaccaataatttcattaacctgttctcaagtggtttagctaccattctgccatttttaatttttatttaattttatttgcttgagcacactgatcaaccactgaactgccttcttccattgtcctgcaatgatataagggttacatttttgtgtatatggctttcatagttgggatttcagagcactgataccagatattttcagtttgttctctgggggaatttcatttgcatctatgtttttagctatctgtgataacttgttaaatattaaaaagatattttgcttctattggaacatttgtatactcgcaactatatttctgtaaacagctgcagtcaaaaataaaacactgaaagttttcattttgcagtgga

SEQ ID NO: 2852 - DNA, 14154 bp, Homo sapiens
tgcaacggaaacttttggctccacgaacagaaaagcaagagcaaaaactcagttaaatgcgttcttcctccatctttgcctagtccaaaaggaaaaaaaaagaaacagaaaaaagaaaaactgtttggaagagtagcgttgaggtttgctttttacctgtttttcctctagaacagccaggtggattcacatgatccaattttttaattgtcttctatgtcccactccgaataacccggatgccccagcacaatcagagagatcgttttttttaaaaaaaatttcagcctccaaaggtaggaggggagtgttaggggagaaagtactttaattaaaaatcaataactcgaggtttttgggatacggtttgccatttcctaattaagaaatgggtttgacagtccctttgtacacactgctatgcaaaccccaaagggttggcggctgtccgggcgatgacactccggtcccctgcgagaccccgggccagccaggcccgtccgccgccggcctctggggtccgtccccggctcgcgcagacctctcgcttctctcggctctgtctcctgcgctcagctctgctcggggccggccgcctcaggctcgccgccaccaggtcgttgcaaataccttttccctccccggggccccagcgcgcggccacctcccagcctccccccctcccaccctggcagcggggccctttcccggctcaggaacagcagcagcccgggccgcgccggcaggaagcgaggcccatgttgctgctgttccctggcgcgcctccccgccctccgggggccgccacggctcttccgcgctcccgggcacccccctccgcgcctgcgctgtgccccacgggggcggggctcagattcctgtcagcggcggcggcggtggcggcgaccgtcagttttcgctgaggagaaacacgaaacggaccctttggctctcccccttccccttccccgtcctgaacccctctcctggtcaccgagaatcagtccccgtggagttccccctccacctcgccatcgtttcctcggtcctcggcccagtggaagtcactaccctcgaggaggaggcagcggcagccgccctcgcgtcgccgcccccggttcggtgcccgcggtcccggagaggaggtgccgccgccaccgccgctccccccctcccgctgccctcgggccgggctgggtcgagctgcgatgccctcggacttcatctcattgctcagcgcggacctagacctggaatcgcccaagtccctctactcgcgagattctctgaagttacacccatcacagaattttcatagagctggactattggaagaatctgtctatgatcttctcccaaaggagttacagttacctccatctagagaaacatctgtagcatcaatgagtcagacaagcggtggtgaggcaggctcgcctcctccagctgttgttgctgctgatgcttcttcagctccctcctcttcctccatgggcggtgcttgcagctcctttaccacctcttccagccctaccatttattctacctcagtcaccgacagcaaggctatgcaagtggagagctgctcctcagccgtgggggtaagtaacagaggggtaagtgaaaagcagttaaccagtaacacagttcagcagcatccatcaacaccgaagaggcacacagtcttgtacatctcaccaccacctgaggacttgctggataacagtcggatgtcctgccaggatgaggggtgtggattggaatctgagcagagctgcagtatgtggatggaggattccccctccaacttcagtaacatgagcaccagttcctacaatgataacactgaggtacctcgtaaatcacgaaaacgaaatccaaagcagaggccgggggtcaaacgacgagattgtgaagaatctaatatggatatatttgatgccgacagtgccaaagcacctcactatgtgctttctcagcttaccacggacaacaaaggcaactcaaaagcgggaaatggaacattggaaaaccaaaaaggaactggagtaaagaagagccctatgttgtgtggacaatatcctgttaaaagtgagggaaaggagctgaagatagttgtacaacctgagacacagcaccgagctcggtacctgactgagggcagccgtggctcagtgaaagatagaacacagcaaggctttcctacagtaaagctggaaggccataatgaacctgtagtgttgcaagtgtttgtgggcaacgactctggacgagtgaaaccacatggattttatcaggcctgcagagtaactggacgaaatacaactccttgcaaagaagtggacattgaaggcactactgttatagaagtcggccttgatcctagcaacaacatgacactggcggtggactgcgtagggatattgaaattgaggaatgctgatgtcgaagccagaataggaattgctggttccaagaagaaaagcactcgtgccagattggtttttcgagttaatatcatgaggaaagatggctccactttgacactgcaaacaccctcttctccaattttgtgtactcagccagcaggagtgccagaaatcttaaagaaaagcttgcatagctgttcagtgaaaggagaagaagaagtgtttttaatcggcaagaactttctgaaaggaactaaagttattttccaagaaaatgtttctgatgaaaactcttggaagtcagaagctgaaattgatatggaactatttcatcagaatcatcttattgtgaaggttcctccctatcatgaccaacatataactttgcctgtgtcagtgggaatatatgtagtgacaaatgctggaagatctcatgatgttcaaccattcacttacactccagacccagcagctggtgctttgaatgtaaatgtgaagaaggaaatatctagtccagcaagaccttgctcttttgaagaggccatgaaagcaatgaaaactactggatgtaatttagataaggtaaatattatccctaatgccctgatgactccactcataccaagcagtatgattaagagtgaagatgttactccaatggaagtaacagcagaaaaaagatcttccactatttttaagactacaaagtctgttggatcaactcagcaaacattagaaaacatctcaaacatagcaggaaatggctctttttcatcaccatcatcttcccacctaccttctgaaaatgaaaaacagcagcagattcagcccaaggcatacaacccagagaccctgacaactattcaaacccaggacatctcacagcctggtacttttccagcagtttctgcttctagtcagctgcccaacagcgatgcactattgcagcaggctacacagtttcagacaagagaaactcagtctagagagatattacagtcagatggtacagtggttaatttgtcacaactgactgaggcatcacaacaacagcagcagtcaccactacaagaacaagcacagactttacagcagcagatttcatcaaatatttttccatcaccaaatagtgtgagtcagcttcagaatactattcagcagctgcaagcagggagtttcacaggcagtactgctagtggcagcagtggaagtgttgacttggtccaacaagttttagaggcacagcagcagttatcttcagttttattttctgctccagatggtaatgagaatgttcaagagcagcttagtgcagatatttttcaacaagtcagtcaaattcagagtggtgtaagccctggaatgttttcctcaacagagccaacagtccataccagaccagataatttattacctggaagagctgaaagtgttcatccacagtctgaaaacacgttatctaatcaacagcagcagcagcagcagcaacagcaagtgatggaatcttcagccgcaatggtgatggagatgcaacagagtatctgccaggcagctgcccagattcagtcagagttattcccttcaactgcttcagcaaatggaaaccttcagcaatcgccagtttaccagcagacttctcacatgatgagtgcattgtctaccaatgaggatatgcaaatgcagtgtgaattgttttcttctcctcctgcagtttctggaaatgaaacttctacaactaccacacagcaggttgcaacccctggcactaccatgtttcagacatcaagttcaggagatggagaagaaactggaacacaagcaaaacagattcagaacagtgtctttcagaccatggtccaaatgcaacatagtggggacaatcaacctcaagttaaccttttttcatccacaaaaagtatgatgagtgttcagaatagtggtacccaacaacaaggtaatggtttattccagcaagggaatgagatgatgtcacttcaatctggaaattttttgcagcagtcttctcattcacaggcccaactttttcatcctcaaaatcctattgccgatgctcagaacctttcccaggaaactcaaggttctctctttcatagtccaaatcctattgtccacagtcagacttctacaacctcctctgaacaaatgcagcctccaatgtttcactctcaaagtaccattgctgtgttacagggctcttcagttcctcaagaccagcagtcaaccaacatatttctttcccagagtcccatgaataatcttcagactaacacagtagcccaagaagcattttttgcagcaccgaactcaatttctccacttcagtcaacatcaaacagtgaacaacaagctgctttccaacagcaagctccaatatcacacatccagactcctatgctttcccaagaacaggcacaacccccgcagcagggtttatttcagcctcaggtggccctgggctcccttccacctaatccaatgcctcaaagccaacaaggaaccatgttccagtcacagcactcaatagttgccatgcagagtaactctccatcccaggaacagcagcagcagcagcaacagcagcagcaacagcagcagcaacaacaacagagcattttattcagtaatcagaataccatggctacaatggcgtctccaaagcaaccaccaccaaacatgatattcaacccaaatcaaaatccaatggctaatcaggagcaacagaaccagtcaatttttcaccaacaaagtaacatggccccaatgaatcaagagcaacagcccatgcaatttcagagtcagtccacagtttcctcacttcagaacccaggtcctacccagtcggaatcatcacagacccccttgttccatagctctcctcagattcagttggtacaagggtcacctagttctcaagagcagcaagtaactctcttcttatctccagcatccatgtctgccttgcagaccagtataaatcaacaagatatgcaacagtctcctctttattcccctcagaacaacatgcctggaattcaaggagccacatcttcgcctcaaccacaggctactttatttcacaacacagcaggaggcacaatgaaccaactgcagaattctcctggctcatctcagcagacatcaggaatgttcttatttggcattcaaaataactgtagtcagcttttaacctctggaccagctacattgcctgatcagttgatggccataagtcagccaggccaaccacaaaacgagggccagccacctgtgacaacacttctttctcagcaaatgccagagaattctccactggcatcctctataaacaccaaccagaacatcgaaaagattgatttgcttgtttcattgcaaaaccaagggaacaacttgactggctccttttaactggatataaattccacgaagaaaatcctgattccaagatgtcctgagatcttgtggttccatgagaattattactttaaaaacaaaacaaaatataaaaaactgtgtttgagtaaactgatagattttactctgactgcaaaagagcacacctatgctgcttgttgcagtaactaaccaccaatgttaacatcttcatattttatattcctaataacagtgatgactgagaatctatttgagtttccagctggcagaattaattgttattattttcctaggcgcaatttccttaaacgtacagtttaaattcaaggctggaccactcagttattattgctattagaaaataatatatcatgtttacttttgttcttcattattttctttcctgcattgttttagtcaagtaatggcttttgaaaaagtaaagttcaataataactaaggctgtgatttttttcaatataaaaggcacagctgttggccaaagtgaaggaatcttttttcagttttattggagaaactgaagggtaacattctaacaagtaaactgtatgtgcagataaaagtactcttgatttaacacaaaggcagatgatacacttataaaactgggaacagctggaatgcttcttgattttattttttcagagagttgttagttctctgggtttctactaaggggtttagccataactgtgcatagaaaaataattatctgtaaaaaatgaaggggataatatatgataaattatgttctgatatcctcctacagtagtttaaattgacagaaaaatttgaatgttttcttcttaacccagtcttaggctggtattccctttttatatatatctatattacttttcacctctttttcactttactttagagaactattaatatactactggcttcatgaccctgtagcatctttggccactttaatctagggtgacctagcaatcctgcagcacagggcagagagtactgtcttaggaattattaggagttgattcctgagaaacaacacatttttccccatgaacggtgctgttctgaagtcttcaaatttttccctctaataggaaacagtataaattttaattaaaaaaaaaaggcaaactaaaatttcttgaaatatcacttctccctgatctgcagtgagtataaattcacttgtcacctcagtgctttacagtttgaagtggtcacttacctgatggttcccacaagccttaggctttacagggttgtatcattgacttaaaatgaagaattaacttgtgttacatctataaagagcaaaataacacactccagaacttggcagttgtagcattagttatacagttttgggtgttcttgccacccgtgggatgcctgcttctcactaccacctgtgtctggacacatgcttatgtctcattttccttttggcatgtggaaagctgtcaatgcagtgtaaggccaacgtgtgtgtggcttctatgtgttgagataatgttttggtatccttgtccgtttcatttattttttaagtgtacaaaaaataacctgttaattgttgaaggctacttttctgttctttttttttttttttttctatcctgtacatttagttgaactgtgcggaattgtggtgttggttttgtttacacagccagatttttccttctttttgttttgtgatgatcttcctttgttctttgaatgtgctcttttgtctttttctcttttttctcatgttttcttccctccacctccacccctttctttctttctctctctgattgagaggcattgaattacgttttcagtagtacaggcttcttgccgatatgaagggaacttttcagaaagagacctactctgggtcatttaattttgaatacagttttcaatcgttcaagttttggatggtttatatctaatgtgtgtttcatttttttggaaagctatattttgtatttaggaaatggtatactattttgctatttgtactgagtgagtacattggcataaatatagaaatttatatatatacatatatataaactattcttttttgccacacatttttgtggtaaatttgtgagtttgtctgatgttctaccacaacgtggcgtctgataacagtgagggggggtggggtttgttatgtctttattgagtatttaagtatcttttgaaacaaatgacctgttcatctgtggccattccatcaggcagttagttccttgatgtcagtagtgggctaaaggcagcttactgtgtgtttgctggagctttcactcagccaagtgttagagtcaggaaacccattgaggcaatggcgtcaaatggtgtttcacaagaatgagccattcagtctttgctcactatatatttaatattttattattgttgttattgttattattaattggctttctgtattctatgccttttatttataaagacactaagaaaacccatgtttgtaattttaataacatttttcccatcttgtaatatccagagctactttataaattctctgaaccaaaagtattttcctcagtgtatctcttctcccccagcccctattgggaaaaattacccagtatagttcaggttatgaggaggatcagccacacaatccagtgcttcagtttgaaaatgtaaaattctaaccctaaagtagggttggttgaaatttcagacaaagcaaacccagcaggtataaaaagtagtataaatacaaatctgtaagttatttttgaattttctgaacttttttctaagagattacataggagactaaagaaatctatctgttcaagttctaattaggatgattgttaatactgcactgtggatgaagtggcgactggcttgtgtgctgacttctgtggtttagcaagaggtttattgttatcaaatgctaattggcaatgccaagtcactgggaccaattttctgttttataatatctaagtttagaacagaatatatacctgaactgtagtggtttgatcggatggagacagaaaacccgatttttattctcataaattttgtggttatttatacaagggctgtgctatgctaccatattcttgttcaataataataggtttgttgttttttttacattgttaaatgttccttacccctaaaggtcaatgttaagtacaacattctgaaaatacaatttggctacgaagagtattcatcttctttgaagctcagtggttgatatttgtgctaataatgcaatttcctgattactgttacaagttatagctacatatgggagagactcagtgagccagcaaaggccatagaaacaacaatttattaaatgtatttatggcagaaggacctaaataaactgtgagccaccttttcttctttatattgttacatttaagtgttcttgctttcagcaactcacattaatgcttggagcttatctctttctctctctctctctctctctctgtgtgtgtgtgtgtatgtgtgtgtgtgtgtgtgtgtgtttccttattgtcattccattatatatccacaccaacatgggtgacgataattcaaagtcatattttgcctctaagcttgatcatgttacctttatgattaaagtatcatgttatttagccaatgcaaatctgttttaaaacaaatagtttaaaaaaagaacaagtttttaagggctttattatagaagaagtattaatgaaggactttccttcctccctccctttcctcccctccctgcctcccttcttcccttccatctccccctcctccctgccttctttgtttctccttcccttattcctccctccctcctttctcccttccttcctttcttccattcatccttccttgccttttatttttattttttgtaatatcacatgtgctgtagtttggaattttattctagtgcatttcttgctcatcagaacctcagctaatctacctaggaaaaatagtatcaaaggaaatgagaaagttgtatctgagtccctccagaactaagataattctttttgaccatttaagcctttataaatgcgttttgaccatttaagcctttataaatgcttgttttaggaaagtgaatctgttagatgcatcaacaaataatgaccaggacaaaacgatttaataattaaagtctcaaatcaccatggttatacattttcaccagaaatagtaatcttacaatttttcatttttctgatgaagatttctgttccaatatctgtttcctaatagattttttaaattaattagctttcctctgctttatgaccacaggttttatccctaaccgagacagctgtcttatatctgcatgccttagactgtgtggagggactccatgaagaaagaccataggttagaaaaataactcatagtatataccctagtaagtgggttagtagaatctcataacatgtattaaaaagaggttttcttctctgcttgtttgtgtcactagagcaaaattgtagagataatgctcataatgcagtaaatatcagaataatatctacaatatcatttgtggatggtcccaggtcccagtgctctagttactttacttctttttttttttttgagatggagtcttgctctgtctctcaggctagagcagtgtgcgatctcagctcactgcagcctccacctcccaggttcaagcgattctcctgcctcagcctcccaagtagccaggattacaggcaccctccactaggcccggctaattttttttgtatttttttagtagagatggggttttgccatgttggccaggctggtttcgaactcctaacctccagtgatccacctgcctcggcgtcccaaagtgctaggattacaggcatgagccaccacatccggcctaattacttctttaatccccatttatttttatgccattctagcctcatttattaataaaattatgtttttactttctctttcaggaaattttttaaattaatattttatatctagatctaatgctatggaaaagtgcctttttatcatttataatttcatttttcactatttccaaaaacacataaacaaatagtttcagtaggtcccagcttttactttttccatttaaaccttcttttctccatttcttccctttggcttaagaataaaagaaaaggtacattgctagaattgtttctttgggagagggtaaaagattacagaattagactgttcagcctttatataaactaaatttgtcttcatctcaaccagctaatggtaggtcttatctgaatactcatgagaattttagcatctgtgaaactccatgcaccagatgtgtgtaaatttcaggaagaaagtgttgaaagcattttctctgatgttaattagatggaaataaatcactaaaacatagtttaggtaaagcctgattatgccacttttttttaactagacagggcaaagttgtttatgttagtgtacttcttgtctatcctcagttaatttacctagacaaaaagtgtcaaaggaaatgagaaaaaggttatatctgactccctccagacctaagataattccttttgatcagatacagtcagatggagtgccttggtttttgttaattttgcctctattccagctccttaccacagcggtggtgcttaaagaaaggatcatcagcaacaggtcaggatagttctacctttgggatagggctgctttccccgtgctagtatttctgtgactgttagtggcactgaggactgcaaacttttatgcaatattcttaataccctattgatattatgcactttaatcattccaaagaagccaagaatgctgtatagtgatgattccttcctaatgaattcatcttaactatttagaatgttatgtcccttttcttttggatagccaacttggtataaatgttatatggatttttctaaaatgactatataggacttaagactttgaaatgtaatttacttataaggggaaataattatgctttagcacatcattttagaaacgtcacattttagaaacattcagcttgctaacctacatgtttgggaattcattaaaaccagttgtctatatattttgtgccatgtatataagaacattacaatatatctttttctacatatgtagtatgtgcaaccagtggttctcagagtatggttctcagcccaccagctagtatcagtatcacctgggaactagttagaaatgtaaattctttggccccatcccagacatactgagtcagaaactctggaatagggcccccgcaatctgttttcacaagccctccaggtgattctgatgcacactttaaagtttaggaaccactgggctaagactctgttgagatatagagtttttcttccactcagactgatatagttatacattgttcttcatgtaaattcagcttaacctggttatctataatcttttattggcaaaagttaattctcagtactgcctatagagatacagtgtattttatgtacatacacaattagtctaattcttgataattcagttaatttagtttggcattttcctaccacttactaaaaggtttacattaaatgactgatttaaatatataggtgcaatgttctatgtttattttaattgttatgacatttaagtagctaatataattgaccggtgctaaagtctcctgtttatccataaaatgggtacattatgggcagtgtaatacaagctttcttttcattgcctagtactttaccagcagaccacagttttgccctggctagaccaaccctcagaacaaaatcatcattccttgtatttatatttgtatctgagatagtaaacaagatggctggccaggtcaacatggcaccttaacttatttttttaataggtaaaacttcttcaaaagtagcttgctttgtataagaactaagctatcagtatagatatagctatccttggagcttatgtttcagacaagaattatttactaaaataaataataaacaagataatgcattatacaatttgggcatttctcgtttctcaagtgtatgcatcatggtaaatataaactaaccacaagataggtagattgattcatttcattttaatctccttgtgtaattcagtacctccataattgttctaatcttcttcccactgtttacaaattaccagttaattaactcgtgaaagaaaaattcacatatcagaataaaaataaatgtatactcactttataaaaatcaccactgctgtctttccttaatactagcagtggaaatgtaagtggcttactctacaaattttggtgctggcaaatacataggcaaactgttgggagctgctctagttacattcctcccttcttattccctttttctcttcctcactttattgcataacatattcctgtacccaaagcattctaccacagttctatttgactcccacttgtaataactcctttaaaaaattccatgtttaaccatatgaccctgcttgcttactcatattctccctccctctccccttcctttctctctcttccagaagtcatttgcctggtttgaaatattttgtagggattgcttattatattattttagctgatgaacctcaggacaacgtctacacacacacacatacatacacgcacacaaaatctcagctgttgaagagtgggcttggaatcagacttctgtgtccagtaaaaaactcctgcactgaagtcattgtgacttgagtagttacagactgattccagtgaacttgatctaatttcttttgatctaatgaatgtgtctgcttaccttgtttccttttaattgataagctccaagtagttgctaattttttgacaactttaaatgagtttcattcacttcttttacttaatgttttaagtatagtaccaataatttcattaacctgttctcaagtggtttagctaccattctgccatttttaatttttatttaattttatttgcttgagcacactgatcaaccactgaactgccttcttccattgtcctgcaatgatataagggttacatttttgtgtatatggctttcatagttgggatttcagagcactgataccagatattttcagtttgttctctgggggaatttcatttgcatctatgtttttagctatctgtgataacttgttaaatattaaaaagatattttgcttctattggaacatttgtatactcgcaactatatttctgtaaacagctgcagtcaaaaataaaacactgaaagtt

SEQ ID NO: 2853 - DNA, 14157 bp, Homo sapiens
tgcaacggaaacttttggctccacgaacagaaaagcaagagcaaaaactcagttaaatgcgttcttcctccatctttgcctagtccaaaaggaaaaaaaaagaaacagaaaaaagaaaaactgtttggaagagtagcgttgaggtttgctttttacctgtttttcctctagaacagccaggtggattcacatgatccaattttttaattgtcttctatgtcccactccgaataacccggatgccccagcacaatcagagagatcgttttttttaaaaaaaatttcagcctccaaaggtaggaggggagtgttaggggagaaagtactttaattaaaaatcaataactcgaggtttttgggatacggtttgccatttcctaattaagaaatgggtttgacagtccctttgtacacactgctatgcaaaccccaaagggttggcggctgtccgggcgatgacactccggtcccctgcgagaccccgggccagccaggcccgtccgccgccggcctctggggtccgtccccggctcgcgcagacctctcgcttctctcggctctgtctcctgcgctcagctctgctcggggccggccgcctcaggctcgccgccaccaggtcgttgcaaataccttttccctccccggggccccagcgcgcggccacctcccagcctccccccctcccaccctggcagcggggccctttcccggctcaggaacagcagcagcccgggccgcgccggcaggaagcgaggcccatgttgctgctgttccctggcgcgcctccccgccctccgggggccgccacggctcttccgcgctcccgggcacccccctccgcgcctgcgctgtgccccacgggggcggggctcagattcctgtcagcggcggcggcggtggcggcgaccgtcagttttcgctgaggagaaacacgaaacggaccctttggctctcccccttccccttccccgtcctgaacccctctcctggtcaccgagaatcagtccccgtggagttccccctccacctcgccatcgtttcctcggtcctcggcccagtggaagtcactaccctcgaggaggaggcagcggcagccgccctcgcgtcgccgcccccggttcggtgcccgcggtcccggagaggaggtgccgccgccaccgccgctccccccctcccgctgccctcgggccgggctgggtcgagctgcgatgccctcggacttcatctcattgctcagcgcggacctagacctggaatcgcccaagtccctctactcgcgagattctctgaagttacacccatcacagaattttcatagagctggactattggaagaatctgtctatgatcttctcccaaaggagttacagttacctccatctagagaaacatctgtagcatcaatgagtcagacaagcggtggtgaggcaggctcgcctcctccagctgttgttgctgctgatgcttcttcagctccctcctcttcctccatgggcggtgcttgcagctcctttaccacctcttccagccctaccatttattctacctcagtcaccgacagcaaggctatgcaagtggagagctgctcctcagccgtgggggtaagtaacagaggggtaagtgaaaagcagttaaccagtaacacagttcagcagcatccatcaacaccgaagaggcacacagtcttgtacatctcaccaccacctgaggacttgctggataacagtcggatgtcctgccaggatgaggggtgtggattggaatctgagcagagctgcagtatgtggatggaggattccccctccaacttcagtaacatgagcaccagttcctacaatgataacactgaggtacctcgtaaatcacgaaaacgaaatccaaagcagaggccgggggtcaaacgacgagattgtgaagaatctaatatggatatatttgatgccgacagtgccaaagcacctcactatgtgctttctcagcttaccacggacaacaaaggcaactcaaaagcgggaaatggaacattggaaaaccaaaaaggaactggagtaaagaagagccctatgttgtgtggacaatatcctgttaaaagtgagggaaaggagctgaagatagttgtacaacctgagacacagcaccgagctcggtacctgactgagggcagccgtggctcagtgaaagatagaacacagcaaggctttcctacagtaaagctggaaggccataatgaacctgtagtgttgcaagtgtttgtgggcaacgactctggacgagtgaaaccacatggattttatcaggcctgcagagtaactggacgaaatacaactccttgcaaagaagtggacattgaaggcactactgttatagaagtcggccttgatcctagcaacaacatgacactggcggtggactgcgtagggatattgaaattgaggaatgctgatgtcgaagccagaataggaattgctggttccaagaagaaaagcactcgtgccagattggtttttcgagttaatatcatgaggaaagatggctccactttgacactgcaaacaccctcttctccaattttgtgtactcagccagcaggagtgccagaaatcttaaagaaaagcttgcatagctgttcagtgaaaggagaagaagaagtgtttttaatcggcaagaactttctgaaaggaactaaagttattttccaagaaaatgtttctgatgaaaactcttggaagtcagaagctgaaattgatatggaactatttcatcagaatcatcttattgtgaaggttcctccctatcatgaccaacatataactttgcctgtgtcagtgggaatatatgtagtgacaaatgctggaagatctcatgatgttcaaccattcacttacactccagacccagcagcagctggtgctttgaatgtaaatgtgaagaaggaaatatctagtccagcaagaccttgctcttttgaagaggccatgaaagcaatgaaaactactggatgtaatttagataaggtaaatattatccctaatgccctgatgactccactcataccaagcagtatgattaagagtgaagatgttactccaatggaagtaacagcagaaaaaagatcttccactatttttaagactacaaagtctgttggatcaactcagcaaacattagaaaacatctcaaacatagcaggaaatggctctttttcatcaccatcatcttcccacctaccttctgaaaatgaaaaacagcagcagattcagcccaaggcatacaacccagagaccctgacaactattcaaacccaggacatctcacagcctggtacttttccagcagtttctgcttctagtcagctgcccaacagcgatgcactattgcagcaggctacacagtttcagacaagagaaactcagtctagagagatattacagtcagatggtacagtggttaatttgtcacaactgactgaggcatcacaacaacagcagcagtcaccactacaagaacaagcacagactttacagcagcagatttcatcaaatatttttccatcaccaaatagtgtgagtcagcttcagaatactattcagcagctgcaagcagggagtttcacaggcagtactgctagtggcagcagtggaagtgttgacttggtccaacaagttttagaggcacagcagcagttatcttcagttttattttctgctccagatggtaatgagaatgttcaagagcagcttagtgcagatatttttcaacaagtcagtcaaattcagagtggtgtaagccctggaatgttttcctcaacagagccaacagtccataccagaccagataatttattacctggaagagctgaaagtgttcatccacagtctgaaaacacgttatctaatcaacagcagcagcagcagcagcaacagcaagtgatggaatcttcagccgcaatggtgatggagatgcaacagagtatctgccaggcagctgcccagattcagtcagagttattcccttcaactgcttcagcaaatggaaaccttcagcaatcgccagtttaccagcagacttctcacatgatgagtgcattgtctaccaatgaggatatgcaaatgcagtgtgaattgttttcttctcctcctgcagtttctggaaatgaaacttctacaactaccacacagcaggttgcaacccctggcactaccatgtttcagacatcaagttcaggagatggagaagaaactggaacacaagcaaaacagattcagaacagtgtctttcagaccatggtccaaatgcaacatagtggggacaatcaacctcaagttaaccttttttcatccacaaaaagtatgatgagtgttcagaatagtggtacccaacaacaaggtaatggtttattccagcaagggaatgagatgatgtcacttcaatctggaaattttttgcagcagtcttctcattcacaggcccaactttttcatcctcaaaatcctattgccgatgctcagaacctttcccaggaaactcaaggttctctctttcatagtccaaatcctattgtccacagtcagacttctacaacctcctctgaacaaatgcagcctccaatgtttcactctcaaagtaccattgctgtgttacagggctcttcagttcctcaagaccagcagtcaaccaacatatttctttcccagagtcccatgaataatcttcagactaacacagtagcccaagaagcattttttgcagcaccgaactcaatttctccacttcagtcaacatcaaacagtgaacaacaagctgctttccaacagcaagctccaatatcacacatccagactcctatgctttcccaagaacaggcacaacccccgcagcagggtttatttcagcctcaggtggccctgggctcccttccacctaatccaatgcctcaaagccaacaaggaaccatgttccagtcacagcactcaatagttgccatgcagagtaactctccatcccaggaacagcagcagcagcagcaacagcagcagcaacagcagcagcaacaacaacagagcattttattcagtaatcagaataccatggctacaatggcgtctccaaagcaaccaccaccaaacatgatattcaacccaaatcaaaatccaatggctaatcaggagcaacagaaccagtcaatttttcaccaacaaagtaacatggccccaatgaatcaagagcaacagcccatgcaatttcagagtcagtccacagtttcctcacttcagaacccaggtcctacccagtcggaatcatcacagacccccttgttccatagctctcctcagattcagttggtacaagggtcacctagttctcaagagcagcaagtaactctcttcttatctccagcatccatgtctgccttgcagaccagtataaatcaacaagatatgcaacagtctcctctttattcccctcagaacaacatgcctggaattcaaggagccacatcttcgcctcaaccacaggctactttatttcacaacacagcaggaggcacaatgaaccaactgcagaattctcctggctcatctcagcagacatcaggaatgttcttatttggcattcaaaataactgtagtcagcttttaacctctggaccagctacattgcctgatcagttgatggccataagtcagccaggccaaccacaaaacgagggccagccacctgtgacaacacttctttctcagcaaatgccagagaattctccactggcatcctctataaacaccaaccagaacatcgaaaagattgatttgcttgtttcattgcaaaaccaagggaacaacttgactggctccttttaactggatataaattccacgaagaaaatcctgattccaagatgtcctgagatcttgtggttccatgagaattattactttaaaaacaaaacaaaatataaaaaactgtgtttgagtaaactgatagattttactctgactgcaaaagagcacacctatgctgcttgttgcagtaactaaccaccaatgttaacatcttcatattttatattcctaataacagtgatgactgagaatctatttgagtttccagctggcagaattaattgttattattttcctaggcgcaatttccttaaacgtacagtttaaattcaaggctggaccactcagttattattgctattagaaaataatatatcatgtttacttttgttcttcattattttctttcctgcattgttttagtcaagtaatggcttttgaaaaagtaaagttcaataataactaaggctgtgatttttttcaatataaaaggcacagctgttggccaaagtgaaggaatcttttttcagttttattggagaaactgaagggtaacattctaacaagtaaactgtatgtgcagataaaagtactcttgatttaacacaaaggcagatgatacacttataaaactgggaacagctggaatgcttcttgattttattttttcagagagttgttagttctctgggtttctactaaggggtttagccataactgtgcatagaaaaataattatctgtaaaaaatgaaggggataatatatgataaattatgttctgatatcctcctacagtagtttaaattgacagaaaaatttgaatgttttcttcttaacccagtcttaggctggtattccctttttatatatatctatattacttttcacctctttttcactttactttagagaactattaatatactactggcttcatgaccctgtagcatctttggccactttaatctagggtgacctagcaatcctgcagcacagggcagagagtactgtcttaggaattattaggagttgattcctgagaaacaacacatttttccccatgaacggtgctgttctgaagtcttcaaatttttccctctaataggaaacagtataaattttaattaaaaaaaaaaggcaaactaaaatttcttgaaatatcacttctccctgatctgcagtgagtataaattcacttgtcacctcagtgctttacagtttgaagtggtcacttacctgatggttcccacaagccttaggctttacagggttgtatcattgacttaaaatgaagaattaacttgtgttacatctataaagagcaaaataacacactccagaacttggcagttgtagcattagttatacagttttgggtgttcttgccacccgtgggatgcctgcttctcactaccacctgtgtctggacacatgcttatgtctcattttccttttggcatgtggaaagctgtcaatgcagtgtaaggccaacgtgtgtgtggcttctatgtgttgagataatgttttggtatccttgtccgtttcatttattttttaagtgtacaaaaaataacctgttaattgttgaaggctacttttctgttctttttttttttttttttctatcctgtacatttagttgaactgtgcggaattgtggtgttggttttgtttacacagccagatttttccttctttttgttttgtgatgatcttcctttgttctttgaatgtgctcttttgtctttttctcttttttctcatgttttcttccctccacctccacccctttctttctttctctctctgattgagaggcattgaattacgttttcagtagtacaggcttcttgccgatatgaagggaacttttcagaaagagacctactctgggtcatttaattttgaatacagttttcaatcgttcaagttttggatggtttatatctaatgtgtgtttcatttttttggaaagctatattttgtatttaggaaatggtatactattttgctatttgtactgagtgagtacattggcataaatatagaaatttatatatatacatatatataaactattcttttttgccacacatttttgtggtaaatttgtgagtttgtctgatgttctaccacaacgtggcgtctgataacagtgagggggggtggggtttgttatgtctttattgagtatttaagtatcttttgaaacaaatgacctgttcatctgtggccattccatcaggcagttagttccttgatgtcagtagtgggctaaaggcagcttactgtgtgtttgctggagctttcactcagccaagtgttagagtcaggaaacccattgaggcaatggcgtcaaatggtgtttcacaagaatgagccattcagtctttgctcactatatatttaatattttattattgttgttattgttattattaattggctttctgtattctatgccttttatttataaagacactaagaaaacccatgtttgtaattttaataacatttttcccatcttgtaatatccagagctactttataaattctctgaaccaaaagtattttcctcagtgtatctcttctcccccagcccctattgggaaaaattacccagtatagttcaggttatgaggaggatcagccacacaatccagtgcttcagtttgaaaatgtaaaattctaaccctaaagtagggttggttgaaatttcagacaaagcaaacccagcaggtataaaaagtagtataaatacaaatctgtaagttatttttgaattttctgaacttttttctaagagattacataggagactaaagaaatctatctgttcaagttctaattaggatgattgttaatactgcactgtggatgaagtggcgactggcttgtgtgctgacttctgtggtttagcaagaggtttattgttatcaaatgctaattggcaatgccaagtcactgggaccaattttctgttttataatatctaagtttagaacagaatatatacctgaactgtagtggtttgatcggatggagacagaaaacccgatttttattctcataaattttgtggttatttatacaagggctgtgctatgctaccatattcttgttcaataataataggtttgttgttttttttacattgttaaatgttccttacccctaaaggtcaatgttaagtacaacattctgaaaatacaatttggctacgaagagtattcatcttctttgaagctcagtggttgatatttgtgctaataatgcaatttcctgattactgttacaagttatagctacatatgggagagactcagtgagccagcaaaggccatagaaacaacaatttattaaatgtatttatggcagaaggacctaaataaactgtgagccaccttttcttctttatattgttacatttaagtgttcttgctttcagcaactcacattaatgcttggagcttatctctttctctctctctctctctctctctgtgtgtgtgtgtgtatgtgtgtgtgtgtgtgtgtgtgtttccttattgtcattccattatatatccacaccaacatgggtgacgataattcaaagtcatattttgcctctaagcttgatcatgttacctttatgattaaagtatcatgttatttagccaatgcaaatctgttttaaaacaaatagtttaaaaaaagaacaagtttttaagggctttattatagaagaagtattaatgaaggactttccttcctccctccctttcctcccctccctgcctcccttcttcccttccatctccccctcctccctgccttctttgtttctccttcccttattcctccctccctcctttctcccttccttcctttcttccattcatccttccttgccttttatttttattttttgtaatatcacatgtgctgtagtttggaattttattctagtgcatttcttgctcatcagaacctcagctaatctacctaggaaaaatagtatcaaaggaaatgagaaagttgtatctgagtccctccagaactaagataattctttttgaccatttaagcctttataaatgcgttttgaccatttaagcctttataaatgcttgttttaggaaagtgaatctgttagatgcatcaacaaataatgaccaggacaaaacgatttaataattaaagtctcaaatcaccatggttatacattttcaccagaaatagtaatcttacaatttttcatttttctgatgaagatttctgttccaatatctgtttcctaatagattttttaaattaattagctttcctctgctttatgaccacaggttttatccctaaccgagacagctgtcttatatctgcatgccttagactgtgtggagggactccatgaagaaagaccataggttagaaaaataactcatagtatataccctagtaagtgggttagtagaatctcataacatgtattaaaaagaggttttcttctctgcttgtttgtgtcactagagcaaaattgtagagataatgctcataatgcagtaaatatcagaataatatctacaatatcatttgtggatggtcccaggtcccagtgctctagttactttacttctttttttttttttgagatggagtcttgctctgtctctcaggctagagcagtgtgcgatctcagctcactgcagcctccacctcccaggttcaagcgattctcctgcctcagcctcccaagtagccaggattacaggcaccctccactaggcccggctaattttttttgtatttttttagtagagatggggttttgccatgttggccaggctggtttcgaactcctaacctccagtgatccacctgcctcggcgtcccaaagtgctaggattacaggcatgagccaccacatccggcctaattacttctttaatccccatttatttttatgccattctagcctcatttattaataaaattatgtttttactttctctttcaggaaattttttaaattaatattttatatctagatctaatgctatggaaaagtgcctttttatcatttataatttcatttttcactatttccaaaaacacataaacaaatagtttcagtaggtcccagcttttactttttccatttaaaccttcttttctccatttcttccctttggcttaagaataaaagaaaaggtacattgctagaattgtttctttgggagagggtaaaagattacagaattagactgttcagcctttatataaactaaatttgtcttcatctcaaccagctaatggtaggtcttatctgaatactcatgagaattttagcatctgtgaaactccatgcaccagatgtgtgtaaatttcaggaagaaagtgttgaaagcattttctctgatgttaattagatggaaataaatcactaaaacatagtttaggtaaagcctgattatgccacttttttttaactagacagggcaaagttgtttatgttagtgtacttcttgtctatcctcagttaatttacctagacaaaaagtgtcaaaggaaatgagaaaaaggttatatctgactccctccagacctaagataattccttttgatcagatacagtcagatggagtgccttggtttttgttaattttgcctctattccagctccttaccacagcggtggtgcttaaagaaaggatcatcagcaacaggtcaggatagttctacctttgggatagggctgctttccccgtgctagtatttctgtgactgttagtggcactgaggactgcaaacttttatgcaatattcttaataccctattgatattatgcactttaatcattccaaagaagccaagaatgctgtatagtgatgattccttcctaatgaattcatcttaactatttagaatgttatgtcccttttcttttggatagccaacttggtataaatgttatatggatttttctaaaatgactatataggacttaagactttgaaatgtaatttacttataaggggaaataattatgctttagcacatcattttagaaacgtcacattttagaaacattcagcttgctaacctacatgtttgggaattcattaaaaccagttgtctatatattttgtgccatgtatataagaacattacaatatatctttttctacatatgtagtatgtgcaaccagtggttctcagagtatggttctcagcccaccagctagtatcagtatcacctgggaactagttagaaatgtaaattctttggccccatcccagacatactgagtcagaaactctggaatagggcccccgcaatctgttttcacaagccctccaggtgattctgatgcacactttaaagtttaggaaccactgggctaagactctgttgagatatagagtttttcttccactcagactgatatagttatacattgttcttcatgtaaattcagcttaacctggttatctataatcttttattggcaaaagttaattctcagtactgcctatagagatacagtgtattttatgtacatacacaattagtctaattcttgataattcagttaatttagtttggcattttcctaccacttactaaaaggtttacattaaatgactgatttaaatatataggtgcaatgttctatgtttattttaattgttatgacatttaagtagctaatataattgaccggtgctaaagtctcctgtttatccataaaatgggtacattatgggcagtgtaatacaagctttcttttcattgcctagtactttaccagcagaccacagttttgccctggctagaccaaccctcagaacaaaatcatcattccttgtatttatatttgtatctgagatagtaaacaagatggctggccaggtcaacatggcaccttaacttatttttttaataggtaaaacttcttcaaaagtagcttgctttgtataagaactaagctatcagtatagatatagctatccttggagcttatgtttcagacaagaattatttactaaaataaataataaacaagataatgcattatacaatttgggcatttctcgtttctcaagtgtatgcatcatggtaaatataaactaaccacaagataggtagattgattcatttcattttaatctccttgtgtaattcagtacctccataattgttctaatcttcttcccactgtttacaaattaccagttaattaactcgtgaaagaaaaattcacatatcagaataaaaataaatgtatactcactttataaaaatcaccactgctgtctttccttaatactagcagtggaaatgtaagtggcttactctacaaattttggtgctggcaaatacataggcaaactgttgggagctgctctagttacattcctcccttcttattccctttttctcttcctcactttattgcataacatattcctgtacccaaagcattctaccacagttctatttgactcccacttgtaataactcctttaaaaaattccatgtttaaccatatgaccctgcttgcttactcatattctccctccctctccccttcctttctctctcttccagaagtcatttgcctggtttgaaatattttgtagggattgcttattatattattttagctgatgaacctcaggacaacgtctacacacacacacatacatacacgcacacaaaatctcagctgttgaagagtgggcttggaatcagacttctgtgtccagtaaaaaactcctgcactgaagtcattgtgacttgagtagttacagactgattccagtgaacttgatctaatttcttttgatctaatgaatgtgtctgcttaccttgtttccttttaattgataagctccaagtagttgctaattttttgacaactttaaatgagtttcattcacttcttttacttaatgttttaagtatagtaccaataatttcattaacctgttctcaagtggtttagctaccattctgccatttttaatttttatttaattttatttgcttgagcacactgatcaaccactgaactgccttcttccattgtcctgcaatgatataagggttacatttttgtgtatatggctttcatagttgggatttcagagcactgataccagatattttcagtttgttctctgggggaatttcatttgcatctatgtttttagctatctgtgataacttgttaaatattaaaaagatattttgcttctattggaacatttgtatactcgcaactatatttctgtaaacagctgcagtcaaaaataaaacactgaaagtt

SEQ ID NO: 2854 - DNA, 2807 bp, Homo sapiens
gcgtcagagcgagactcagaggctccgaactcgccggcggagtcgccgcgccagatcccagcagcagggcgcgggcaccggggcgcgggcagggctcggagccaccgcgcaggtcctagggccgcggccgggccccgccacgcgcgcacacgcccctcgatgactttcctccggggcgcgcggcgctgagcccggggcgagggctgtcttcccggagacccgaccccggcagcgcggggcggccgcttctcctgtgcctccgcccgccgctccactccccgccgccgccgcgcggatgccaagcaccagctttccagtcccttccaagtttccacttggccctgcggctgcggtcttcgggagaggagaaactttggggcccgcgccgcgcgccggcggcaccatgaagtcagcggaggaagaacactatggctatgcatcctccaacgtcagccccgccctgccgctccccacggcgcactccaccctgccggccccgtgccacaaccttcagacctccacaccgggcatcatcccgccggcggatcacccctcggggtacggagcagctttggacggtgggcccgcgggctacttcctctcctccggccacaccaggcctgatggggcccctgccctggagagtcctcgcatcgagataacctcgtgcttgggcctgtaccacaacaataaccagtttttccacgatgtggaggtggaagacgtcctccctagctccaaacggtccccctccacggccacgctgagtctgcccagcctggaggcctacagagacccctcgtgcctgagcccggccagcagcctgtcctcccggagctgcaactcagaggcctcctcctacgagtccaactactcgtacccgtacgcgtccccccagacgtcgccatggcagtctccctgcgtgtctcccaagaccacggaccccgaggagggctttccccgcgggctgggggcctgcacactgctgggttccccgcggcactccccctccacctcgccccgcgccagcgtcactgaggagagctggctgggtgcccgctcctccagacccgcgtccccttgcaacaagaggaagtacagcctcaacggccggcagccgccctactcaccccaccactcgcccacgccgtccccgcacggctccccgcgggtcagcgtgaccgacgactcgtggttgggcaacaccacccagtacaccagctcggccatcgtggccgccatcaacgcgctgaccaccgacagcagcctggacctgggagatggcgtccctgtcaagtcccgcaagaccaccctggagcagccgccctcagtggcgctcaaggtggagcccgtcggggaggacctgggcagccccccgcccccggccgacttcgcgcccgaagactactcctctttccagcacatcaggaagggcggcttctgcgaccagtacctggcggtgccgcagcacccctaccagtgggcgaagcccaagcccctgtcccctacgtcctacatgagcccgaccctgcccgccctggactggcagctgccgtcccactcaggcccgtatgagcttcggattgaggtgcagcccaagtcccaccaccgagcccactacgagacggagggcagccggggggccgtgaaggcgtcggccggaggacaccccatcgtgcagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctcccagcgctcagctcaggagctgcctctggtggagaagcagagcacggacagctatccggtcgtgggcgggaagaagatggtcctgtctggccacaacttcctgcaggactccaaggtcattttcgtggagaaagccccagatggccaccatgtctgggagatggaagcgaaaactgaccgggacctgtgcaagccgaattctctggtggttgagatcccgccatttcggaatcagaggataaccagccccgttcacgtcagtttctacgtctgcaacgggaagagaaagcgaagccagtaccagcgtttcacctaccttcccgccaacggtaacgccatctttctaaccgtaagccgtgaacatgagcgcgtggggtgctttttctaaagacgcagaaacgacgtcgccgtaaagcagcgtggcgtgttgcacatttaactgtgtgatgtcccgttagtgagaccgagccatcgatgccctgaaaaggaaaggaaaagggaagcttcggatgcattttccttgatccctgttgggggtggggggcgggggttgcatactcagatagtcacggttattttgcttcttgcgaatgtataacagccaaggggaaaacatggctcttctgctccaaaaaactgagggggtcctggtgtgcatttgcaccctaaagctgcttacggtgaaaaggcaaataggtatagctattttgcaggcacctttaggaataaactttgcttttaagcctgta

SEQ ID NO: 2855 - DNA, 4642 bp, Homo sapiens
gagccgccgggccggcggggaggcgggggaggtgttttccagctttaaaaaggcaggaggcagagcgcggccctgcgtcagagcgagactcagaggctccgaactcgccggcggagtcgccgcgccagatcccagcagcagggcgcgggcaccggggcgcgggcagggctcggagccaccgcgcaggtcctagggccgcggccgggccccgccacgcgcgcacacgcccctcgatgactttcctccggggcgcgcggcgctgagcccggggcgagggctgtcttcccggagacccgaccccggcagcgcggggcggccgcttctcctgtgcctccgcccgccgctccactccccgccgccgccgcgcggatgccaagcaccagctttccagtcccttccaagtttccacttggccctgcggctgcggtcttcgggagaggagaaactttggggcccgcgccgcgcgccggcggcaccatgaagtcagcggaggaagaacactatggctatgcatcctccaacgtcagccccgccctgccgctccccacggcgcactccaccctgccggccccgtgccacaaccttcagacctccacaccgggcatcatcccgccggcggatcacccctcggggtacggagcagctttggacggtgggcccgcgggctacttcctctcctccggccacaccaggcctgatggggcccctgccctggagagtcctcgcatcgagataacctcgtgcttgggcctgtaccacaacaataaccagtttttccacgatgtggaggtggaagacgtcctccctagctccaaacggtccccctccacggccacgctgagtctgcccagcctggaggcctacagagacccctcgtgcctgagcccggccagcagcctgtcctcccggagctgcaactcagaggcctcctcctacgagtccaactactcgtacccgtacgcgtccccccagacgtcgccatggcagtctccctgcgtgtctcccaagaccacggaccccgaggagggctttccccgcgggctgggggcctgcacactgctgggttccccgcggcactccccctccacctcgccccgcgccagcgtcactgaggagagctggctgggtgcccgctcctccagacccgcgtccccttgcaacaagaggaagtacagcctcaacggccggcagccgccctactcaccccaccactcgcccacgccgtccccgcacggctccccgcgggtcagcgtgaccgacgactcgtggttgggcaacaccacccagtacaccagctcggccatcgtggccgccatcaacgcgctgaccaccgacagcagcctggacctgggagatggcgtccctgtcaagtcccgcaagaccaccctggagcagccgccctcagtggcgctcaaggtggagcccgtcggggaggacctgggcagccccccgcccccggccgacttcgcgcccgaagactactcctctttccagcacatcaggaagggcggcttctgcgaccagtacctggcggtgccgcagcacccctaccagtgggcgaagcccaagcccctgtcccctacgtcctacatgagcccgaccctgcccgccctggactggcagctgccgtcccactcaggcccgtatgagcttcggattgaggtgcagcccaagtcccaccaccgagcccactacgagacggagggcagccggggggccgtgaaggcgtcggccggaggacaccccatcgtgcagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctcccagcgctcagctcaggagctgcctctggtggagaagcagagcacggacagctatccggtcgtgggcgggaagaagatggtcctgtctggccacaacttcctgcaggactccaaggtcattttcgtggagaaagccccagatggccaccatgtctgggagatggaagcgaaaactgaccgggacctgtgcaagccgaattctctggtggttgagatcccgccatttcggaatcagaggataaccagccccgttcacgtcagtttctacgtctgcaacgggaagagaaagcgaagccagtaccagcgtttcacctaccttcccgccaacgttccaattataaaaacagaacccactgatgattatgagcctgctccaacctgtggaccggtgagccaggggttaagtcctctcccaagaccatactacagccagcagctcgcgatgccacccgaccccagctcctgcctcgtggccggcttcccgccctgtccgcagagaagcaccctgatgccagcggcccctggcgtgagccccaagctccacgacctttctcccgctgcctacaccaagggcgttgccagcccgggccactgtcacctcggactcccgcagccggccggagaggcccccgccgtccaggacgtgcccaggccagtggccacgcaccccggctcgcccgggcagccacccccggccctgctgccacagcagtaaatgaaataatacgaaatgacctctccagcacgagcacccactcctagttgccacattggagcactcagttcagcaggggtatgctgacttcagcagacaaagacttttgaataaataaactgaactcacacctggtaccactcagaacctccaactgactgaatgccaggagctgaacattaatatgtgcaaagattggctctccaacaagaaggaaagcagggaggaagggagaccactgtgtcacctggaggagaagtcatctcatgacaacagaagggaggtggccgggctgagcacgggagacccaccgtgcaggggcctttcatgggaacggcccacacgcagtttgaccccacgcccagcccttctggcacccctggggttcaatactggaagtgccttatttaaccagaccatcagggcatcatagaattgagcattgaatttgctactgtaggagtatttttaggagcagaaactgcaaacacatttcattgtgaggttttaccctctgtatgaatgaagagaacgctggaaggctgcgagaggactctagtatgagtctccaacatttggaacgtttcctgggctgtcacgtacactcctgctgccttacacagtgcattttagaatcttccagtctgtcatctcagctcttttgtaacatgcttcccttgtctgcgcggttgaaaccgtaggcttgttcatagtcgcatgctcgcatctttgtttttaatctggcttcgaacatagcacaagtaacttgaatagcacatcaataggttactggacaaaagcagaaaaacctgttacaggatagcctgcatttgcatgtgtgtacatatctaggcatctatttatgtataaataataacagagccgacgtgtcctcgcccaggagggcttccctgtcagcaataaccggcatccgttttggaacctgcgtctggggctccagtcgctgctcttgctggcgtccatcgccgcctcggacggccgtgcattttctcgtctcacgcagttcgaggaggaccctagaaagccaggagctgtgattgacagtagctgtaggttaccagacggcaacattagaaagtgattgtaaataacatgcaacctaagtgtaatatatttgttcagttataagatgattgtttcacagaagccttaccactctctgcttcatctaagaaaaccaataccaaaaacgccactttaatgctcagccctgcgttgtgtgttttcagatgagttactgttaacaggtaggtttgtgtaggccttgctgggcactctgtacaattagttgcttattacgtatgattactcacagcgatctattgttccatataaccaaaaagcatggtttattcattgaaacacggttgacctgaactcgtgccttaggaattaatgcccccttatggaacctgcctgaattgcacctgcgggtggaggctccggctgtgaagtcactgaacagaacgtcgctgatggagaaagggctcccgcagaaggaacggcctgtaccgtgcgctccggcacaatcgcgtctcttgtgtctcactcacggaaagaaacaacctgaaggccatcccgtcggtctgcacgtaaccgtgaagacgtgtggccgcgtcccacctgcggctgggtaccctgcacccggcactgtaggagtcacgtgcagcctttctcaggggactgtcattgaaaaggaaacgtttgatgtctgtgtcagctgtctttgtagttaggaaatagatccaataaagccgtatttttttgctggaca

SEQ ID NO: 2856 - DNA, 5030 bp, Homo sapiens
ggcgggcgctcggcgactcgtccccggggccccgcgcgggcccgggcagcaggggcgtgatgtcacggcagggagggggcgcgggagccgccgggccggcggggaggcgggggaggtgttttccagctttaaaaaggcaggaggcagagcgcggccctgcgtcagagcgagactcagaggctccgaactcgccggcggagtcgccgcgccagatcccagcagcagggcgcgggcaccggggcgcgggcagggctcggagccaccgcgcaggtcctagggccgcggccgggccccgccacgcgcgcacacgcccctcgatgactttcctccggggcgcgcggcgctgagcccggggcgagggctgtcttcccggagacccgaccccggcagcgcggggcggccgcttctcctgtgcctccgcccgccgctccactccccgccgccgccgcgcggatgccaagcaccagctttccagtcccttccaagtttccacttggccctgcggctgcggtcttcgggagaggagaaactttggggcccgcgccgcgcgccggcggcaccatgaagtcagcggaggaagaacactatggctatgcatcctccaacgtcagccccgccctgccgctccccacggcgcactccaccctgccggccccgtgccacaaccttcagacctccacaccgggcatcatcccgccggcggatcacccctcggggtacggagcagctttggacggtgggcccgcgggctacttcctctcctccggccacaccaggcctgatggggcccctgccctggagagtcctcgcatcgagataacctcgtgcttgggcctgtaccacaacaataaccagtttttccacgatgtggaggtggaagacgtcctccctagctccaaacggtccccctccacggccacgctgagtctgcccagcctggaggcctacagagacccctcgtgcctgagcccggccagcagcctgtcctcccggagctgcaactcagaggcctcctcctacgagtccaactactcgtacccgtacgcgtccccccagacgtcgccatggcagtctccctgcgtgtctcccaagaccacggaccccgaggagggctttccccgcgggctgggggcctgcacactgctgggttccccgcggcactccccctccacctcgccccgcgccagcgtcactgaggagagctggctgggtgcccgctcctccagacccgcgtccccttgcaacaagaggaagtacagcctcaacggccggcagccgccctactcaccccaccactcgcccacgccgtccccgcacggctccccgcgggtcagcgtgaccgacgactcgtggttgggcaacaccacccagtacaccagctcggccatcgtggccgccatcaacgcgctgaccaccgacagcagcctggacctgggagatggcgtccctgtcaagtcccgcaagaccaccctggagcagccgccctcagtggcgctcaaggtggagcccgtcggggaggacctgggcagccccccgcccccggccgacttcgcgcccgaagactactcctctttccagcacatcaggaagggcggcttctgcgaccagtacctggcggtgccgcagcacccctaccagtgggcgaagcccaagcccctgtcccctacgtcctacatgagcccgaccctgcccgccctggactggcagctgccgtcccactcaggcccgtatgagcttcggattgaggtgcagcccaagtcccaccaccgagcccactacgagacggagggcagccggggggccgtgaaggcgtcggccggaggacaccccatcgtgcagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctcccagcgctcagctcaggagctgcctctggtggagaagcagagcacggacagctatccggtcgtgggcgggaagaagatggtcctgtctggccacaacttcctgcaggactccaaggtcattttcgtggagaaagccccagatggccaccatgtctgggagatggaagcgaaaactgaccgggacctgtgcaagccgaattctctggtggttgagatcccgccatttcggaatcagaggataaccagccccgttcacgtcagtttctacgtctgcaacgggaagagaaagcgaagccagtaccagcgtttcacctaccttcccgccaacgttccaattataaaaacagaacccactgatgattatgagcctgctccaacctgtggaccggtgagccaggggttaagtcctctcccaagaccatactacagccagcagctcgcgatgccacccgaccccagctcctgcctcgtggccggcttcccgccctgtccgcagagaagcaccctgatgccagcggcccctggcgtgagccccaagctccacgacctttctcccgctgcctacaccaagggcgttgccagcccgggccactgtcacctcggactcccgcagccggccggagaggcccccgccgtccaggacgtgcccaggccagtggccacgcaccccggctcgcccgggcagccacccccggccctgctgccacagcaggtgagtgcgcctccaagcagtagctgcccccctggtctcgaacactcgctctgccccagcagcccctctcctccactcccgcctgccacccaagagccgacctgcctgcagccctgcagcccagcgtgcccgcccgccacgggccgcccgcagcacctgccgtccacggtccgcagggacgagtctccgactgccgggccacggctgctgccagaggtgcatgaggacggtagtcctaatttggcccctattcctgtaacggtcaagcgagagcctgaagagttggaccagttgtacctggatgacgtaaatgaaataatacgaaatgacctctccagcacgagcacccactcctagttgccacattggagcactcagttcagcaggggtatgctgacttcagcagacaaagacttttgaataaataaactgaactcacacctggtaccactcagaacctccaactgactgaatgccaggagctgaacattaatatgtgcaaagattggctctccaacaagaaggaaagcagggaggaagggagaccactgtgtcacctggaggagaagtcatctcatgacaacagaagggaggtggccgggctgagcacgggagacccaccgtgcaggggcctttcatgggaacggcccacacgcagtttgaccccacgcccagcccttctggcacccctggggttcaatactggaagtgccttatttaaccagaccatcagggcatcatagaattgagcattgaatttgctactgtaggagtatttttaggagcagaaactgcaaacacatttcattgtgaggttttaccctctgtatgaatgaagagaacgctggaaggctgcgagaggactctagtatgagtctccaacatttggaacgtttcctgggctgtcacgtacactcctgctgccttacacagtgcattttagaatcttccagtctgtcatctcagctcttttgtaacatgcttcccttgtctgcgcggttgaaaccgtaggcttgttcatagtcgcatgctcgcatctttgtttttaatctggcttcgaacatagcacaagtaacttgaatagcacatcaataggttactggacaaaagcagaaaaacctgttacaggatagcctgcatttgcatgtgtgtacatatctaggcatctatttatgtataaataataacagagccgacgtgtcctcgcccaggagggcttccctgtcagcaataaccggcatccgttttggaacctgcgtctggggctccagtcgctgctcttgctggcgtccatcgccgcctcggacggccgtgcattttctcgtctcacgcagttcgaggaggaccctagaaagccaggagctgtgattgacagtagctgtaggttaccagacggcaacattagaaagtgattgtaaataacatgcaacctaagtgtaatatatttgttcagttataagatgattgtttcacagaagccttaccactctctgcttcatctaagaaaaccaataccaaaaacgccactttaatgctcagccctgcgttgtgtgttttcagatgagttactgttaacaggtaggtttgtgtaggccttgctgggcactctgtacaattagttgcttattacgtatgattactcacagcgatctattgttccatataaccaaaaagcatggtttattcattgaaacacggttgacctgaactcgtgccttaggaattaatgcccccttatggaacctgcctgaattgcacctgcgggtggaggctccggctgtgaagtcactgaacagaacgtcgctgatggagaaagggctcccgcagaaggaacggcctgtaccgtgcgctccggcacaatcgcgtctcttgtgtctcactcacggaaagaaacaacctgaaggccatcccgtcggtctgcacgtaaccgtgaagacgtgtggccgcgtcccacctgcggctgggtaccctgcacccggcactgtaggagtcacgtgcagcctttctcaggggactgtcattgaaaaggaaacgtttgatgtctgtgtcagctgtctttgtagttaggaaatagatccaataaagccgtatttttttgctgg

SEQ ID NO: 2857 - DNA, 4604 bp, Homo sapiens
gccgggagaaccgaacccctggcggccgcgaccccggctcccgccccggccccggcccgacccgccatgacggggctggaggaccaggagttcgacttcgagttcctcttcgagtttaaccagcgcgacgagggcgccgccgcggccgccccagaacactatggctatgcatcctccaacgtcagccccgccctgccgctccccacggcgcactccaccctgccggccccgtgccacaaccttcagacctccacaccgggcatcatcccgccggcggatcacccctcggggtacggagcagctttggacggtgggcccgcgggctacttcctctcctccggccacaccaggcctgatggggcccctgccctggagagtcctcgcatcgagataacctcgtgcttgggcctgtaccacaacaataaccagtttttccacgatgtggaggtggaagacgtcctccctagctccaaacggtccccctccacggccacgctgagtctgcccagcctggaggcctacagagacccctcgtgcctgagcccggccagcagcctgtcctcccggagctgcaactcagaggcctcctcctacgagtccaactactcgtacccgtacgcgtccccccagacgtcgccatggcagtctccctgcgtgtctcccaagaccacggaccccgaggagggctttccccgcgggctgggggcctgcacactgctgggttccccgcggcactccccctccacctcgccccgcgccagcgtcactgaggagagctggctgggtgcccgctcctccagacccgcgtccccttgcaacaagaggaagtacagcctcaacggccggcagccgccctactcaccccaccactcgcccacgccgtccccgcacggctccccgcgggtcagcgtgaccgacgactcgtggttgggcaacaccacccagtacaccagctcggccatcgtggccgccatcaacgcgctgaccaccgacagcagcctggacctgggagatggcgtccctgtcaagtcccgcaagaccaccctggagcagccgccctcagtggcgctcaaggtggagcccgtcggggaggacctgggcagccccccgcccccggccgacttcgcgcccgaagactactcctctttccagcacatcaggaagggcggcttctgcgaccagtacctggcggtgccgcagcacccctaccagtgggcgaagcccaagcccctgtcccctacgtcctacatgagcccgaccctgcccgccctggactggcagctgccgtcccactcaggcccgtatgagcttcggattgaggtgcagcccaagtcccaccaccgagcccactacgagacggagggcagccggggggccgtgaaggcgtcggccggaggacaccccatcgtgcagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctcccagcgctcagctcaggagctgcctctggtggagaagcagagcacggacagctatccggtcgtgggcgggaagaagatggtcctgtctggccacaacttcctgcaggactccaaggtcattttcgtggagaaagccccagatggccaccatgtctgggagatggaagcgaaaactgaccgggacctgtgcaagccgaattctctggtggttgagatcccgccatttcggaatcagaggataaccagccccgttcacgtcagtttctacgtctgcaacgggaagagaaagcgaagccagtaccagcgtttcacctaccttcccgccaacgttccaattataaaaacagaacccactgatgattatgagcctgctccaacctgtggaccggtgagccaggggttaagtcctctcccaagaccatactacagccagcagctcgcgatgccacccgaccccagctcctgcctcgtggccggcttcccgccctgtccgcagagaagcaccctgatgccagcggcccctggcgtgagccccaagctccacgacctttctcccgctgcctacaccaagggcgttgccagcccgggccactgtcacctcggactcccgcagccggccggagaggcccccgccgtccaggacgtgcccaggccagtggccacgcaccccggctcgcccgggcagccacccccggccctgctgccacagcaggtgagtgcgcctccaagcagtagctgcccccctggtctcgaacactcgctctgccccagcagcccctctcctccactcccgcctgccacccaagagccgacctgcctgcagccctgcagcccagcgtgcccgcccgccacgggccgcccgcagcacctgccgtccacggtccgcagggacgagtctccgactgccgggccacggctgctgccagaggtgcatgaggacggtagtcctaatttggcccctattcctgtaacggtcaagcgagagcctgaagagttggaccagttgtacctggatgacgtaaatgaaataatacgaaatgacctctccagcacgagcacccactcctagttgccacattggagcactcagttcagcaggggtatgctgacttcagcagacaaagacttttgaataaataaactgaactcacacctggtaccactcagaacctccaactgactgaatgccaggagctgaacattaatatgtgcaaagattggctctccaacaagaaggaaagcagggaggaagggagaccactgtgtcacctggaggagaagtcatctcatgacaacagaagggaggtggccgggctgagcacgggagacccaccgtgcaggggcctttcatgggaacggcccacacgcagtttgaccccacgcccagcccttctggcacccctggggttcaatactggaagtgccttatttaaccagaccatcagggcatcatagaattgagcattgaatttgctactgtaggagtatttttaggagcagaaactgcaaacacatttcattgtgaggttttaccctctgtatgaatgaagagaacgctggaaggctgcgagaggactctagtatgagtctccaacatttggaacgtttcctgggctgtcacgtacactcctgctgccttacacagtgcattttagaatcttccagtctgtcatctcagctcttttgtaacatgcttcccttgtctgcgcggttgaaaccgtaggcttgttcatagtcgcatgctcgcatctttgtttttaatctggcttcgaacatagcacaagtaacttgaatagcacatcaataggttactggacaaaagcagaaaaacctgttacaggatagcctgcatttgcatgtgtgtacatatctaggcatctatttatgtataaataataacagagccgacgtgtcctcgcccaggagggcttccctgtcagcaataaccggcatccgttttggaacctgcgtctggggctccagtcgctgctcttgctggcgtccatcgccgcctcggacggccgtgcattttctcgtctcacgcagttcgaggaggaccctagaaagccaggagctgtgattgacagtagctgtaggttaccagacggcaacattagaaagtgattgtaaataacatgcaacctaagtgtaatatatttgttcagttataagatgattgtttcacagaagccttaccactctctgcttcatctaagaaaaccaataccaaaaacgccactttaatgctcagccctgcgttgtgtgttttcagatgagttactgttaacaggtaggtttgtgtaggccttgctgggcactctgtacaattagttgcttattacgtatgattactcacagcgatctattgttccatataaccaaaaagcatggtttattcattgaaacacggttgacctgaactcgtgccttaggaattaatgcccccttatggaacctgcctgaattgcacctgcgggtggaggctccggctgtgaagtcactgaacagaacgtcgctgatggagaaagggctcccgcagaaggaacggcctgtaccgtgcgctccggcacaatcgcgtctcttgtgtctcactcacggaaagaaacaacctgaaggccatcccgtcggtctgcacgtaaccgtgaagacgtgtggccgcgtcccacctgcggctgggtaccctgcacccggcactgtaggagtcacgtgcagcctttctcaggggactgtcattgaaaaggaaacgtttgatgtctgtgtcagctgtctttgtagttaggaaatagatccaataaagccgtatttttttgctgg

SEQ ID NO: 2858 - DNA, 3453 bp, Homo sapiens
ctcagaggctccgaactcgccggcggagtcgccgcgccagatcccagcagcagggcgcgggcaccggggcgcgggcagggctcggagccaccgcgcaggtcctagggccgcggccgggccccgccacgcgcgcacacgcccctcgatgactttcctccggggcgcgcggcgctgagcccggggcgagggctgtcttcccggagacccgaccccggcagcgcggggcggccgcttctcctgtgcctccgcccgccgctccactccccgccgccgccgcgcggatgccaagcaccagctttccagtcccttccaagtttccacttggccctgcggctgcggtcttcgggagaggagaaactttggggcccgcgccgcgcgccggcggcaccatgaagtcagcggaggaagcccgaccctgcccgccctggactggcagctgccgtcccactcaggcccgtatgagcttcggattgaggtgcagcccaagtcccaccaccgagcccactacgagacggagggcagccggggggccgtgaaggcgtcggccggaggacaccccatcgtgcagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctcccagcgctcagctcaggagctgcctctggtggagaagcagagcacggacagctatccggtcgtgggcgggaagaagatggtcctgtctggccacaacttcctgcaggactccaaggtcattttcgtggagaaagccccagatggccaccatgtctgggagatggaagcgaaaactgaccgggacctgtgcaagccgaattctctggtggttgagatcccgccatttcggaatcagaggataaccagccccgttcacgtcagtttctacgtctgcaacgggaagagaaagcgaagccagtaccagcgtttcacctaccttcccgccaacgttccaattataaaaacagaacccactgatgattatgagcctgctccaacctgtggaccggtgagccaggggttaagtcctctcccaagaccatactacagccagcagctcgcgatgccacccgaccccagctcctgcctcgtggccggcttcccgccctgtccgcagagaagcaccctgatgccagcggcccctggcgtgagccccaagctccacgacctttctcccgctgcctacaccaagggcgttgccagcccgggccactgtcacctcggactcccgcagccggccggagaggcccccgccgtccaggacgtgcccaggccagtggccacgcaccccggctcgcccgggcagccacccccggccctgctgccacagcagtaaatgaaataatacgaaatgacctctccagcacgagcacccactcctagttgccacattggagcactcagttcagcaggggtatgctgacttcagcagacaaagacttttgaataaataaactgaactcacacctggtaccactcagaacctccaactgactgaatgccaggagctgaacattaatatgtgcaaagattggctctccaacaagaaggaaagcagggaggaagggagaccactgtgtcacctggaggagaagtcatctcatgacaacagaagggaggtggccgggctgagcacgggagacccaccgtgcaggggcctttcatgggaacggcccacacgcagtttgaccccacgcccagcccttctggcacccctggggttcaatactggaagtgccttatttaaccagaccatcagggcatcatagaattgagcattgaatttgctactgtaggagtatttttaggagcagaaactgcaaacacatttcattgtgaggttttaccctctgtatgaatgaagagaacgctggaaggctgcgagaggactctagtatgagtctccaacatttggaacgtttcctgggctgtcacgtacactcctgctgccttacacagtgcattttagaatcttccagtctgtcatctcagctcttttgtaacatgcttcccttgtctgcgcggttgaaaccgtaggcttgttcatagtcgcatgctcgcatctttgtttttaatctggcttcgaacatagcacaagtaacttgaatagcacatcaataggttactggacaaaagcagaaaaacctgttacaggatagcctgcatttgcatgtgtgtacatatctaggcatctatttatgtataaataataacagagccgacgtgtcctcgcccaggagggcttccctgtcagcaataaccggcatccgttttggaacctgcgtctggggctccagtcgctgctcttgctggcgtccatcgccgcctcggacggccgtgcattttctcgtctcacgcagttcgaggaggaccctagaaagccaggagctgtgattgacagtagctgtaggttaccagacggcaacattagaaagtgattgtaaataacatgcaacctaagtgtaatatatttgttcagttataagatgattgtttcacagaagccttaccactctctgcttcatctaagaaaaccaataccaaaaacgccactttaatgctcagccctgcgttgtgtgttttcagatgagttactgttaacaggtaggtttgtgtaggccttgctgggcactctgtacaattagttgcttattacgtatgattactcacagcgatctattgttccatataaccaaaaagcatggtttattcattgaaacacggttgacctgaactcgtgccttaggaattaatgcccccttatggaacctgcctgaattgcacctgcgggtggaggctccggctgtgaagtcactgaacagaacgtcgctgatggagaaagggctcccgcagaaggaacggcctgtaccgtgcgctccggcacaatcgcgtctcttgtgtctcactcacggaaagaaacaacctgaaggccatcccgtcggtctgcacgtaaccgtgaagacgtgtggccgcgtcccacctgcggctgggtaccctgcacccggcactgtaggagtcacgtgcagcctttctcaggggactgtcattgaaaaggaaacgtttgatgtctgtgtcagctgtctttgtagttaggaaatagatccaataaagccgtatttttttgctgga

SEQ ID NO: 2859 - DNA, 4469 bp, Homo sapiens
atgaagagcggaaccctagaacactatggctatgcatcctccaacgtcagccccgccctgccgctccccacggcgcactccaccctgccggccccgtgccacaaccttcagacctccacaccgggcatcatcccgccggcggatcacccctcggggtacggagcagctttggacggtgggcccgcgggctacttcctctcctccggccacaccaggcctgatggggcccctgccctggagagtcctcgcatcgagataacctcgtgcttgggcctgtaccacaacaataaccagtttttccacgatgtggaggtggaagacgtcctccctagctccaaacggtccccctccacggccacgctgagtctgcccagcctggaggcctacagagacccctcgtgcctgagcccggccagcagcctgtcctcccggagctgcaactcagaggcctcctcctacgagtccaactactcgtacccgtacgcgtccccccagacgtcgccatggcagtctccctgcgtgtctcccaagaccacggaccccgaggagggctttccccgcgggctgggggcctgcacactgctgggttccccgcggcactccccctccacctcgccccgcgccagcgtcactgaggagagctggctgggtgcccgctcctccagacccgcgtccccttgcaacaagaggaagtacagcctcaacggccggcagccgccctactcaccccaccactcgcccacgccgtccccgcacggctccccgcgggtcagcgtgaccgacgactcgtggttgggcaacaccacccagtacaccagctcggccatcgtggccgccatcaacgcgctgaccaccgacagcagcctggacctgggagatggcgtccctgtcaagtcccgcaagaccaccctggagcagccgccctcagtggcgctcaaggtggagcccgtcggggaggacctgggcagccccccgcccccggccgacttcgcgcccgaagactactcctctttccagcacatcaggaagggcggcttctgcgaccagtacctggcggtgccgcagcacccctaccagtgggcgaagcccaagcccctgtcccctacgtcctacatgagcccgaccctgcccgccctggactggcagctgccgtcccactcaggcccgtatgagcttcggattgaggtgcagcccaagtcccaccaccgagcccactacgagacggagggcagccggggggccgtgaaggcgtcggccggaggacaccccatcgtgcagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctcccagcgctcagctcaggagctgcctctggtggagaagcagagcacggacagctatccggtcgtgggcgggaagaagatggtcctgtctggccacaacttcctgcaggactccaaggtcattttcgtggagaaagccccagatggccaccatgtctgggagatggaagcgaaaactgaccgggacctgtgcaagccgaattctctggtggttgagatcccgccatttcggaatcagaggataaccagccccgttcacgtcagtttctacgtctgcaacgggaagagaaagcgaagccagtaccagcgtttcacctaccttcccgccaacgttccaattataaaaacagaacccactgatgattatgagcctgctccaacctgtggaccggtgagccaggggttaagtcctctcccaagaccatactacagccagcagctcgcgatgccacccgaccccagctcctgcctcgtggccggcttcccgccctgtccgcagagaagcaccctgatgccagcggcccctggcgtgagccccaagctccacgacctttctcccgctgcctacaccaagggcgttgccagcccgggccactgtcacctcggactcccgcagccggccggagaggcccccgccgtccaggacgtgcccaggccagtggccacgcaccccggctcgcccgggcagccacccccggccctgctgccacagcaggtgagtgcgcctccaagcagtagctgcccccctggtctcgaacactcgctctgccccagcagcccctctcctccactcccgcctgccacccaagagccgacctgcctgcagccctgcagcccagcgtgcccgcccgccacgggccgcccgcagcacctgccgtccacggtccgcagggacgagtctccgactgccgggccacggctgctgccagaggtgcatgaggacggtagtcctaatttggcccctattcctgtaacggtcaagcgagagcctgaagagttggaccagttgtacctggatgacgtaaatgaaataatacgaaatgacctctccagcacgagcacccactcctagttgccacattggagcactcagttcagcaggggtatgctgacttcagcagacaaagacttttgaataaataaactgaactcacacctggtaccactcagaacctccaactgactgaatgccaggagctgaacattaatatgtgcaaagattggctctccaacaagaaggaaagcagggaggaagggagaccactgtgtcacctggaggagaagtcatctcatgacaacagaagggaggtggccgggctgagcacgggagacccaccgtgcaggggcctttcatgggaacggcccacacgcagtttgaccccacgcccagcccttctggcacccctggggttcaatactggaagtgccttatttaaccagaccatcagggcatcatagaattgagcattgaatttgctactgtaggagtatttttaggagcagaaactgcaaacacatttcattgtgaggttttaccctctgtatgaatgaagagaacgctggaaggctgcgagaggactctagtatgagtctccaacatttggaacgtttcctgggctgtcacgtacactcctgctgccttacacagtgcattttagaatcttccagtctgtcatctcagctcttttgtaacatgcttcccttgtctgcgcggttgaaaccgtaggcttgttcatagtcgcatgctcgcatctttgtttttaatctggcttcgaacatagcacaagtaacttgaatagcacatcaataggttactggacaaaagcagaaaaacctgttacaggatagcctgcatttgcatgtgtgtacatatctaggcatctatttatgtataaataataacagagccgacgtgtcctcgcccaggagggcttccctgtcagcaataaccggcatccgttttggaacctgcgtctggggctccagtcgctgctcttgctggcgtccatcgccgcctcggacggccgtgcattttctcgtctcacgcagttcgaggaggaccctagaaagccaggagctgtgattgacagtagctgtaggttaccagacggcaacattagaaagtgattgtaaataacatgcaacctaagtgtaatatatttgttcagttataagatgattgtttcacagaagccttaccactctctgcttcatctaagaaaaccaataccaaaaacgccactttaatgctcagccctgcgttgtgtgttttcagatgagttactgttaacaggtaggtttgtgtaggccttgctgggcactctgtacaattagttgcttattacgtatgattactcacagcgatctattgttccatataaccaaaaagcatggtttattcattgaaacacggttgacctgaactcgtgccttaggaattaatgcccccttatggaacctgcctgaattgcacctgcgggtggaggctccggctgtgaagtcactgaacagaacgtcgctgatggagaaagggctcccgcagaaggaacggcctgtaccgtgcgctccggcacaatcgcgtctcttgtgtctcactcacggaaagaaacaacctgaaggccatcccgtcggtctgcacgtaaccgtgaagacgtgtggccgcgtcccacctgcggctgggtaccctgcacccggcactgtaggagtcacgtgcagcctttctcaggggactgtcattgaaaaggaaacgtttgatgtctgtgtcagctgtctttgtagttaggaaatagatccaataaagccgtatttttttgctgg

SEQ ID NO: 2860 - DNA, 2799 bp, Homo sapiens
ccgaacccctggcggccgcgaccccggctcccgccccggccccggcccgacccgccatgacggggctggaggaccaggagttcgacttcgagttcctcttcgagtttaaccagcgcgacgagggcgccgccgcggccgccccagaacactatggctatgcatcctccaacgtcagccccgccctgccgctccccacggcgcactccaccctgccggccccgtgccacaaccttcagacctccacaccgggcatcatcccgccggcggatcacccctcggggtacggagcagctttggacggtgggcccgcgggctacttcctctcctccggccacaccaggcctgatggggcccctgccctggagagtcctcgcatcgagataacctcgtgcttgggcctgtaccacaacaataaccagtttttccacgatgtggaggtggaagacgtcctccctagctccaaacggtccccctccacggccacgctgagtctgcccagcctggaggcctacagagacccctcgtgcctgagcccggccagcagcctgtcctcccggagctgcaactcagaggcctcctcctacgagtccaactactcgtacccgtacgcgtccccccagacgtcgccatggcagtctccctgcgtgtctcccaagaccacggaccccgaggagggctttccccgcgggctgggggcctgcacactgctgggttccccgcggcactccccctccacctcgccccgcgccagcgtcactgaggagagctggctgggtgcccgctcctccagacccgcgtccccttgcaacaagaggaagtacagcctcaacggccggcagccgccctactcaccccaccactcgcccacgccgtccccgcacggctccccgcgggtcagcgtgaccgacgactcgtggttgggcaacaccacccagtacaccagctcggccatcgtggccgccatcaacgcgctgaccaccgacagcagcctggacctgggagatggcgtccctgtcaagtcccgcaagaccaccctggagcagccgccctcagtggcgctcaaggtggagcccgtcggggaggacctgggcagccccccgcccccggccgacttcgcgcccgaagactactcctctttccagcacatcaggaagggcggcttctgcgaccagtacctggcggtgccgcagcacccctaccagtgggcgaagcccaagcccctgtcccctacgtcctacatgagcccgaccctgcccgccctggactggcagctgccgtcccactcaggcccgtatgagcttcggattgaggtgcagcccaagtcccaccaccgagcccactacgagacggagggcagccggggggccgtgaaggcgtcggccggaggacaccccatcgtgcagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctcccagcgctcagctcaggagctgcctctggtggagaagcagagcacggacagctatccggtcgtgggcgggaagaagatggtcctgtctggccacaacttcctgcaggactccaaggtcattttcgtggagaaagccccagatggccaccatgtctgggagatggaagcgaaaactgaccgggacctgtgcaagccgaattctctggtggttgagatcccgccatttcggaatcagaggataaccagccccgttcacgtcagtttctacgtctgcaacgggaagagaaagcgaagccagtaccagcgtttcacctaccttcccgccaacgttccaattataaaaacagaacccactgatgattatgagcctgctccaacctgtggaccggtgagccaggggttaagtcctctcccaagaccatactacagccagcagctcgcgatgccacccgaccccagctcctgcctcgtggccggcttcccgccctgtccgcagagaagcaccctgatgccagcggcccctggcgtgagccccaagctccacgacctttctcccgctgcctacaccaagggcgttgccagcccgggccactgtcacctcggactcccgcagccggccggagaggcccccgccgtccaggacgtgcccaggccagtggccacgcaccccggctcgcccgggcagccacccccggccctgctgccacagcaggtgagtgcgcctccaagcagtagctgcccccctggtctcgaacactcgctctgccccagcagcccctctcctccactcccgcctgccacccaagagccgacctgcctgcagccctgcagcccagcgtgcccgcccgccacgggccgcccgcagcacctgccgtccacggtccgcagggacgagtctccgactgccgggccacggctgctgccagaggtgcatgaggacggtagtcctaatttggcccctattcctgtaacggtcaagcgagagcctgaagagttggaccagttgtacctggatgacg

SEQ ID NO: 2861 - DNA, 2142 bp, Homo sapiens
atgccaagcaccagctttccagtcccttccaagtttccacttggccctgcggctgcggtcttcgggagaggagaaactttggggcccgcgccgcgcgccggcggcaccatgaagtcagcggaggaagaacactatggctatgcatcctccaacgtcagccccgccctgccgctccccacggcgcactccaccctgccggccccgtgccacaaccttcagacctccacaccgggcatcatcccgccggcggatcacccctcggggtacggagcagctttggacggtgggcccgcgggctacttcctctcctccggccacaccaggcctgatggggcccctgccctggagagtcctcgcatcgagataacctcgtgcttgggcctgtaccacaacaataaccagtttttccacgatgtggaggtggaagacgtcctccctagctccaaacggtccccctccacggccacgctgagtctgcccagcctggaggcctacagagacccctcgtgcctgagcccggccagcagcctgtcctcccggagctgcaactcagaggcctcctcctacgagtccaactactcgtacccgtacgcgtccccccagacgtcgccatggcagtctccctgcgtgtctcccaagaccacggaccccgaggagggctttccccgcgggctgggggcctgcacactgctgggttccccgcggcactccccctccacctcgccccgcgccagcgtcactgaggagagctggctgggtgcccgctcctccagacccgcgtccccttgcaacaagaggaagtacagcctcaacggccggcagccgccctactcaccccaccactcgcccacgccgtccccgcacggctccccgcgggtcagcgtgaccgacgactcgtggttgggcaacaccacccagtacaccagctcggccatcgtggccgccatcaacgcgctgaccaccgacagcagcctggacctgggagatggcgtccctgtcaagtcccgcaagaccaccctggagcagccgccctcagtggcgctcaaggtggagcccgtcggggaggacctgggcagccccccgcccccggccgacttcgcgcccgaagactactcctctttccagcacatcaggaagggcggcttctgcgaccagtacctggcggtgccgcagcacccctaccagtgggcgaagcccaagcccctgtcccctacgtcctacatgagcccgaccctgcccgccctggactggcagctgccgtcccactcaggcccgtatgagcttcggattgaggtgcagcccaagtcccaccaccgagcccactacgagacggagggcagccggggggccgtgaaggcgtcggccggaggacaccccatcgtgcagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctcccagcgctcagctcaggagctgcctctggtggagaagcagagcacggacagctatccggtcgtgggcgggaagaagatggtcctgtctggccacaacttcctgcaggactccaaggtcattttcgtggagaaagccccagatggccaccatgtctgggagatggaagcgaaaactgaccgggacctgtgcaagccgaattctctggtggttgagatcccgccatttcggaatcagaggataaccagccccgttcacgtcagtttctacgtctgcaacgggaagagaaagcgaagccagtaccagcgtttcacctaccttcccgccaacgtaaatgaaataatacgaaatgacctctccagcacgagcacccactcctag

SEQ ID NO: 2862 - DNA, 1919 bp, Homo sapiens
gagaaccgaacccctggcggccgcgaccccggctcccgccccggccccggcccgacccgccatgacggggctggaggaccaggagttcgacttcgagttcctcttcgagtttaaccagcgcgacgagggcgccgccgcggccgccccagcccgaccctgcccgccctggactggcagctgccgtcccactcaggcccgtatgagcttcggattgaggtgcagcccaagtcccaccaccgagcccactacgagacggagggcagccggggggccgtgaaggcgtcggccggaggacaccccatcgtgcagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctcccagcgctcagctcaggagctgcctctggtggagaagcagagcacggacagctatccggtcgtgggcgggaagaagatggtcctgtctggccacaacttcctgcaggactccaaggtcattttcgtggagaaagccccagatggccaccatgtctgggagatggaagcgaaaactgaccgggacctgtgcaagccgaattctctggtggttgagatcccgccatttcggaatcagaggataaccagccccgttcacgtcagtttctacgtctgcaacgggaagagaaagcgaagccagtaccagcgtttcacctaccttcccgccaacgttccaattataaaaacagaacccactgatgattatgagcctgctccaacctgtggaccggtgagccaggggttaagtcctctcccaagaccatactacagccagcagctcgcgatgccacccgaccccagctcctgcctcgtggccggcttcccgccctgtccgcagagaagcaccctgatgccagcggcccctggcgtgagccccaagctccacgacctttctcccgctgcctacaccaagggcgttgccagcccgggccactgtcacctcggactcccgcagccggccggagaggcccccgccgtccaggacgtgcccaggccagtggccacgcaccccggctcgcccgggcagccacccccggccctgctgccacagcaggtgagtgcgcctccaagcagtagctgcccccctggtctcgaacactcgctctgccccagcagcccctctcctccactcccgcctgccacccaagagccgacctgcctgcagccctgcagcccagcgtgcccgcccgccacgggccgcccgcagcacctgccgtccacggtccgcagggacgagtctccgactgccgggccacggctgctgccagaggtgcatgaggacggtagtcctaatttggcccctattcctgtaacggtcaagcgagagcctgaagagttggaccagttgtacctggatgacgtaaatgaaataatacgaaatgacctctccagcacgagcacccactcctagttgccacattggagcactcagttcagcaggggtatgctgacttcagcagacaaagacttttgaataaataaactgaactcacacctggtaccactcagaacctccaactgactgaatgccaggagctgaacattaatatgtgcaaagattggctctccaacaag

SEQ ID NO: 2863 - DNA, 7525 bp, Homo sapiens
agcaggaagctcgcgccgccgtcgccgccgccgctcagcttccccgggcgcgtccaggacccgctgcgccaggcgcgccgtccccggacccggcgtgcgtccctacgaggaaagggaccccgccgctcgagccgcctccgccagccccactgcgaggggtcccagagccagccgcgcccgccctcgcccccggccccgcagccttcccgccctgcgcgccatgaacgcccccgagcggcagccccaacccgacggcggggacgccccaggccacgagcctgggggcagcccccaagacgagcttgacttctccatcctcttcgactatgagtatttgaatccgaacgaagaagagccgaatgcacataaggtcgccagcccaccctccggacccgcataccccgatgatgtcctggactatggcctcaagccatacagcccccttgctagtctctctggcgagccccccggccgattcggagagccggatagggtagggccgcagaagtttctgagcgcggccaagccagcaggggcctcgggcctgagccctcggatcgagatcactccgtcccacgaactgatccaggcagtggggcccctccgcatgagagacgcgggcctcctggtggagcagccgcccctggccggggtggccgccagcccgaggttcaccctgcccgtgcccggcttcgagggctaccgcgagccgctttgcttgagccccgctagcagcggctcctctgccagcttcatttctgacaccttctccccctacacctcgccctgcgtctcgcccaataacggcgggcccgacgacctgtgtccgcagtttcaaaacatccctgctcattattcccccagaacctcgccaataatgtcacctcgaaccagcctcgccgaggacagctgcctgggccgccactcgcccgtgccccgtccggcctcccgctcctcatcgcctggtgccaagcggaggcattcgtgcgccgaggccttggttgccctgccgcccggagcctcaccccagcgctcccggagcccctcgccgcagccctcatctcacgtggcaccccaggaccacggctccccggctgggtacccccctgtggctggctctgccgtgatcatggatgccctgaacagcctcgccacggactcgccttgtgggatcccccccaagatgtggaagaccagccctgacccctcgccggtgtctgccgccccatccaaggccggcctgcctcgccacatctacccggccgtggagttcctggggccctgcgagcagggcgagaggagaaactcggctccagaatccatcctgctggttccgcccacttggcccaagccgctggtgcctgccattcccatctgcagcatcccagtgactgcatccctccctccacttgagtggccgctgtccagtcagtcaggctcttacgagctgcggatcgaggtgcagcccaagccacatcaccgggcccactatgagacagaaggcagccgaggggctgtcaaagctccaactggaggccaccctgtggttcagctccatggctacatggaaaacaagcctctgggacttcagatcttcattgggacagctgatgagcggatccttaagccgcacgccttctaccaggtgcaccgaatcacggggaaaactgtcaccaccaccagctatgagaagatagtgggcaacaccaaagtcctggagatacccttggagcccaaaaacaacatgagggcaaccatcgactgtgcggggatcttgaagcttagaaacgccgacattgagctgcggaaaggcgagacggacattggaagaaagaacacgcgggtgagactggttttccgagttcacatcccagagtccagtggcagaatcgtctctttacagactgcatctaaccccatcgagtgctcccagcgatctgctcacgagctgcccatggttgaaagacaagacacagacagctgcctggtctatggcggccagcaaatgatcctcacggggcagaactttacatccgagtccaaagttgtgtttactgagaagaccacagatggacagcaaatttgggagatggaagccacggtggataaggacaagagccagcccaacatgctttttgttgagatccctgaatatcggaacaagcatatccgcacacctgtaaaagtgaacttctacgtcatcaatgggaagagaaaacgaagtcagcctcagcactttacctaccacccagtcccagccatcaagacggagcccacggatgaatatgaccccactctgatctgcagccccacccatggaggcctggggagccagccttactacccccagcacccgatggtggccgagtccccctcctgcctcgtggccaccatggctccctgccagcagttccgcacggggctctcatcccctgacgcccgctaccagcaacagaacccagcggccgtactctaccagcggagcaagagcctgagccccagcctgctgggctatcagcagccggccctcatggccgccccgctgtcccttgcggacgctcaccgctctgtgctggtgcacgccggctcccagggccagagctcagccctgctccacccctctccgaccaaccagcaggcctcgcctgtgatccactactcacccaccaaccagcagctgcgctgcggaagccaccaggagttccagcacatcatgtactgcgagaatttcgcaccaggcaccaccagacctggcccgcccccggtcagtcaaggtcagaggctgagcccgggttcctaccccacagtcattcagcagcagaatgccacgagccaaagagccgccaaaaacggacccccggtcagtgaccaaaaggaagtattacctgcgggggtgaccattaaacaggagcagaacttggaccagacctacttggatgatgagctgatagacacacaccttagctggatacaaaacatattatgaaacagaatgactgtgatctttgatccgagaaatcaaagttaaagttaatgaaattatcaggaaggagttttcaggacctcctgccagaaatcagacgtaaaagaagccattatagcaagacaccttctgtatctgacccctcggagccctccacagcccctcaccttctgtctcctttcatgttcatctcccagcccggagtccacacgcggatcaatgtatgggcactaagcggactctcacttaaggagctcgccacctccctctaaacaccagagagaactcttcttttcggtttatgttttaaatcccagagagcatcctggttgatcttaatggtgttccgtccaaatagtaagcacctgctgaccaaaagcacattctacatgagacaggacactggaactctcctgagaacagagtgactggagcttggggggatggacgggggacagaagatgtgggcactgtgattaaaccccagcccttgcgttcgtttttccaggtcacagatacagctcctgtaccttttgaaggcaaggagttctcagagcaaccaaaggaacgtgacccaagagcccagcttacaggctgaagaaacccaaaaccctcgatagagacagaaactgaactgtcagtccttagagctcgcccagtccatgccacaactgggccacagctaaagctttatttttgaattctcattccaaaaccaaactgtcttgcccagacaagatcacctgttaagacttcttggcgttaagttatgacatgtatacgcgtttgttattattattttttctgctttaaaaggctgaccagggcacctagccctggagctgtcttggcgagctgttctttaacccctgcagcacgcagtcctgctaacacaatttccatagacttggggggctgacccaggctgcagagagcaagcacctgtctgctgcagctgtacaacctggatgctttgcaaggttccggcttgctttcttcctagcagccagagtgcttttccgtaaagcggtggagaatctcaagcatgtgcatttaattgaggaatagcagaagggctaaagcaaccaagaaaagaagtgtgggtatttttgttaagtaaaacagcccaagtgcttctggaggtgggtttctaccaagatagaggaaaagggctgaattccctctaagtgggacagccgagctcaggatgtgcttcccagcttcactggttaatttgacctgaacctatttaaagatcccttctgcccctgaagacctatccgcactcaaattctaacatgaagaaatctactcgaatgcatcctttactttgaatgagctctattcggttgcatgttatatgtgatttccttcctcccaactgtttccactgagcgcacccagtctcccctagtcttcctctgtgggtgtgatttttgtgatttttacaaacaaaacccttgaagttcttggcagatgtgtttgtttctgtttgcatgtactgcagataccccaggacaagcgggggattcatttttcagccattcagttgtttcctcaataatccgcagcaaagtgaaaatattcttagcactcagactgtacttagagtgttttctcagtccagtctgtacagtctgtaggcagaaggcctcagaagaaagtcatggccactcagtgcccactgtgggctttgtaagtcctggctctcccgtcaaggttacccagaggtaaaagcttcctgggagtggggccaggtgtgtttggcactccagatagaaggcaaaatgctcagattcgggcctgtgcacttgtatgcaacctgtcggtcgatacctagcatttatttttccctgacaatgaacgacctttccctcacccaccctaagctcaaagagtttagcaaaattctcttttaaataaacagaatgccagtaagaggttgacccctaccatggaacttctgggatgctaaatacttcctcatgaacaaaataagttccttattataagttccttatactagcagcttcacctaaagaattttctctccagcaatattgacttcactggggaaaagccaagagtgtgtggtgagtgatttgttctcactcgacctggctaggactggctaggagctgttttttgtacatgagggaatttgggctttcctcagttatctgaatgttttacccaagtgccttcctgctattgtagcaaagtagctcagcttccttgtccacagggtgaaaaaggactaatgcattttccatcagttttctaactatgttagcaaaaacggcctcctggtagctcaacctcctgtacgcgtgtgtgtgtgtaatacacacacaaataaacccctctgtttttctaagacatcttagctggatattataggaagcactttcataaacaactgtaacaaatcgcaaaggaaagagaaacaaaagcattagatttgagacataaacaggcaagagaaagtgtattaggaactgacagctatcaaggaagttttgtcagttacaaatgctaggaggaaattttgccaagaaggatggctcatgaaatatttccagtacgggaagaggcaataagatcctctaagagaatgagaaagtaggggtgtctaaatggtaaagatgggtgtgttgcacgtgtgttagaaggatctcagttgagtgaaggtttgcactgctacatctaagttaatgtaaatatgtagcactctgacaggtctaccgtgttgctgaatgtagtatatttccaaagtttgcaagtcttcctgtattgtacaaagatgctgctgcttgataatatgtatagcaatccagattagtatgttattaaattttattttcttacctgtatttttatgctttttacctgtcctcaaaatattacacccctgttggaattagatttatatttataaatggtcagaaatctttttaagtgtctctttttacacataggttgatttttttttcttaagagaaatgatgtattcttgaaacatttgttactcattccaggaaacaaaaacccatataataaaacccccactcagagcctgttagtcacctctctagaagatggcatctcaggagaaggaatggctttgtggaagaaggaatcacctttttcttgctcaagaattatgctgacttcagccctgagcctggatctggtcactgagaatcatcaagtgtctagatcctccccccaaaataactaatttagtaggtgattttgattttaaaaaattgacaccaaaaccctgcctgcattgtaatggaattcgaaaagaattcatgttcacagaactcaacgttcaggctaatatttacagaagggaccaaatctaaatcctggtagataactcctgtatgctttatccaaaggacacccacagttttccagcatagatataaccaaggatgaattgattccttcaaagaactgggaggcacggatattgcattttttgtttacatccagtagccaagacgcctcagtgagccagtcttgggcagaggctgtcacatttaggcagattggaagttggtatgttctaattctcactctggactacagtgaggctgaatttatcatgtcaaaaaaaaaaaaaaaaaaagacctttccaagtgctttctattgctcagaattgaaagaatgttttcatttcaagtttacaagaggcatggatggagttgtgacgttcttgacaagctgggctaacctttcccgaacttgtttcccggaggcaaggtgctcggtgacccagcgcatcttaaccttgggtctcctaggctcgaggctagggcattacgtttcgtggaaccaaagcagccaattgcatagcaagtattttcctgcattccaattaaatgcttaagaaaaagcagcatcctataaaattgtgatcataaacatccatttccctcagcttttgtgagtgccttgacttacagccaacatcactgtttaactcagtctgtttaaaaacaaacttttctggtggttgataacagagagttgctccctgagccatcagggtcctgggagctggaagtgaaagggttattaacattctacctttatgcagctgttggctgaccagaataaactccctgctgagttcaagctttgaatggaatggatgcaaatgatgttgtttccattagagcaggtgctcacagcattctgattggcctgagcagaccgaggctatggctgttgggacaagcttagcatcctggacatcttgtcaaagaacctcactcacccctctggcctctacagccctcagaggagagaaaaccaattctccaacaaacaggtctctccaacatggtggtgctggcaggcttaggtttagaaaatcctgactgttaaaggcgtttgaatacatcacattcctatgcaaatgtttttaatctccagtttaatgtagtttatttttcctatatgtaaagtatttttatacggcttgtatcatgatagtttagcaataaaacagttggaagcaacatcta

SEQ ID NO: 2864 - DNA, 1397 bp, Homo sapiens
gactccgccgagccgggagccgggaggcgcgcagctcccgggtcgctccgaggctcctcggccagggcagccccgcgggcacgcggtagagaagacggcgtcccctcggctgctggtcgatacaaacagatccccctttccaaacacgcgccaagtccccgtgccctccagatgcagagagaggctgcgttcagactggggcactgccatcccctccgcatcatggggtctgtggaccaagaacctcgccaataatgtcacctcgaaccagcctcgccgaggacagctgcctgggccgccactcgcccgtgccccgtccggcctcccgctcctcatcgcctggtgccaagcggaggcattcgtgcgccgaggccttggttgccctgccgcccggagcctcaccccagcgctcccggagcccctcgccgcagccctcatctcacgtggcaccccaggaccacggctccccggctgggtacccccctgtggctggctctgccgtgatcatggatgccctgaacagcctcgccacggactcgccttgtgggatcccccccaagatgtggaagaccagccctgacccctcgccggtgtctgccgccccatccaaggccggcctgcctcgccacatctacccggccgtggagttcctggggccctgcgagcagggcgagaggagaaactcggctccagaatccatcctgctggttccgcccacttggcccaagccgctggtgcctgccattcccatctgcagcatcccagtgactgcatccctccctccacttgagtggccgctgtccagtcagtcaggctcttacgagctgcggatcgaggtgcagcccaagccacatcaccgggcccactatgagacagaaggcagccgaggggctgtcaaagctccaactggaggccaccctgtggttcagctccatggctacatggaaaacaagcctctgggacttcagatcttcattgggacagctgatgagcggatccttaagccgcacgccttctaccaggtgcaccgaatcacggggaaaactgtcaccaccaccagctatgagaagatagtgggcaacaccaaagtcctggagatacccttggagccctccacagcccctcaccttctgtctcctttcatgttcatctcccagcccggagtccacacgcggatcaatgtatgggcactaagcggactctcacttaaggagctcgccacctccctctaaacaccagagagaactcttcttttcggtttatgttttaaatcccagagagcatcctggttgatcttaatggtgttccgtccaaatagtaagcacctgctgaccaaaagcacattctacatgagacaggacactggaactctcctgagaacagagtgactggagctt

SEQ ID NO: 2865 - DNA, 7437 bp, Homo sapiens
agcaggaagctcgcgccgccgtcgccgccgccgctcagcttccccgggcgcgtccaggacccgctgcgccaggcgcgccgtccccggacccggcgtgcgtccctacgaggaaagggaccccgccgctcgagccgcctccgccagccccactgcgaggggtcccagagccagccgcgcccgccctcgcccccggccccgcagccttcccgccctgcgcgccatgaacgcccccgagcggcagccccaacccgacggcggggacgccccaggccacgagcctgggggcagcccccaagacgagcttgacttctccatcctcttcgactatgagtatttgaatccgaacgaagaagagccgaatgcacataaggtcgccagcccaccctccggacccgcataccccgatgatgtcctggactatggcctcaagccatacagcccccttgctagtctctctggcgagccccccggccgattcggagagccggatagggtagggccgcagaagtttctgagcgcggccaagccagcaggggcctcgggcctgagccctcggatcgagatcactccgtcccacgaactgatccaggcagtggggcccctccgcatgagagacgcgggcctcctggtggagcagccgcccctggccggggtggccgccagcccgaggttcaccctgcccgtgcccggcttcgagggctaccgcgagccgctttgcttgagccccgctagcagcggctcctctgccagcttcatttctgacaccttctccccctacacctcgccctgcgtctcgcccaataacggcgggcccgacgacctgtgtccgcagtttcaaaacatccctgctcattattcccccagaacctcgccaataatgtcacctcgaaccagcctcgccgaggacagctgcctgggccgccactcgcccgtgccccgtccggcctcccgctcctcatcgcctggtgccaagcggaggcattcgtgcgccgaggccttggttgccctgccgcccggagcctcaccccagcgctcccggagcccctcgccgcagccctcatctcacgtggcaccccaggaccacggctccccggctgggtacccccctgtggctggctctgccgtgatcatggatgccctgaacagcctcgccacggactcgccttgtgggatcccccccaagatgtggaagaccagccctgacccctcgccggtgtctgccgccccatccaaggccggcctgcctcgccacatctacccggccgtggagttcctggggccctgcgagcagggcgagaggagaaactcggctccagaatccatcctgctggttccgcccacttggcccaagccgctggtgcctgccattcccatctgcagcatcccagtgactgcatccctccctccacttgagtggccgctgtccagtcagtcaggctcttacgagctgcggatcgaggtgcagcccaagccacatcaccgggcccactatgagacagaaggcagccgaggggctgtcaaagctccaactggaggccaccctgtggttcagctccatggctacatggaaaacaagcctctgggacttcagatcttcattgggacagctgatgagcggatccttaagccgcacgccttctaccaggtgcaccgaatcacggggaaaactgtcaccaccaccagctatgagaagatagtgggcaacaccaaagtcctggagatacccttggagcccaaaaacaacatgagggcaaccatcgactgtgcggggatcttgaagcttagaaacgccgacattgagctgcggaaaggcgagacggacattggaagaaagaacacgcgggtgagactggttttccgagttcacatcccagagtccagtggcagaatcgtctctttacagactgcatctaaccccatcgagtgctcccagcgatctgctcacgagctgcccatggttgaaagacaagacacagacagctgcctggtctatggcggccagcaaatgatcctcacggggcagaactttacatccgagtccaaagttgtgtttactgagaagaccacagatggacagcaaatttgggagatggaagccacggtggataaggacaagagccagcccaacatgctttttgttgagatccctgaatatcggaacaagcatatccgcacacctgtaaaagtgaacttctacgtcatcaatgggaagagaaaacgaagtcagcctcagcactttacctaccacccagtcccagccatcaagacggagcccacggatgaatatgaccccactctgatctgcagccccacccatggaggcctggggagccagccttactacccccagcacccgatggtggccgagtccccctcctgcctcgtggccaccatggctccctgccagcagttccgcacggggctctcatcccctgacgcccgctaccagcaacagaacccagcggccgtactctaccagcggagcaagagcctgagccccagcctgctgggctatcagcagccggccctcatggccgccccgctgtcccttgcggacgctcaccgctctgtgctggtgcacgccggctcccagggccagagctcagccctgctccacccctctccgaccaaccagcaggcctcgcctgtgatccactactcacccaccaaccagcagctgcgctgcggaagccaccaggagttccagcacatcatgtactgcgagaatttcgcaccaggcaccaccagacctggcccgcccccggtcagtcaaggtcagaggctgagcccgggttcctaccccacagtcattcagcagcagaatgccacgagccaaagagccgccaaaaacggacccccggtcagtgaccaaaaggaagtattacctgcgggggtgaccattaaacaggagcagaacttggaccagacctacttggatgatgttaatgaaattatcaggaaggagttttcaggacctcctgccagaaatcagacgtaaaagaagccattatagcaagacaccttctgtatctgacccctcggagccctccacagcccctcaccttctgtctcctttcatgttcatctcccagcccggagtccacacgcggatcaatgtatgggcactaagcggactctcacttaaggagctcgccacctccctctaaacaccagagagaactcttcttttcggtttatgttttaaatcccagagagcatcctggttgatcttaatggtgttccgtccaaatagtaagcacctgctgaccaaaagcacattctacatgagacaggacactggaactctcctgagaacagagtgactggagcttggggggatggacgggggacagaagatgtgggcactgtgattaaaccccagcccttgcgttcgtttttccaggtcacagatacagctcctgtaccttttgaaggcaaggagttctcagagcaaccaaaggaacgtgacccaagagcccagcttacaggctgaagaaacccaaaaccctcgatagagacagaaactgaactgtcagtccttagagctcgcccagtccatgccacaactgggccacagctaaagctttatttttgaattctcattccaaaaccaaactgtcttgcccagacaagatcacctgttaagacttcttggcgttaagttatgacatgtatacgcgtttgttattattattttttctgctttaaaaggctgaccagggcacctagccctggagctgtcttggcgagctgttctttaacccctgcagcacgcagtcctgctaacacaatttccatagacttggggggctgacccaggctgcagagagcaagcacctgtctgctgcagctgtacaacctggatgctttgcaaggttccggcttgctttcttcctagcagccagagtgcttttccgtaaagcggtggagaatctcaagcatgtgcatttaattgaggaatagcagaagggctaaagcaaccaagaaaagaagtgtgggtatttttgttaagtaaaacagcccaagtgcttctggaggtgggtttctaccaagatagaggaaaagggctgaattccctctaagtgggacagccgagctcaggatgtgcttcccagcttcactggttaatttgacctgaacctatttaaagatcccttctgcccctgaagacctatccgcactcaaattctaacatgaagaaatctactcgaatgcatcctttactttgaatgagctctattcggttgcatgttatatgtgatttccttcctcccaactgtttccactgagcgcacccagtctcccctagtcttcctctgtgggtgtgatttttgtgatttttacaaacaaaacccttgaagttcttggcagatgtgtttgtttctgtttgcatgtactgcagataccccaggacaagcgggggattcatttttcagccattcagttgtttcctcaataatccgcagcaaagtgaaaatattcttagcactcagactgtacttagagtgttttctcagtccagtctgtacagtctgtaggcagaaggcctcagaagaaagtcatggccactcagtgcccactgtgggctttgtaagtcctggctctcccgtcaaggttacccagaggtaaaagcttcctgggagtggggccaggtgtgtttggcactccagatagaaggcaaaatgctcagattcgggcctgtgcacttgtatgcaacctgtcggtcgatacctagcatttatttttccctgacaatgaacgacctttccctcacccaccctaagctcaaagagtttagcaaaattctcttttaaataaacagaatgccagtaagaggttgacccctaccatggaacttctgggatgctaaatacttcctcatgaacaaaataagttccttattataagttccttatactagcagcttcacctaaagaattttctctccagcaatattgacttcactggggaaaagccaagagtgtgtggtgagtgatttgttctcactcgacctggctaggactggctaggagctgttttttgtacatgagggaatttgggctttcctcagttatctgaatgttttacccaagtgccttcctgctattgtagcaaagtagctcagcttccttgtccacagggtgaaaaaggactaatgcattttccatcagttttctaactatgttagcaaaaacggcctcctggtagctcaacctcctgtacgcgtgtgtgtgtgtaatacacacacaaataaacccctctgtttttctaagacatcttagctggatattataggaagcactttcataaacaactgtaacaaatcgcaaaggaaagagaaacaaaagcattagatttgagacataaacaggcaagagaaagtgtattaggaactgacagctatcaaggaagttttgtcagttacaaatgctaggaggaaattttgccaagaaggatggctcatgaaatatttccagtacgggaagaggcaataagatcctctaagagaatgagaaagtaggggtgtctaaatggtaaagatgggtgtgttgcacgtgtgttagaaggatctcagttgagtgaaggtttgcactgctacatctaagttaatgtaaatatgtagcactctgacaggtctaccgtgttgctgaatgtagtatatttccaaagtttgcaagtcttcctgtattgtacaaagatgctgctgcttgataatatgtatagcaatccagattagtatgttattaaattttattttcttacctgtatttttatgctttttacctgtcctcaaaatattacacccctgttggaattagatttatatttataaatggtcagaaatctttttaagtgtctctttttacacataggttgatttttttttcttaagagaaatgatgtattcttgaaacatttgttactcattccaggaaacaaaaacccatataataaaacccccactcagagcctgttagtcacctctctagaagatggcatctcaggagaaggaatggctttgtggaagaaggaatcacctttttcttgctcaagaattatgctgacttcagccctgagcctggatctggtcactgagaatcatcaagtgtctagatcctccccccaaaataactaatttagtaggtgattttgattttaaaaaattgacaccaaaaccctgcctgcattgtaatggaattcgaaaagaattcatgttcacagaactcaacgttcaggctaatatttacagaagggaccaaatctaaatcctggtagataactcctgtatgctttatccaaaggacacccacagttttccagcatagatataaccaaggatgaattgattccttcaaagaactgggaggcacggatattgcattttttgtttacatccagtagccaagacgcctcagtgagccagtcttgggcagaggctgtcacatttaggcagattggaagttggtatgttctaattctcactctggactacagtgaggctgaatttatcatgtcaaaaaaaaaaaaaaaaaaagacctttccaagtgctttctattgctcagaattgaaagaatgttttcatttcaagtttacaagaggcatggatggagttgtgacgttcttgacaagctgggctaacctttcccgaacttgtttcccggaggcaaggtgctcggtgacccagcgcatcttaaccttgggtctcctaggctcgaggctagggcattacgtttcgtggaaccaaagcagccaattgcatagcaagtattttcctgcattccaattaaatgcttaagaaaaagcagcatcctataaaattgtgatcataaacatccatttccctcagcttttgtgagtgccttgacttacagccaacatcactgtttaactcagtctgtttaaaaacaaacttttctggtggttgataacagagagttgctccctgagccatcagggtcctgggagctggaagtgaaagggttattaacattctacctttatgcagctgttggctgaccagaataaactccctgctgagttcaagctttgaatggaatggatgcaaatgatgttgtttccattagagcaggtgctcacagcattctgattggcctgagcagaccgaggctatggctgttgggacaagcttagcatcctggacatcttgtcaaagaacctcactcacccctctggcctctacagccctcagaggagagaaaaccaattctccaacaaacaggtctctccaacatggtggtgctggcaggcttaggtttagaaaatcctgactgttaaaggcgtttgaatacatcacattcctatgcaaatgtttttaatctccagtttaatgtagtttatttttcctatatgtaaagtatttttatacggcttgtatcatgatagtttagcaataaaacagttggaagcaacatcta

SEQ ID NO: 2866 - DNA, 2974 bp, Homo sapiens
atgcagagagaggctgcgttcagactggggcactgccatcccctccgcatcatggggtctgtggaccaagaagagccgaatgcacataaggtcgccagcccaccctccggacccgcataccccgatgatgtcctggactatggcctcaagccatacagcccccttgctagtctctctggcgagccccccggccgattcggagagccggatagggtagggccgcagaagtttctgagcgcggccaagccagcaggggcctcgggcctgagccctcggatcgagatcactccgtcccacgaactgatccaggcagtggggcccctccgcatgagagacgcgggcctcctggtggagcagccgcccctggccggggtggccgccagcccgaggttcaccctgcccgtgcccggcttcgagggctaccgcgagccgctttgcttgagccccgctagcagcggctcctctgccagcttcatttctgacaccttctccccctacacctcgccctgcgtctcgcccaataacggcgggcccgacgacctgtgtccgcagtttcaaaacatccctgctcattattcccccagaacctcgccaataatgtcacctcgaaccagcctcgccgaggacagctgcctgggccgccactcgcccgtgccccgtccggcctcccgctcctcatcgcctggtgccaagcggaggcattcgtgcgccgaggccttggttgccctgccgcccggagcctcaccccagcgctcccggagcccctcgccgcagccctcatctcacgtggcaccccaggaccacggctccccggctgggtacccccctgtggctggctctgccgtgatcatggatgccctgaacagcctcgccacggactcgccttgtgggatcccccccaagatgtggaagaccagccctgacccctcgccggtgtctgccgccccatccaaggccggcctgcctcgccacatctacccggccgtggagttcctggggccctgcgagcagggcgagaggagaaactcggctccagaatccatcctgctggttccgcccacttggcccaagccgctggtgcctgccattcccatctgcagcatcccagtgactgcatccctccctccacttgagtggccgctgtccagtcagtcaggctcttacgagctgcggatcgaggtgcagcccaagccacatcaccgggcccactatgagacagaaggcagccgaggggctgtcaaagctccaactggaggccaccctgtggttcagctccatggctacatggaaaacaagcctctgggacttcagatcttcattgggacagctgatgagcggatccttaagccgcacgccttctaccaggtgcaccgaatcacggggaaaactgtcaccaccaccagctatgagaagatagtgggcaacaccaaagtcctggagatacccttggagcccaaaaacaacatgagggcaaccatcgactgtgcggggatcttgaagcttagaaacgccgacattgagctgcggaaaggcgagacggacattggaagaaagaacacgcgggtgagactggttttccgagttcacatcccagagtccagtggcagaatcgtctctttacagactgcatctaaccccatcgagtgctcccagcgatctgctcacgagctgcccatggttgaaagacaagacacagacagctgcctggtctatggcggccagcaaatgatcctcacggggcagaactttacatccgagtccaaagttgtgtttactgagaagaccacagatggacagcaaatttgggagatggaagccacggtggataaggacaagagccagcccaacatgctttttgttgagatccctgaatatcggaacaagcatatccgcacacctgtaaaagtgaacttctacgtcatcaatgggaagagaaaacgaagtcagcctcagcactttacctaccacccagtcccagccatcaagacggagcccacggatgaatatgaccccactctgatctgcagccccacccatggaggcctggggagccagccttactacccccagcacccgatggtggccgagtccccctcctgcctcgtggccaccatggctccctgccagcagttccgcacggggctctcatcccctgacgcccgctaccagcaacagaacccagcggccgtactctaccagcggagcaagagcctgagccccagcctgctgggctatcagcagccggccctcatggccgccccgctgtcccttgcggacgctcaccgctctgtgctggtgcacgccggctcccagggccagagctcagccctgctccacccctctccgaccaaccagcaggcctcgcctgtgatccactactcacccaccaaccagcagctgcgctgcggaagccaccaggagttccagcacatcatgtactgcgagaatttcgcaccaggcaccaccagacctggcccgcccccggtcagtcaaggtcagaggctgagcccgggttcctaccccacagtcattcagcagcagaatgccacgagccaaagagccgccaaaaacggacccccggtcagtgaccaaaaggaagtattacctgcgggggtgaccattaaacaggagcagaacttggaccagacctacttggatgatgagctgatagacacacaccttagctggatacaaaacatattatgaaacagaatgactgtgatctttgatccgagaaatcaaagttaaagttaatgaaattatcaggaaggagttttcaggacctcctgccagaaatcagacgtaaaagaagccattatagcaagacaccttctgtatctgacccctcggagccctccacagcccctcaccttctgtctcctttcatgttcatctcccagcccggagtccacacgcggatcaatgtatgggcactaagcggactctcacttaaggagctcgccacctccctcta

SEQ ID NO: 2867 - DNA, 6144 bp, Homo sapiens
gctgcagcaccctgggccacgccgatgactactgcaaactgtggcgcccacgacgagctcgacttcaaactcgtctttggcgaggacggggcgccggcgccgccgcccccgggctcgcggcctgcagatcttgagccagatgattgtgcatccatttacatctttaatgtagatccacctccatctactttaaccacaccactttgcttaccacatcatggattaccgtctcactcttctgttttgtcaccatcgtttcagctccaaagtcacaaaaactatgaaggaacttgtgagattcctgaatctaaatatagcccattaggtggtcccaaaccctttgagtgcccaagtattcaaattacatctatctctcctaactgtcatcaagaattagatgcacatgaagatgacctacagataaatgacccagaacgggaatttttggaaaggccttctagagatcatctctatcttcctcttgagccatcctaccgggagtcttctcttagtcctagtcctgccagcagcatctcttctaggagttggttctctgatgcatcttcttgtgaatcgctttcacatatttatgatgatgtggactcagagttgaatgaagctgcagcccgatttacccttggatcccctctgacttctcctggtggctctccagggggctgccctggagaagaaacttggcatcaacagtatggacttggacactcattatcacccaggcaatctccttgccactctcctagatccagtgtcactgatgagaattggctgagccccaggccagcctcaggaccctcatcaaggcccacatccccctgtgggaaacggaggcactccagtgctgaagtttgttatgctgggtccctttcaccccatcactcacctgttccttcacctggtcactcccccaggggaagtgtgacagaagatacgtggctcaatgcttctgtccatggtgggtcaggccttggccctgcagtttttccatttcagtactgtgtagagactgacatccctctcaaaacaaggaaaacttctgaagatcaagctgccatactaccaggaaaattagagctgtgttcagatgaccaagggagtttatcaccagcccgggagacttcaatagatgatggccttggatctcagtatcctttaaagaaagattcatgtggtgatcagtttctttcagttccttcaccctttacctggagcaaaccaaagcctggccacacccctatatttcgcacatcttcattacctccactagactggcctttaccagctcattttggacaatgtgaactgaaaatagaagtgcaacctaaaactcatcatcgagcccattatgaaactgaaggtagccgaggggcagtaaaagcatctactgggggacatcctgttgtgaagctcctgggctataacgaaaagccaataaatctacaaatgtttattgggacagcagatgatcgatatttacgacctcatgcattttaccaggtgcatcgaatcactgggaagacagtcgctactgcaagccaagagataataattgccagtacaaaagttctggaaattccacttcttcctgaaaataatatgtcagccagtattgattgtgcaggtattttgaaactccgcaattcagatatagaacttcgaaaaggagaaactgatattggcagaaagaatactagagtacgacttgtgtttcgtgtacacatcccacagcccagtggaaaagtcctttctctgcagatagcctctatacccgttgagtgctcccagcggtctgctcaagaacttcctcatattgagaagtacagtatcaacagttgttctgtaaatggaggtcatgaaatggttgtgactggatctaattttcttccagaatccaaaatcatttttcttgaaaaaggacaagatggacgacctcagtgggaggtagaagggaagataatcagggaaaaatgtcaaggggctcacattgtccttgaagttcctccatatcataacccagcagttacagctgcagtgcaggtgcacttttatctttgcaatggcaagaggaaaaaaagccagtctcaacgttttacttatacaccagttttgatgaagcaagaacacagagaagagattgatttgtcttcagttccatctttgcctgtgcctcatcctgctcagacccagaggccttcctctgattcagggtgttcacatgacagtgtactgtcaggacagagaagtttgatttgctccatcccacaaacatatgcatccatggtgacctcatcccatctgccacagttgcagtgtagagatgagagtgttagtaaagaacagcatatgattccttctccaattgtacaccagccttttcaagtcacaccaacacctcctgtggggtcttcctatcagcctatgcaaactaatgttgtgtacaatggaccaacttgtcttcctattaatgctgcctctagtcaagaatttgattcagttttgtttcagcaggatgcaactctttctggtttagtgaatcttggctgtcaaccactgtcatccataccatttcattcttcaaattcaggctcaacaggacatctcttagcccatacacctcattctgtgcataccctgcctcatctgcaatcaatgggatatcattgttcaaatacaggacaaagatctctttcttctccagtggctgaccagattacaggtcagccttcgtctcagttacaacctattacatatggtccttcacattcagggtctgctacaacagcttccccagcagcttctcatcccttggctagttcaccgctttctgggccaccatctcctcagcttcagcctatgccttaccaatctcctagctcaggaactgcctcatcaccgtctccagccaccagaatgcattctggacagcactcaactcaagcacaaagtacgggccaggggggtctttctgcaccttcatccttaatatgtcacagtttgtgtgatccagcgtcatttccacctgatggggcaactgtgagcattaaacctgaaccagaagatcgagagcctaactttgcaaccattggtctgcaggacatcactttagatgatgaccaatttatatctgacttggaacaccagccatcaggttcagcagagaaatggcctaaccacagtgtgctctcatgtccagctcctttctggagaatctagaggtgaacgagataattgggagagacatgtcccagatttctgtttcccaaggagcaggggtgagcaggcaggctcccctcccgagtcctgagtccctggatttaggaagatctgatgggctctaacagtgcttactgcagccttgtgtccaccaccaacttctcagcatgtttctctccttggaccttgggtttccaactctgcagccttcaggtctggggccaggagtgggacccaccatttgtggggaaagtagcattcctccacctcaggccttgggtagatttggcaaaagaacaggagcagcataggctgtttgagctttggggaaatgaactttgctttttatatttaactaggatacttttatatgatgggtgctttgagtgtgaatgcagcaggctctcttgtttccgaggtgctgcttttgcaggtgacctggttacttagctaggattggtgatttgtactgctttatggtcatttgaagggccctttagtttttatgataatttttaaaataggaacttttgataagaccttctagaagcaaaaaaaaaaaaaaaaaaaaaaaaaagaaaaaaaaagaaaagaaaaaaagaaaaagaaaaaaatatcccaagcccacacctatgcctcagaaagtcagcatgtgtcctgaagacgttcatagatttataggaaataaagccaaatgtagctcatacctctttataaaactaaactgttgttagataaaatgagaagagaccattccatcattgaagtgttggaatataaaaagacattccagagcatagccttttggtaactttctaggtaatcttgcaatctctccatactggctccatgttgaaattgctttttccctcaggaccctgggtaagatggctacatttaaggtgactctgaatggtggggttctagcttggtcactttcatttcttgccatcataaaaactagtaggctgtggagtgcgcttcctgtttgtgtcatctggtcgtagaaccttttccaaacagaagcatctgcctttggctgttctgtgacctttgaagccagtctcagtggtttaggcagctttgcagttctaactctagctagaggccaggctgtgtgcagagctaaagcacaaatgagcagtacatcagcatgggcagagaaaatacaggactccagatgggaaggttttaagagtcacactggcatggaaggcttatctgccattctatttatagcctgaaatgattctggcctaccctgtcctgtctgtatgatctaaaaaccagccttttccccagaaggctctgagcacatccagaagtgataacctgaccctccacaccaaagacaccctggtgctgctgctggtgagactggtgtccaaggcagggcccagcagaaactgcagcctgctgtctaccaaaggaggtacccgagttgggtactttaaaaaaaaaaaaaacctgcccttacccctctccctaatgggattttttttacctgttcctgggcccattacagagcctctgaagtttgcagtatgctttcaaatgaaataatatacttccattgattcaggaagcagattttttgagtgcctatatgtgagacagtgtgctggttgaaggcctgatgctgttattccaggagactgcaggcccttgatgccaggactctctctactaaggccagttcaggtctgggaaagggagctggcctattgcccaccacctgttgtcagtaggttaggagctgttgactcaggatgaggaagtatggtctttaaaaaaaacaaaatatattttagatttctcccctaaagttagttagagaaaaaggtctattcttcagcagatcactgtggcccctcttggagctgggtgttttcaaattttcttgaaaagtgagttgtgtcacagaatgtggatagtgagatttgcttctgggcctgtggttggacgcccacagcttcctttggaggggcaagaagttggcctctcggttgacattccagagaaatggccagacttgcccctacccttttgcccctggtgtagctgcctcacatgaggttattgcaagagttccccttgcaataccctttgtgccctcaagaattaaaagcctctatgatccagagttgctatgcaccaaattttgatgccttctaaataccttgatgcctgtagcactagaaatgctttcctatttaaaataaacattaaattttaaaatagagctttgtatactatgtaagcagttttatatcagctttgtaaaagctttggtgttaagagtcaatattttttggctttgtagataaagacttaaatttttgtgcaacatagtggtgttaaagcacacatccattggactatgcaaatcaatttctactagcagcactgagcaactgggcacgtgctagtacgcaccccctcctactctaactgtgctagctcttgggttgaggaatggaatgggtagccttctgcttactggagatgcacagagaaacatggctgaaaacagctttaaaaagaacatgtctttgggttcatgtgtggtgctgctgcccgggtgtaaactatccccacccagggccagccattatcaccagacctcttctgggcctggctgtgaagccctgtttttggtattcagaatggatctttaaggctcagatgggctcaaattgaaaccttgtgttttataaaatggatgtttagtaaaggaactggttctcagttatgtttacagcacttggaattgtgtgttcttgtacattttgtattttaaaaccttttatgggagtgcagtgctccttacacaaatacaaagggaagaagagccagcagttgaggctcctcagttttagtgctgaaataataaacagtgacaggtcaacagta

SEQ ID NO: 2868 - DNA, 6040 bp, Homo sapiens
gctgcagcaccctgggccacgccgatgactactgcaaactgtggcgcccacgacgagctcgacttcaaactcgtctttggcgaggacggggcgccggcgccgccgcccccgggctcgcggcctgcagatcttgagccagatgattgtgcatccatttacatctttaatgtagatccacctccatctactttaaccacaccactttgcttaccacatcatggattaccgtctcactcttctgttttgtcaccatcgtttcagctccaaagtcacaaaaactatgaaggaacttgtgagattcctgaatctaaatatagcccattaggtggtcccaaaccctttgagtgcccaagtattcaaattacatctatctctcctaactgtcatcaagaattagatgcacatgaagatgacctacagataaatgacccagaacgggaatttttggaaaggccttctagagatcatctctatcttcctcttgagccatcctaccgggagtcttctcttagtcctagtcctgccagcagcatctcttctaggagttggttctctgatgcatcttcttgtgaatcgctttcacatatttatgatgatgtggactcagagttgaatgaagctgcagcccgatttacccttggatcccctctgacttctcctggtggctctccagggggctgccctggagaagaaacttggcatcaacagtatggacttggacactcattatcacccaggcaatctccttgccactctcctagatccagtgtcactgatgagaattggctgagccccaggccagcctcaggaccctcatcaaggcccacatccccctgtgggaaacggaggcactccagtgctgaagtttgttatgctgggtccctttcaccccatcactcacctgttccttcacctggtcactcccccaggggaagtgtgacagaagatacgtggctcaatgcttctgtccatggtgggtcaggccttggccctgcagtttttccatttcagtactgtgtagagactgacatccctctcaaaacaaggaaaacttctgaagatcaagctgccatactaccaggaaaattagagctgtgttcagatgaccaagggagtttatcaccagcccgggagacttcaatagatgatggccttggatctcagtatcctttaaagaaagattcatgtggtgatcagtttctttcagttccttcaccctttacctggagcaaaccaaagcctggccacacccctatatttcgcacatcttcattacctccactagactggcctttaccagctcattttggacaatgtgaactgaaaatagaagtgcaacctaaaactcatcatcgagcccattatgaaactgaaggtagccgaggggcagtaaaagcatctactgggggacatcctgttgtgaagctcctgggctataacgaaaagccaataaatctacaaatgtttattgggacagcagatgatcgatatttacgacctcatgcattttaccaggtgcatcgaatcactgggaagacagtcgctactgcaagccaagagataataattgccagtacaaaagttctggaaattccacttcttcctgaaaataatatgtcagccagtattgattgtgcaggtattttgaaactccgcaattcagatatagaacttcgaaaaggagaaactgatattggcagaaagaatactagagtacgacttgtgtttcgtgtacacatcccacagcccagtggaaaagtcctttctctgcagatagcctctatacccgttgagtgctcccagcggtctgctcaagaacttcctcatattgagaagtacagtatcaacagttgttctgtaaatggaggtcatgaaatggttgtgactggatctaattttcttccagaatccaaaatcatttttcttgaaaaaggacaagatggacgacctcagtgggaggtagaagggaagataatcagggaaaaatgtcaaggggctcacattgtccttgaagttcctccatatcataacccagcagttacagctgcagtgcaggtgcacttttatctttgcaatggcaagaggaaaaaaagccagtctcaacgttttacttatacaccagttttgatgaagcaagaacacagagaagagattgatttgtcttcagttccatctttgcctgtgcctcatcctgctcagacccagaggccttcctctgattcagggtgttcacatgacagtgtactgtcaggacagagaagtttgatttgctccatcccacaaacatatgcatccatggtgacctcatcccatctgccacagttgcagtgtagagatgagagtgttagtaaagaacagcatatgattccttctccaattgtacaccagccttttcaagtcacaccaacacctcctgtggggtcttcctatcagcctatgcaaactaatgttgtgtacaatggaccaacttgtcttcctattaatgctgcctctagtcaagaatttgattcagttttgtttcagcaggatgcaactctttctggtttagtgaatcttggctgtcaaccactgtcatccataccatttcattcttcaaattcaggctcaacaggacatctcttagcccatacacctcattctgtgcataccctgcctcatctgcaatcaatgggatatcattgttcaaatacaggacaaagatctctttcttctccagtggctgaccagattacaggtcagccttcgtctcagttacaacctattacatatggtccttcacattcagggtctgctacaacagcttccccagcagcttctcatcccttggctagttcaccgctttctgggccaccatctcctcagcttcagcctatgccttaccaatctcctagctcaggaactgcctcatcaccgtctccagccaccagaatgcattctggacagcactcaactcaagcacaaagtacgggccaggggggtctttctgcaccttcatccttaatatgtcacagtttgtgtgatccagcgtcatttccacctgatggggcaactgtgagcattaaacctgaaccagaagatcgagagcctaactttgcaaccattggtctgcaggacatcactttagatgatgtgaacgagataattgggagagacatgtcccagatttctgtttcccaaggagcaggggtgagcaggcaggctcccctcccgagtcctgagtccctggatttaggaagatctgatgggctctaacagtgcttactgcagccttgtgtccaccaccaacttctcagcatgtttctctccttggaccttgggtttccaactctgcagccttcaggtctggggccaggagtgggacccaccatttgtggggaaagtagcattcctccacctcaggccttgggtagatttggcaaaagaacaggagcagcataggctgtttgagctttggggaaatgaactttgctttttatatttaactaggatacttttatatgatgggtgctttgagtgtgaatgcagcaggctctcttgtttccgaggtgctgcttttgcaggtgacctggttacttagctaggattggtgatttgtactgctttatggtcatttgaagggccctttagtttttatgataatttttaaaataggaacttttgataagaccttctagaagcaaaaaaaaaaaaaaaaaaaaaaaaaagaaaaaaaaagaaaagaaaaaaagaaaaagaaaaaaatatcccaagcccacacctatgcctcagaaagtcagcatgtgtcctgaagacgttcatagatttataggaaataaagccaaatgtagctcatacctctttataaaactaaactgttgttagataaaatgagaagagaccattccatcattgaagtgttggaatataaaaagacattccagagcatagccttttggtaactttctaggtaatcttgcaatctctccatactggctccatgttgaaattgctttttccctcaggaccctgggtaagatggctacatttaaggtgactctgaatggtggggttctagcttggtcactttcatttcttgccatcataaaaactagtaggctgtggagtgcgcttcctgtttgtgtcatctggtcgtagaaccttttccaaacagaagcatctgcctttggctgttctgtgacctttgaagccagtctcagtggtttaggcagctttgcagttctaactctagctagaggccaggctgtgtgcagagctaaagcacaaatgagcagtacatcagcatgggcagagaaaatacaggactccagatgggaaggttttaagagtcacactggcatggaaggcttatctgccattctatttatagcctgaaatgattctggcctaccctgtcctgtctgtatgatctaaaaaccagccttttccccagaaggctctgagcacatccagaagtgataacctgaccctccacaccaaagacaccctggtgctgctgctggtgagactggtgtccaaggcagggcccagcagaaactgcagcctgctgtctaccaaaggaggtacccgagttgggtactttaaaaaaaaaaaaaacctgcccttacccctctccctaatgggattttttttacctgttcctgggcccattacagagcctctgaagtttgcagtatgctttcaaatgaaataatatacttccattgattcaggaagcagattttttgagtgcctatatgtgagacagtgtgctggttgaaggcctgatgctgttattccaggagactgcaggcccttgatgccaggactctctctactaaggccagttcaggtctgggaaagggagctggcctattgcccaccacctgttgtcagtaggttaggagctgttgactcaggatgaggaagtatggtctttaaaaaaaacaaaatatattttagatttctcccctaaagttagttagagaaaaaggtctattcttcagcagatcactgtggcccctcttggagctgggtgttttcaaattttcttgaaaagtgagttgtgtcacagaatgtggatagtgagatttgcttctgggcctgtggttggacgcccacagcttcctttggaggggcaagaagttggcctctcggttgacattccagagaaatggccagacttgcccctacccttttgcccctggtgtagctgcctcacatgaggttattgcaagagttccccttgcaataccctttgtgccctcaagaattaaaagcctctatgatccagagttgctatgcaccaaattttgatgccttctaaataccttgatgcctgtagcactagaaatgctttcctatttaaaataaacattaaattttaaaatagagctttgtatactatgtaagcagttttatatcagctttgtaaaagctttggtgttaagagtcaatattttttggctttgtagataaagacttaaatttttgtgcaacatagtggtgttaaagcacacatccattggactatgcaaatcaatttctactagcagcactgagcaactgggcacgtgctagtacgcaccccctcctactctaactgtgctagctcttgggttgaggaatggaatgggtagccttctgcttactggagatgcacagagaaacatggctgaaaacagctttaaaaagaacatgtctttgggttcatgtgtggtgctgctgcccgggtgtaaactatccccacccagggccagccattatcaccagacctcttctgggcctggctgtgaagccctgtttttggtattcagaatggatctttaaggctcagatgggctcaaattgaaaccttgtgttttataaaatggatgtttagtaaaggaactggttctcagttatgtttacagcacttggaattgtgtgttcttgtacattttgtattttaaaaccttttatgggagtgcagtgctccttacacaaatacaaagggaagaagagccagcagttgaggctcctcagttttagtgctgaaataataaacagtgacaggtcaacagta

SEQ ID NO: 2869 - DNA, 6129 bp, Homo sapiens
gctgcagcaccctgggccacgccgatgactactgcaaactgtggcgcccacgacgagctcgacttcaaactcgtctttggcgaggacggggcgccggcgccgccgcccccgggctcgcggcctgcagatcttgagccagatgattgtgcatccatttacatctttaatgtagatccacctccatctactttaaccacaccactttgcttaccacatcatggattaccgtctcactcttctgttttgtcaccatcgtttcagctccaaagtcacaaaaactatgaaggaacttgtgagattcctgaatctaaatatagcccattaggtggtcccaaaccctttgagtgcccaagtattcaaattacatctatctctcctaactgtcatcaagaattagatgcacatgaagatgacctacagataaatgacccagaacgggaatttttggaaaggccttctagagatcatctctatcttcctcttgagccatcctaccgggagtcttctcttagtcctagtcctgccagcagcatctcttctaggagttggttctctgatgcatcttcttgtgaatcgctttcacatatttatgatgatgtggactcagagttgaatgaagctgcagcccgatttacccttggatcccctctgacttctcctggtggctctccagggggctgccctggagaagaaacttggcatcaacagtatggacttggacactcattatcacccaggcaatctccttgccactctcctagatccagtgtcactgatgagaattggctgagccccaggccagcctcaggaccctcatcaaggcccacatccccctgtgggaaacggaggcactccagtgctgaagtttgttatgctgggtccctttcaccccatcactcacctgttccttcacctggtcactcccccaggggaagtgtgacagaagatacgtggctcaatgcttctgtccatggtgggtcaggccttggccctgcagtttttccatttcagtactgtgtagagactgacatccctctcaaaacaaggaaaacttctgaagatcaagctgccatactaccaggaaaattagagctgtgttcagatgaccaagggagtttatcaccagcccgggagacttcaatagatgatggccttggatctcagtatcctttaaagaaagattcatgtggtgatcagtttctttcagttccttcaccctttacctggagcaaaccaaagcctggccacacccctatatttcgcacatcttcattacctccactagactggcctttaccagctcattttggacaatgtgaactgaaaatagaagtgcaacctaaaactcatcatcgagcccattatgaaactgaaggtagccgaggggcagtaaaagcatctactgggggacatcctgttgtgaagctcctgggctataacgaaaagccaataaatctacaaatgtttattgggacagcagatgatcgatatttacgacctcatgcattttaccaggtgcatcgaatcactgggaagacagtcgctactgcaagccaagagataataattgccagtacaaaagttctggaaattccacttcttcctgaaaataatatgtcagccagtattgattgtgcaggtattttgaaactccgcaattcagatatagaacttcgaaaaggagaaactgatattggcagaaagaatactagagtacgacttgtgtttcgtgtacacatcccacagcccagtggaaaagtcctttctctgcagatagcctctatacccgttgagtgctcccagcggtctgctcaagaacttcctcatattgagaagtacagtatcaacagttgttctgtaaatggaggtcatgaaatggttgtgactggatctaattttcttccagaatccaaaatcatttttcttgaaaaaggacaagatggacgacctcagtgggaggtagaagggaagataatcagggaaaaatgtcaaggggctcacattgtccttgaagttcctccatatcataacccagcagttacagctgcagtgcaggtgcacttttatctttgcaatggcaagaggaaaaaaagccagtctcaacgttttacttatacaccagttttgatgaagcaagaacacagagaagagattgatttgtcttcagttccatctttgcctgtgcctcatcctgctcagacccagaggccttcctctgattcagggtgttcacatgacagtgtactgtcaggacagagaagtttgatttgctccatcccacaaacatatgcatccatggtgacctcatcccatctgccacagttgcagtgtagagatgagagtgttagtaaagaacagcatatgattccttctccaattgtacaccagccttttcaagtcacaccaacacctcctgtggggtcttcctatcagcctatgcaaactaatgttgtgtacaatggaccaacttgtcttcctattaatgctgcctctagtcaagaatttgattcagttttgtttcagcaggatgcaactctttctggtttagtgaatcttggctgtcaaccactgtcatccataccatttcattcttcaaattcaggctcaacaggacatctcttagcccatacacctcattctgtgcataccctgcctcatctgcaatcaatgggatatcattgttcaaatacaggacaaagatctctttcttctccagtggctgaccagattacaggtcagccttcgtctcagttacaacctattacatatggtccttcacattcagggtctgctacaacagcttccccagcagcttctcatcccttggctagttcaccgctttctgggccaccatctcctcagcttcagcctatgccttaccaatctcctagctcaggaactgcctcatcaccgtctccagccaccagaatgcattctggacagcactcaactcaagcacaaagtacgggccaggggggtctttctgcaccttcatccttaatatgtcacagtttgtgtgatccagcgtcatttccacctgatggggcaactgtgagcattaaacctgaaccagaagatcgagagcctaactttgcaaccattggtctgcaggacatcactttagatgatgatttgtttaccagtaataattttgacttgcttcagttgagacctacgttttggccagtcccagcaggaagatatctgaggaatctagagtgaacgagataattgggagagacatgtcccagatttctgtttcccaaggagcaggggtgagcaggcaggctcccctcccgagtcctgagtccctggatttaggaagatctgatgggctctaacagtgcttactgcagccttgtgtccaccaccaacttctcagcatgtttctctccttggaccttgggtttccaactctgcagccttcaggtctggggccaggagtgggacccaccatttgtggggaaagtagcattcctccacctcaggccttgggtagatttggcaaaagaacaggagcagcataggctgtttgagctttggggaaatgaactttgctttttatatttaactaggatacttttatatgatgggtgctttgagtgtgaatgcagcaggctctcttgtttccgaggtgctgcttttgcaggtgacctggttacttagctaggattggtgatttgtactgctttatggtcatttgaagggccctttagtttttatgataatttttaaaataggaacttttgataagaccttctagaagcaaaaaaaaaaaaaaaaaaaaaaaaaagaaaaaaaaagaaaagaaaaaaagaaaaagaaaaaaatatcccaagcccacacctatgcctcagaaagtcagcatgtgtcctgaagacgttcatagatttataggaaataaagccaaatgtagctcatacctctttataaaactaaactgttgttagataaaatgagaagagaccattccatcattgaagtgttggaatataaaaagacattccagagcatagccttttggtaactttctaggtaatcttgcaatctctccatactggctccatgttgaaattgctttttccctcaggaccctgggtaagatggctacatttaaggtgactctgaatggtggggttctagcttggtcactttcatttcttgccatcataaaaactagtaggctgtggagtgcgcttcctgtttgtgtcatctggtcgtagaaccttttccaaacagaagcatctgcctttggctgttctgtgacctttgaagccagtctcagtggtttaggcagctttgcagttctaactctagctagaggccaggctgtgtgcagagctaaagcacaaatgagcagtacatcagcatgggcagagaaaatacaggactccagatgggaaggttttaagagtcacactggcatggaaggcttatctgccattctatttatagcctgaaatgattctggcctaccctgtcctgtctgtatgatctaaaaaccagccttttccccagaaggctctgagcacatccagaagtgataacctgaccctccacaccaaagacaccctggtgctgctgctggtgagactggtgtccaaggcagggcccagcagaaactgcagcctgctgtctaccaaaggaggtacccgagttgggtactttaaaaaaaaaaaaaacctgcccttacccctctccctaatgggattttttttacctgttcctgggcccattacagagcctctgaagtttgcagtatgctttcaaatgaaataatatacttccattgattcaggaagcagattttttgagtgcctatatgtgagacagtgtgctggttgaaggcctgatgctgttattccaggagactgcaggcccttgatgccaggactctctctactaaggccagttcaggtctgggaaagggagctggcctattgcccaccacctgttgtcagtaggttaggagctgttgactcaggatgaggaagtatggtctttaaaaaaaacaaaatatattttagatttctcccctaaagttagttagagaaaaaggtctattcttcagcagatcactgtggcccctcttggagctgggtgttttcaaattttcttgaaaagtgagttgtgtcacagaatgtggatagtgagatttgcttctgggcctgtggttggacgcccacagcttcctttggaggggcaagaagttggcctctcggttgacattccagagaaatggccagacttgcccctacccttttgcccctggtgtagctgcctcacatgaggttattgcaagagttccccttgcaataccctttgtgccctcaagaattaaaagcctctatgatccagagttgctatgcaccaaattttgatgccttctaaataccttgatgcctgtagcactagaaatgctttcctatttaaaataaacattaaattttaaaatagagctttgtatactatgtaagcagttttatatcagctttgtaaaagctttggtgttaagagtcaatattttttggctttgtagataaagacttaaatttttgtgcaacatagtggtgttaaagcacacatccattggactatgcaaatcaatttctactagcagcactgagcaactgggcacgtgctagtacgcaccccctcctactctaactgtgctagctcttgggttgaggaatggaatgggtagccttctgcttactggagatgcacagagaaacatggctgaaaacagctttaaaaagaacatgtctttgggttcatgtgtggtgctgctgcccgggtgtaaactatccccacccagggccagccattatcaccagacctcttctgggcctggctgtgaagccctgtttttggtattcagaatggatctttaaggctcagatgggctcaaattgaaaccttgtgttttataaaatggatgtttagtaaaggaactggttctcagttatgtttacagcacttggaattgtgtgttcttgtacattttgtattttaaaaccttttatgggagtgcagtgctccttacacaaatacaaagggaagaagagccagcagttgaggctcctcagttttagtgctgaaataataaacagtgacaggtcaacagta

SEQ ID NO: 2870 - DNA, 4157 bp, Homo sapiens
gttttgtgtttttagtagagacagagtttcaccatgttggccaggctggtctggaactcctgacctcaagggatcctcctgcctcagcctcccaaagtggtgggattacaggcatgggccactgcaccctgcccaatatatatatttttaaatagagatggaagtctcactatgttgcccaggctagtctggaactcctgggctctcctgttctggcttcccaaaatgctgggattacaggtgtgagccactgcacatagcccctatattttgttaaataagtgaataaataacacctaagttttgaatcattgctcactgctctttcgtggtagaggaaattgacgagaattgtttcagttctttggcttttattgatgagttccataaattagatcttggtaatttggggctgcagtggttttacatctctgaaggtttgggagtacttgtatcacaactaaatttccatacagtgagaagatttttgaaaaatagtgagatcttgagccagatgattgtgcatccatttacatctttaatgtagatccacctccatctactttaaccacaccactttgcttaccacatcatggattaccgtctcactcttctgttttgtcaccatcgtttcagctccaaagtcacaaaaactatgaaggaacttgtgagattcctgaatctaaatatagcccattaggtggtcccaaaccctttgagtgcccaagtattcaaattacatctatctctcctaactgtcatcaagaattagatgcacatgaagatgacctacagataaatgacccagaacgggaatttttggaaaggccttctagagatcatctctatcttcctcttgagccatcctaccgggagtcttctcttagtcctagtcctgccagcagcatctcttctaggagttggttctctgatgcatcttcttgtgaatcgctttcacatatttatgatgatgtggactcagagttgaatgaagctgcagcccgatttacccttggatcccctctgacttctcctggtggctctccagggggctgccctggagaagaaacttggcatcaacagtatggacttggacactcattatcacccaggcaatctccttgccactctcctagatccagtgtcactgatgagaattggctgagccccaggccagcctcaggaccctcatcaaggcccacatccccctgtgggaaacggaggcactccagtgctgaagtttgttatgctgggtccctttcaccccatcactcacctgttccttcacctggtcactcccccaggggaagtgtgacagaagatacgtggctcaatgcttctgtccatggtgggtcaggccttggccctgcagtttttccatttcagtactgtgtagagactgacatccctctcaaaacaaggaaaacttctgaagatcaagctgccatactaccaggaaaattagagctgtgttcagatgaccaagggagtttatcaccagcccgggagacttcaatagatgatggccttggatctcagtatcctttaaagaaagattcatgtggtgatcagtttctttcagttccttcaccctttacctggagcaaaccaaagcctggccacacccctatatttcgcacatcttcattacctccactagactggcctttaccagctcattttggacaatgtgaactgaaaatagaagtgcaacctaaaactcatcatcgagcccattatgaaactgaaggtagccgaggggcagtaaaagcatctactgggggacatcctgttgtgaagctcctgggctataacgaaaagccaataaatctacaaatgtttattgggacagcagatgatcgatatttacgacctcatgcattttaccaggtgcatcgaatcactgggaagacagtcgctactgcaagccaagagataataattgccagtacaaaagttctggaaattccacttcttcctgaaaataatatgtcagccagtattgattgtgcaggtattttgaaactccgcaattcagatatagaacttcgaaaaggagaaactgatattggcagaaagaatactagagtacgacttgtgtttcgtgtacacatcccacagcccagtggaaaagtcctttctctgcagatagcctctatacccgttgagtgctcccagcggtctgctcaagaacttcctcatattgagaagtacagtatcaacagttgttctgtaaatggaggtcatgaaatggttgtgactggatctaattttcttccagaatccaaaatcatttttcttgaaaaaggacaagatggacgacctcagtgggaggtagaagggaagataatcagggaaaaatgtcaaggggctcacattgtccttgaagttcctccatatcataacccagcagttacagctgcagtgcaggtgcacttttatctttgcaatggcaagaggaaaaaaagccagtctcaacgttttacttatacaccagttttgatgaagcaagaacacagagaagagattgatttgtcttcagttccatctttgcctgtgcctcatcctgctcagacccagaggccttcctctgattcagggtgttcacatgacagtgtactgtcaggacagagaagtttgatttgctccatcccacaaacatatgcatccatggtgacctcatcccatctgccacagttgcagtgtagagatgagagtgttagtaaagaacagcatatgattccttctccaattgtacaccagccttttcaagtcacaccaacacctcctgtggggtcttcctatcagcctatgcaaactaatgttgtgtacaatggaccaacttgtcttcctattaatgctgcctctagtcaagaatttgattcagttttgtttcagcaggatgcaactctttctggtttagtgaatcttggctgtcaaccactgtcatccataccatttcattcttcaaattcaggctcaacaggacatctcttagcccatacacctcattctgtgcataccctgcctcatctgcaatcaatgggatatcattgttcaaatacaggacaaagatctctttcttctccagtggctgaccagattacaggtcagccttcgtctcagttacaacctattacatatggtccttcacattcagggtctgctacaacagcttccccagcagcttctcatcccttggctagttcaccgctttctgggccaccatctcctcagcttcagcctatgccttaccaatctcctagctcaggaactgcctcatcaccgtctccagccaccagaatgcattctggacagcactcaactcaagcacaaagtacgggccaggggggtctttctgcaccttcatccttaatatgtcacagtttgtgtgatccagcgtcatttccacctgatggggcaactgtgagcattaaacctgaaccagaagatcgagagcctaactttgcaaccattggtctgcaggacatcactttagatgatgaccaatttatatctgacttggaacaccagccatcaggttcagcagagaaatggcctaaccacagtgtgctctcatgtccagctcctttctggagaatctagaggtgaacgagataattgggagagacatgtcccagatttctgtttcccaaggagcaggggtgagcaggcaggctcccctcccgagtcctgagtccctggatttaggaagatctgatgggctctaacagtgcttactgcagccttgtgtccaccaccaacttctcagcatgtttctctccttggaccttgggtttccaactctgcagccttcaggtctggggccaggagtgggacccaccatttgtggggaaagtagcattcctccacctcaggccttgggtagatttggcaaaagaacaggagcagcataggctgtttgagctttggggaaatgaactttgctttttatatttaactaggatacttttatatgatgggtgctttgagtgtgaatgcagcaggctctcttgtttccgaggtgctgcttttgcaggtgacctggttacttagctaggattggtgatttgtactgctttatggtcatttgaagggccctttagtttttatgataatttttaaaataggaacttttgataagaccttctagaagc

SEQ ID NO: 2871 - DNA, 4749 bp, Homo sapiens
gcttctggagggaggcggcagcgacggaggagggggcttctcagagaaagggagggagggagccacccgggtgaagatacagcagcctcctgaactcccccctcccacccaggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctgttgtgctggaaagctggggacaggttgatggtaataaactgctcaatgaccagtgcttcaggctccagagctctttggagagatgggttggggcagcttactccagccctggcccaaggaggcccagaagttggaaagagatggaatgtggctgggaacattgcatcccaaagagcttctcagtggaggaggctggggaaggcatgagggggctcagaggctccttgactgggaccaggattgggggccagggcttgagtaggcctctccactctcctccttgggggtccagattccttaggagctttgggatgaggcccaggaggctgcatttttccaggtccttagtcttgccaccacacagatgattctgattcatagccaagatgaggacacactgatgtagctgatctctcatttacagaggaggattctaaagttcagagagggaaaggggcttgcctgaggtcacgtagataatcagcagcacattgaacgctgcactcctgggctcctgtccccagcccccattcagacacgctgactcaggaggtccaggcctctaaggcttctctccctggagtgagggtggaggtgagggagagctggcacaagccctccctctggatcctccactcctggggattatgaagatattctggaaagatttgtgcttcagaggtagactgcagaaagcaaacagtctacccagcagctctgaatgtcacctgccctggggcttacagcactatatgagttcctggcctatcctgcaaatatgcccatgctggccttctaaatagctggtacatccatcaccactgacgggcctggcctggaaacctggtttgtcccctgtcttgatggcctacgagaggccaagttccactgggctgggaaaagtcactttgtctgtcttgttcacctggagcctgacacaccgtaggtactgagtacaaatagcttgatttggctaggcttggctgcagggggacgtgcctaaaagacattccgggcatttgcacttgggaaacttgcctcaccttcaggcttgtggggcctctctatgcccaatgagtccaggcagtcctagcaagtactcaggagagcaggggtgggtgtgacagaggctggctctggattgggggacaacagaaccagagtaactcctcgcctgttgctgctttgcaatgaatttcctttacctttctggaacacaagctgctgtgaaccaaactgatatcaagtgattagctcaccgggccttggttgcttttcaaagatccccttcagccccctgccagagtcactgccccataatcaccatgtcagaagggaccctagggcattcgtgtcctatttatcaatcttcagcaccacctctaagatctctgagagagggtggatcagcctctgtgtaaacaaaaagctgttaggacttgttgcctctcaaggtggactattctgttttctgccaggacactgccattcatgcattgtcagatatttattaaacagcagcaaagtgccagccaatttgtcctggaggaattcatagcctcatggggcaaaagtaaataaacagcttattacaattcaacaa

SEQ ID NO: 2872 - DNA, 5700 bp, Homo sapiens
gtaaacgtctgacctggggccgtcgcttaaccgtttagttgctgggatggggcggcgttgggggtgcggccctgaaccggagggatttagagactggagacgcggcctctaagagaggttgaaactgtgtgtgtgtgggagaaaatgataaccaccctcccatctctcctacccgccagcctcgccagtatctcccaccgagtcacgaatctcccatctaactccctctcacacaacccaggcctctccaagcctgactttcccggaaactccagtccaggtcttccttcctcctccagcccaggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaaggtgggtgtgggactgggggctgtgagtgtgagtgtgtgcaagagattgctctgcatgtttgctgagggctggagctgggcttttcagagatcgggcatccctggtctctcagggccagttggaggttcccaggaggcatgttcttgatgcctgtggctgcctgaatccaattaactgaattctgaagagtgcatggggtaactgtctcagcctttctcctgtctctgcctctgtcctctgctccaaatcataaaatctcagagctagaagcactttcaagatcattccatccagcgcattcaatttgcaagtttaggcgttgagttccagagagggatggtagcttgctgaggtcccagtcaagcacacttgccattgcctcagctttcccctaaacacggtgtctgtggtcagggttggtgaggaggagctttcctgttttgcctctccttcttcccattggctacacccatctctggccctgctgataccgattcccctgacatttcaggctaagccagcaggaaagggctaggacgggtgcctgggagcccacatggagggagttgggcaagatttgattcggagcaggtgtcaagacgtgttggggaaactgaggcccagtggaatagaagccagtagaggaggaatctagaggcctcctagattaagacctgcctggaatggattgggggtgggtctttggaaaaggaggggacccacctctagcccagtctctcaactgcccctcctttacagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctgttgtgctggaaagctggggacaggttgatggtaataaactgctcaatgaccagtgcttcaggctccagagctctttggagagatgggttggggcagcttactccagccctggcccaaggaggcccagaagttggaaagagatggaatgtggctgggaacattgcatcccaaagagcttctcagtggaggaggctggggaaggcatgagggggctcagaggctccttgactgggaccaggattgggggccagggcttgagtaggcctctccactctcctccttgggggtccagattccttaggagctttgggatgaggcccaggaggctgcatttttccaggtccttagtcttgccaccacacagatgattctgattcatagccaagatgaggacacactgatgtagctgatctctcatttacagaggaggattctaaagttcagagagggaaaggggcttgcctgaggtcacgtagataatcagcagcacattgaacgctgcactcctgggctcctgtccccagcccccattcagacacgctgactcaggaggtccaggcctctaaggcttctctccctggagtgagggtggaggtgagggagagctggcacaagccctccctctggatcctccactcctggggattatgaagatattctggaaagatttgtgcttcagaggtagactgcagaaagcaaacagtctacccagcagctctgaatgtcacctgccctggggcttacagcactatatgagttcctggcctatcctgcaaatatgcccatgctggccttctaaatagctggtacatccatcaccactgacgggcctggcctggaaacctggtttgtcccctgtcttgatggcctacgagaggccaagttccactgggctgggaaaagtcactttgtctgtcttgttcacctggagcctgacacaccgtaggtactgagtacaaatagcttgatttggctaggcttggctgcagggggacgtgcctaaaagacattccgggcatttgcacttgggaaacttgcctcaccttcaggcttgtggggcctctctatgcccaatgagtccaggcagtcctagcaagtactcaggagagcaggggtgggtgtgacagaggctggctctggattgggggacaacagaaccagagtaactcctcgcctgttgctgctttgcaatgaatttcctttacctttctggaacacaagctgctgtgaaccaaactgatatcaagtgattagctcaccgggccttggttgcttttcaaagatccccttcagccccctgccagagtcactgccccataatcaccatgtcagaagggaccctagggcattcgtgtcctatttatcaatcttcagcaccacctctaagatctctgagagagggtggatcagcctctgtgtaaacaaaaagctgttaggacttgttgcctctcaaggtggactattctgttttctgccaggacactgccattcatgcattgtcagatatttattaaacagcagcaaagtgccagccaatttgtcctggaggaattcatagcctcatggggcaaaagtaaataaacagcttattacaattcaacaa

SEQ ID NO: 2873 - DNA, 5491 bp, Homo sapiens
atgtgtgagtcgcccccagtccagcccagtgcctcaagaaacacgcctccaggcccagccccagctccagcccctctggacccacctctctcaccttaagacccactggatcgggtaccctcggtcctaggatccaggggccagtgggcaaaggcctggcatgcctgcttcaatctcctccatcttcccaggtccaactctgcttttgtcttgtggctcagaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaaggtgggtgtgggactgggggctgtgagtgtgagtgtgtgcaagagattgctctgcatgtttgctgagggctggagctgggcttttcagagatcgggcatccctggtctctcagggccagttggaggttcccaggaggcatgttcttgatgcctgtggctgcctgaatccaattaactgaattctgaagagtgcatggggtaactgtctcagcctttctcctgtctctgcctctgtcctctgctccaaatcataaaatctcagagctagaagcactttcaagatcattccatccagcgcattcaatttgcaagtttaggcgttgagttccagagagggatggtagcttgctgaggtcccagtcaagcacacttgccattgcctcagctttcccctaaacacggtgtctgtggtcagggttggtgaggaggagctttcctgttttgcctctccttcttcccattggctacacccatctctggccctgctgataccgattcccctgacatttcaggctaagccagcaggaaagggctaggacgggtgcctgggagcccacatggagggagttgggcaagatttgattcggagcaggtgtcaagacgtgttggggaaactgaggcccagtggaatagaagccagtagaggaggaatctagaggcctcctagattaagacctgcctggaatggattgggggtgggtctttggaaaaggaggggacccacctctagcccagtctctcaactgcccctcctttacagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctgttgtgctggaaagctggggacaggttgatggtaataaactgctcaatgaccagtgcttcaggctccagagctctttggagagatgggttggggcagcttactccagccctggcccaaggaggcccagaagttggaaagagatggaatgtggctgggaacattgcatcccaaagagcttctcagtggaggaggctggggaaggcatgagggggctcagaggctccttgactgggaccaggattgggggccagggcttgagtaggcctctccactctcctccttgggggtccagattccttaggagctttgggatgaggcccaggaggctgcatttttccaggtccttagtcttgccaccacacagatgattctgattcatagccaagatgaggacacactgatgtagctgatctctcatttacagaggaggattctaaagttcagagagggaaaggggcttgcctgaggtcacgtagataatcagcagcacattgaacgctgcactcctgggctcctgtccccagcccccattcagacacgctgactcaggaggtccaggcctctaaggcttctctccctggagtgagggtggaggtgagggagagctggcacaagccctccctctggatcctccactcctggggattatgaagatattctggaaagatttgtgcttcagaggtagactgcagaaagcaaacagtctacccagcagctctgaatgtcacctgccctggggcttacagcactatatgagttcctggcctatcctgcaaatatgcccatgctggccttctaaatagctggtacatccatcaccactgacgggcctggcctggaaacctggtttgtcccctgtcttgatggcctacgagaggccaagttccactgggctgggaaaagtcactttgtctgtcttgttcacctggagcctgacacaccgtaggtactgagtacaaatagcttgatttggctaggcttggctgcagggggacgtgcctaaaagacattccgggcatttgcacttgggaaacttgcctcaccttcaggcttgtggggcctctctatgcccaatgagtccaggcagtcctagcaagtactcaggagagcaggggtgggtgtgacagaggctggctctggattgggggacaacagaaccagagtaactcctcgcctgttgctgctttgcaatgaatttcctttacctttctggaacacaagctgctgtgaaccaaactgatatcaagtgattagctcaccgggccttggttgcttttcaaagatccccttcagccccctgccagagtcactgccccataatcaccatgtcagaagggaccctagggcattcgtgtcctatttatcaatcttcagcaccacctctaagatctctgagagagggtggatcagcctctgtgtaaacaaaaagctgttaggacttgttgcctctcaaggtggactattctgttttctgccaggacactgccattcatgcattgtcagatatttattaaacagcagcaaagtgccagccaatttgtcctggaggaattcatagcctcatggggcaaaagtaaataaacagcttattacaattcaacaa

SEQ ID NO: 2874 - DNA, 5488 bp, Homo sapiens
gaagaggaggggaacccacagggtccggaggtttcaggcccctagtaaacctggcaaggatttttagaagagccggagtgggatgctatcgggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaaggtgggtgtgggactgggggctgtgagtgtgagtgtgtgcaagagattgctctgcatgtttgctgagggctggagctgggcttttcagagatcgggcatccctggtctctcagggccagttggaggttcccaggaggcatgttcttgatgcctgtggctgcctgaatccaattaactgaattctgaagagtgcatggggtaactgtctcagcctttctcctgtctctgcctctgtcctctgctccaaatcataaaatctcagagctagaagcactttcaagatcattccatccagcgcattcaatttgcaagtttaggcgttgagttccagagagggatggtagcttgctgaggtcccagtcaagcacacttgccattgcctcagctttcccctaaacacggtgtctgtggtcagggttggtgaggaggagctttcctgttttgcctctccttcttcccattggctacacccatctctggccctgctgataccgattcccctgacatttcaggctaagccagcaggaaagggctaggacgggtgcctgggagcccacatggagggagttgggcaagatttgattcggagcaggtgtcaagacgtgttggggaaactgaggcccagtggaatagaagccagtagaggaggaatctagaggcctcctagattaagacctgcctggaatggattgggggtgggtctttggaaaaggaggggacccacctctagcccagtctctcaactgcccctcctttacagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctgttgtgctggaaagctggggacaggttgatggtaataaactgctcaatgaccagtgcttcaggctccagagctctttggagagatgggttggggcagcttactccagccctggcccaaggaggcccagaagttggaaagagatggaatgtggctgggaacattgcatcccaaagagcttctcagtggaggaggctggggaaggcatgagggggctcagaggctccttgactgggaccaggattgggggccagggcttgagtaggcctctccactctcctccttgggggtccagattccttaggagctttgggatgaggcccaggaggctgcatttttccaggtccttagtcttgccaccacacagatgattctgattcatagccaagatgaggacacactgatgtagctgatctctcatttacagaggaggattctaaagttcagagagggaaaggggcttgcctgaggtcacgtagataatcagcagcacattgaacgctgcactcctgggctcctgtccccagcccccattcagacacgctgactcaggaggtccaggcctctaaggcttctctccctggagtgagggtggaggtgagggagagctggcacaagccctccctctggatcctccactcctggggattatgaagatattctggaaagatttgtgcttcagaggtagactgcagaaagcaaacagtctacccagcagctctgaatgtcacctgccctggggcttacagcactatatgagttcctggcctatcctgcaaatatgcccatgctggccttctaaatagctggtacatccatcaccactgacgggcctggcctggaaacctggtttgtcccctgtcttgatggcctacgagaggccaagttccactgggctgggaaaagtcactttgtctgtcttgttcacctggagcctgacacaccgtaggtactgagtacaaatagcttgatttggctaggcttggctgcagggggacgtgcctaaaagacattccgggcatttgcacttgggaaacttgcctcaccttcaggcttgtggggcctctctatgcccaatgagtccaggcagtcctagcaagtactcaggagagcaggggtgggtgtgacagaggctggctctggattgggggacaacagaaccagagtaactcctcgcctgttgctgctttgcaatgaatttcctttacctttctggaacacaagctgctgtgaaccaaactgatatcaagtgattagctcaccgggccttggttgcttttcaaagatccccttcagccccctgccagagtcactgccccataatcaccatgtcagaagggaccctagggcattcgtgtcctatttatcaatcttcagcaccacctctaagatctctgagagagggtggatcagcctctgtgtaaacaaaaagctgttaggacttgttgcctctcaaggtggactattctgttttctgccaggacactgccattcatgcattgtcagatatttattaaacagcagcaaagtgccagccaatttgtcctggaggaattcatagcctcatggggcaaaagtaaataaacagcttattacaattcaacaa

SEQ ID NO: 2875 - DNA, 5686 bp, Homo sapiens
ttccagactacagttctagggaggaggctgccaacttcccgtggaggctaattcacggcccctctgggtggctgggacaagggcagcggcaaagcctggcctggatctacgcccatcaagggctgtgggcctagggacagttctcaaagcctctttggctcggactgctcccagaggcatccaggctggctaagcgttcttcatctttgggggtcctggaggaatggctgatggaggcgctgattcggcagcgcaaagacttccagaaggcccgggcagagtagccccaggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaaggtgggtgtgggactgggggctgtgagtgtgagtgtgtgcaagagattgctctgcatgtttgctgagggctggagctgggcttttcagagatcgggcatccctggtctctcagggccagttggaggttcccaggaggcatgttcttgatgcctgtggctgcctgaatccaattaactgaattctgaagagtgcatggggtaactgtctcagcctttctcctgtctctgcctctgtcctctgctccaaatcataaaatctcagagctagaagcactttcaagatcattccatccagcgcattcaatttgcaagtttaggcgttgagttccagagagggatggtagcttgctgaggtcccagtcaagcacacttgccattgcctcagctttcccctaaacacggtgtctgtggtcagggttggtgaggaggagctttcctgttttgcctctccttcttcccattggctacacccatctctggccctgctgataccgattcccctgacatttcaggctaagccagcaggaaagggctaggacgggtgcctgggagcccacatggagggagttgggcaagatttgattcggagcaggtgtcaagacgtgttggggaaactgaggcccagtggaatagaagccagtagaggaggaatctagaggcctcctagattaagacctgcctggaatggattgggggtgggtctttggaaaaggaggggacccacctctagcccagtctctcaactgcccctcctttacagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctgttgtgctggaaagctggggacaggttgatggtaataaactgctcaatgaccagtgcttcaggctccagagctctttggagagatgggttggggcagcttactccagccctggcccaaggaggcccagaagttggaaagagatggaatgtggctgggaacattgcatcccaaagagcttctcagtggaggaggctggggaaggcatgagggggctcagaggctccttgactgggaccaggattgggggccagggcttgagtaggcctctccactctcctccttgggggtccagattccttaggagctttgggatgaggcccaggaggctgcatttttccaggtccttagtcttgccaccacacagatgattctgattcatagccaagatgaggacacactgatgtagctgatctctcatttacagaggaggattctaaagttcagagagggaaaggggcttgcctgaggtcacgtagataatcagcagcacattgaacgctgcactcctgggctcctgtccccagcccccattcagacacgctgactcaggaggtccaggcctctaaggcttctctccctggagtgagggtggaggtgagggagagctggcacaagccctccctctggatcctccactcctggggattatgaagatattctggaaagatttgtgcttcagaggtagactgcagaaagcaaacagtctacccagcagctctgaatgtcacctgccctggggcttacagcactatatgagttcctggcctatcctgcaaatatgcccatgctggccttctaaatagctggtacatccatcaccactgacgggcctggcctggaaacctggtttgtcccctgtcttgatggcctacgagaggccaagttccactgggctgggaaaagtcactttgtctgtcttgttcacctggagcctgacacaccgtaggtactgagtacaaatagcttgatttggctaggcttggctgcagggggacgtgcctaaaagacattccgggcatttgcacttgggaaacttgcctcaccttcaggcttgtggggcctctctatgcccaatgagtccaggcagtcctagcaagtactcaggagagcaggggtgggtgtgacagaggctggctctggattgggggacaacagaaccagagtaactcctcgcctgttgctgctttgcaatgaatttcctttacctttctggaacacaagctgctgtgaaccaaactgatatcaagtgattagctcaccgggccttggttgcttttcaaagatccccttcagccccctgccagagtcactgccccataatcaccatgtcagaagggaccctagggcattcgtgtcctatttatcaatcttcagcaccacctctaagatctctgagagagggtggatcagcctctgtgtaaacaaaaagctgttaggacttgttgcctctcaaggtggactattctgttttctgccaggacactgccattcatgcattgtcagatatttattaaacagcagcaaagtgccagccaatttgtcctggaggaattcatagcctcatggggcaaaagtaaataaacagcttattacaattcaacaa

SEQ ID NO: 2876 - DNA, 2566 bp, Homo sapiens
agttctcaaagcctctttggctcggactgctcccagaggcatccaggctggctaagcgttcttcatctttgggggtcctggaggaatggctgatggaggcgctgattcggcagcgcaaagacttccagaaggcccgggcagagtagccccaggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacagtgagtgagatcattggccgagacctgagtggcttccctgcacctcctggagaagagcctcctgcctga

SEQ ID NO: 2877 - DNA, 5367 bp, Homo sapiens
atgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaaggtgggtgtgggactgggggctgtgagtgtgagtgtgtgcaagagattgctctgcatgtttgctgagggctggagctgggcttttcagagatcgggcatccctggtctctcagggccagttggaggttcccaggaggcatgttcttgatgcctgtggctgcctgaatccaattaactgaattctgaagagtgcatggggtaactgtctcagcctttctcctgtctctgcctctgtcctctgctccaaatcataaaatctcagagctagaagcactttcaagatcattccatccagcgcattcaatttgcaagtttaggcgttgagttccagagagggatggtagcttgctgaggtcccagtcaagcacacttgccattgcctcagctttcccctaaacacggtgtctgtggtcagggttggtgaggaggagctttcctgttttgcctctccttcttcccattggctacacccatctctggccctgctgataccgattcccctgacatttcaggctaagccagcaggaaagggctaggacgggtgcctgggagcccacatggagggagttgggcaagatttgattcggagcaggtgtcaagacgtgttggggaaactgaggcccagtggaatagaagccagtagaggaggaatctagaggcctcctagattaagacctgcctggaatggattgggggtgggtctttggaaaaggaggggacccacctctagcccagtctctcaactgcccctcctttacagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctgttgtgctggaaagctggggacaggttgatggtaataaactgctcaatgaccagtgcttcaggctccagagctctttggagagatgggttggggcagcttactccagccctggcccaaggaggcccagaagttggaaagagatggaatgtggctgggaacattgcatcccaaagagcttctcagtggaggaggctggggaaggcatgagggggctcagaggctccttgactgggaccaggattgggggccagggcttgagtaggcctctccactctcctccttgggggtccagattccttaggagctttgggatgaggcccaggaggctgcatttttccaggtccttagtcttgccaccacacagatgattctgattcatagccaagatgaggacacactgatgtagctgatctctcatttacagaggaggattctaaagttcagagagggaaaggggcttgcctgaggtcacgtagataatcagcagcacattgaacgctgcactcctgggctcctgtccccagcccccattcagacacgctgactcaggaggtccaggcctctaaggcttctctccctggagtgagggtggaggtgagggagagctggcacaagccctccctctggatcctccactcctggggattatgaagatattctggaaagatttgtgcttcagaggtagactgcagaaagcaaacagtctacccagcagctctgaatgtcacctgccctggggcttacagcactatatgagttcctggcctatcctgcaaatatgcccatgctggccttctaaatagctggtacatccatcaccactgacgggcctggcctggaaacctggtttgtcccctgtcttgatggcctacgagaggccaagttccactgggctgggaaaagtcactttgtctgtcttgttcacctggagcctgacacaccgtaggtactgagtacaaatagcttgatttggctaggcttggctgcagggggacgtgcctaaaagacattccgggcatttgcacttgggaaacttgcctcaccttcaggcttgtggggcctctctatgcccaatgagtccaggcagtcctagcaagtactcaggagagcaggggtgggtgtgacagaggctggctctggattgggggacaacagaaccagagtaactcctcgcctgttgctgctttgcaatgaatttcctttacctttctggaacacaagctgctgtgaaccaaactgatatcaagtgattagctcaccgggccttggttgcttttcaaagatccccttcagccccctgccagagtcactgccccataatcaccatgtcagaagggaccctagggcattcgtgtcctatttatcaatcttcagcaccacctctaagatctctgagagagggtggatcagcctctgtgtaaacaaaaagctgttaggacttgttgcctctcaaggtggactattctgttttctgccaggacactgccattcatgcattgtcagatatttattaaacagcagcaaagtgccagccaatttgtcctggaggaattcatagcctcatggggcaaaagtaaataaacagcttattacaattcaacaa

SEQ ID NO: 2878 - DNA, 2707 bp, Homo sapiens
acggttgcgatggcaactggggctcctgccagcgccgtttgggggtttgggaaccgctgctaattgggttcatgtaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaagtgagtgagatcattggccgagacctgagtggcttccctgcacctcctggagaagagcctcctgcctgaaccacgtgaactgtcatcacctg

SEQ ID NO: 2879 - DNA, 3057 bp, Homo sapiens
gaagagaggacagagggagggagggtgggggaggacgaggggcgcgtggttttcccatctcatccctggaggaggggctggagcatccccggcagccaatcagggacaggctgggggggggaccgctttgaagaagtttgggggaaaaaagtttggaaaagtttctataataacgagggggcttctggagggaggcggcagcgacggaggagggggcttctcagagaaagggagggagggagccacccgggtgaagatacagcagcctcctgaactcccccctcccacccaggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctgttgtgctggaaagctggggacaggttgatggtaataaactgctcaatgaccagtg

SEQ ID NO: 2880 - DNA, 2955 bp, Homo sapiens
atgtgtgagtcgcccccagtccagcccagtgcctcaagaaacacgcctccaggcccagccccagctccagcccctctggacccacctctctcaccttaagacccactggatcgggtaccctcggtcctaggatccaggggccagtgggcaaaggcctggcatgcctgcttcaatctcctccatcttcccaggtccaactctgcttttgtcttgtggctcagaaggtctctttgctgaggggcagggagcatagaaggacttgcggcctggccactcaaggaacatagccatctcacctgcttctctctttccccctctccctctgctcctcttcccattttgacagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaagtgagtgagatcattggccgagacctgagtggcttccctgcacctcctggagaagagcctcctgcctga

SEQ ID NO: 2881 - DNA, 1382 bp, Homo sapiens
gggacaccagcctcatgtctactctggaaaatggtggcccgccagatatgggggagggtttaggctgaggacaaaagtcactgggagttaagttttctctgtattgagttgggccagtctctttggaggctcttctgcctttgcccagcccactttgggctttattccaagaaaaacactgtgaactccaggccatgttttctccacaacgggtgcccagttccccaagggattcccttgcaggatatcctttatctttcaccattcccatcccatggtagactgaaaatctagggatgaataaaggatgagacggtggggatttcaatgaggtggccgctctctccctctgccagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacagtgagtgagatcattggccgagacctgagtggcttccctgcacctcctggagaagagcctcctgcctga

SEQ ID NO: 2882 - DNA, 2893 bp, Homo sapiens
aaccgtttagttgctgggatggggcggcgttgggggtgcggccctgaaccggagggatttagagactggagacgcggcctctaagagaggttgaaactgtgtgtgtgtgggagaaaatgataaccaccctcccatctctcctacccgccagcctcgccagtatctcccaccgagtcacgaatctcccatctaactccctctcacacaacccaggcctctccaagcctgactttcccggaaactccagtccaggtcttccttcctcctccagcccaggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggg

SEQ ID NO: 2883 - DNA, 2631 bp, Homo sapiens
atgtgtgagtcgcccccagtccagcccagtgcctcaagaaacacgcctccaggcccagccccagctccagcccctctggacccacctctctcaccttaagacccactggatcgggtaccctcggtcctaggatccaggggccagtgggcaaaggcctggcatgcctgcttcaatctcctccatcttcccaggtccaactctgcttttgtcttgtggctcagaaggtctctttgctgaggggcagggagcatagaaggacttgcggcctggccactcaaggaacatagccatctcacctgcttctctctttccccctctccctctgctcctcttcccattttgacagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacagtgagtgagatcattggccgagacctgagtggcttccctgcacctcctggagaagagcctcctgcctga

SEQ ID NO: 2884 - DNA, 559 bp, Homo sapiens
tttcccatctcatccctggaggaggggctggagcatccccggcagccaatcagggacaggctgggggggggaccgctttgaagaagtttgggggaaaaaagccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctccta

SEQ ID NO: 2885 - DNA, 2506 bp, Homo sapiens
gaagaggaggggaacccacagggtccggaggtttcaggcccctagtaaacctggcaaggatttttagaagagccggagtgggatgctatcgggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacagtgagtgagatcattggccgagacctgagtggcttccctgcacctcctggagaagagcctcctgcctga

SEQ ID NO: 2886 - DNA, 4364 bp, Homo sapiens
gggacaccagcctcatgtctactctggaaaatggtggcccgccagatatgggggagggtttaggctgaggacaaaagtcactgggagttaagttttctctgtattgagttgggccagtctctttggaggctcttctgcctttgcccagcccactttgggctttattccaagaaaaacactgtgaactccaggccatgttttctccacaacgggtgcccagttccccaagggattcccttgcaggatatcctttatctttcaccattcccatcccatggtagactgaaaatctagggatgaataaaggatgagacggtggggatttcaatgaggtggccgctctctccctctgccagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaaggtgggtgtgggactgggggctgtgagtgtgagtgtgtgcaagagattgctctgcatgtttgctgagggctggagctgggcttttcagagatcgggcatccctggtctctcagggccagttggaggttcccaggaggcatgttcttgatgcctgtggctgcctgaatccaattaactgaattctgaagagtgcatggggtaactgtctcagcctttctcctgtctctgcctctgtcctctgctccaaatcataaaatctcagagctagaagcactttcaagatcattccatccagcgcattcaatttgcaagtttaggcgttgagttccagagagggatggtagcttgctgaggtcccagtcaagcacacttgccattgcctcagctttcccctaaacacggtgtctgtggtcagggttggtgaggaggagctttcctgttttgcctctccttcttcccattggctacacccatctctggccctgctgataccgattcccctgacatttcaggctaagccagcaggaaagggctaggacgggtgcctgggagcccacatggagggagttgggcaagatttgattcggagcaggtgtcaagacgtgttggggaaactgaggcccagtggaatagaagccagtagaggaggaatctagaggcctcctagattaagacctgcctggaatggattgggggtgggtctttggaaaaggaggggacccacctctagcccagtctctcaactgcccctcctttacagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctgttgtgctggaaagctggggacaggttgatggtaataaactgctcaatgaccagtgcttcaggctccagagctctttggagagatgggttggggcagcttactccagccctggcccaaggaggcccagaagttggaaagagatggaatgtggctgggaacattgcatcccaaagagcttctcagtggaggaggctggggaaggcatgagggggctcagaggctccttgactgggaccaggattgggggccagggcttgagtaggcctctccactctcctccttgggggtccagattccttaggagctttgggatgaggcccaggaggctgcatttttccaggtccttagtcttgccaccacacagatgattctgattcatagccaagatgaggacacactgatgtagctgatctctcatttacagaggaggattctaaagttcagagagggaaaggggcttgcctgaggtcacgtagataatcagcagcacattgaacgctgcactcctgggctcctgtccccagcccccattcagacacgctgactcaggaggtccaggcctctaaggcttctctccctggagtgagggtggaggtgagggagagctggcacaagccctccctctggatcctccactcctggggattatgaagatattctggaaagatttgtgcttcagaggtagactgcagaaagcaaacagtctacccagcagctctgaatgtcacctgccctggggcttacagcactatatgagttcctggcctatcctgcaaatatgcccatgctggccttctaaatagctggtacatccatcaccactgacgggcctggcctggaaacctggtttgtcccctgtcttgatggcctacgagaggccaagttccactgggctgggaaaagtcactttgtctgtcttgttcacctggagcctgacacaccgtaggtactgagtacaaatagcttgatttggctaggcttggctgcagggggacgtgcctaaaagacattccgggcatttgcacttgggaaacttgcctcaccttcaggcttgtggggcctctctatgcccaatgagtccaggcagtcctagcaagtactcaggagagcaggggtgggtgtgacagaggctggctctggattgggggacaacagaaccagagtaactcctcgcctgttgctgctttgcaatgaatttcctttacctttctggaacacaagctgctgtgaaccaaactgatatcaagtgattagctcaccgggccttggttgcttttcaaagatccccttcagccccctgccagagtcactgccccataatcaccatgtcagaagggaccctagggcattcgtgtcctatttatcaatcttcagcaccacctctaagatctctgagagagggtggatcagcctctgtgtaaacaaaaagctgttaggacttgttgcctctcaaggtggactattctgttttctgccaggacactgccattcatgcattgtcagatatttattaaacagcagcaaagtgccagccaatttgtcctggaggaattcatagcctcatggggcaaaagtaaataaacagcttattacaattcaacaa

SEQ ID NO: 2887 - DNA, 2235 bp, Homo sapiens
ctgtttaaccctctctctgctctgggagcggccccttacatggtgtatgtgactccatggatattactggtttatttgtgtgtctactgctgaggagggctccctcagagccctgtggcagttttcccaaagagggtggggacagaggaggccacccctccatgcccagcccagccagtcctcttccttgcactgctctgcagcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaaggtgggtgtgggactgggggctgtgagtgtgagtgtgtgcaagagattgctctgcatgtttgctgagggctggagctgggcttttcagagatcgggcatccctggtctctcagggccagttggaggttcccaggaggcatgttcttgatgcctgtggctgcctgaatccaattaactgaattctgaagagtgcatggggtaactgtctcagcctttctcctgtctctgcctctgtcctctgctccaaatcataaaatctcagagctagaagcactttcaagatcattccatccagcgcattcaatttgcaagtttaggcgttgagttccagagagggatggtagcttgctgaggtcccagtcaagcacacttgccattgcctcagctttcccctaaacacggtgtctgtggtcagggttggtgaggaggagctttcctgttttgcctctccttcttcccattggctacacccatctctggccctgctgataccgattcccctgacatttcaggctaagccagcaggaaagggctaggacgggtgcctgggagcccacatggagggagttgggcaagatttgattcggagcaggtgtcaagacgtgttggggaaactgaggcccagtggaatagaagccagtagaggaggaatctagaggcctcctagattaagacctgcctggaatggattgggggtgggtctttggaaaaggaggggacccacctctagcccagtctctcaactgcccctcctttacagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctg

SEQ ID NO: 2888 - DNA, 3169 bp, Homo sapiens
cccagtccagcccagtgcctcaagaaacacgcctccaggcccagccccagctccagcccctctggacccacctctctcaccttaagacccactggatcgggtaccctcggtcctaggatccaggggccagtgggcaaaggcctggcatgcctgcttcaatctcctccatcttcccaggtccaactctgcttttgtcttgtggctcagaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctgttgtgctggaaagctggggacaggttgatggtaataaactgctcaatgaccagt

SEQ ID NO: 2889 - DNA, 2830 bp, Homo sapiens
gaagaggaggggaacccacagggtccggaggtttcaggcccctagtaaacctggcaaggatttttagaagagccggagtgggatgctatcgggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaagtgagtgagatcattggccgagacctgagtggcttccctgcacctcctggagaagagcctcctgcctga

SEQ ID NO: 2890 - DNA, 1476 bp, Homo sapiens
ctgtttaaccctctctctgctctgggagcggccccttacatggtgtatgtgactccatggatattactggtttatttgtgtgtctactgctgaggagggctccctcagagccctgtggcagttttcccaaagagggtggggacagaggaggccacccctccatgcccagcccagccagtcctcttccttgcactgctctgcagcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctg

SEQ ID NO: 2891 - DNA, 2509 bp, Homo sapiens
atgtgtgagtcgcccccagtccagcccagtgcctcaagaaacacgcctccaggcccagccccagctccagcccctctggacccacctctctcaccttaagacccactggatcgggtaccctcggtcctaggatccaggggccagtgggcaaaggcctggcatgcctgcttcaatctcctccatcttcccaggtccaactctgcttttgtcttgtggctcagaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacagtgagtgagatcattggccgagacctgagtggcttccctgcacctcctggagaagagcctcctgcctga

SEQ ID NO: 2892 - DNA, 2924 bp, Homo sapiens
atctacgcccatcaagggctgtgggcctagggacagttctcaaagcctctttggctcggactgctcccagaggcatccaggctggctaagcgttcttcatctttgggggtcctggaggaatggctgatggaggcgctgattcggcagcgcaaagacttccagaaggcccgggcagagtagccccaggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaagtgagtgagatcattggccgagacctgagtggcttccctgcacctcctggagaagagcctcctgcctga

SEQ ID NO: 2893 - DNA, 2025 bp, Homo sapiens
gggacaccagcctcatgtctactctggaaaatggtggcccgccagatatgggggagggtttaggctgaggacaaaagtcactgggagttaagttttctctgtattgagttgggccagtctctttggaggctcttctgcctttgcccagcccactttgggctttattccaagaaaaacactgtgaactccaggccatgttttctccacaacgggtgcccagttccccaagggattcccttgcaggatatcctttatctttcaccattcccatcccatggtagactgaaaatctagggatgaataaaggatgagacggtggggatttcaatgaggtggccgctctctccctctgccagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctgttgtgctggaaagctggggacag

SEQ ID NO: 2894 - DNA, 5613 bp, Homo sapiens
atgtgtgagtcgcccccagtccagcccagtgcctcaagaaacacgcctccaggcccagccccagctccagcccctctggacccacctctctcaccttaagacccactggatcgggtaccctcggtcctaggatccaggggccagtgggcaaaggcctggcatgcctgcttcaatctcctccatcttcccaggtccaactctgcttttgtcttgtggctcagaaggtctctttgctgaggggcagggagcatagaaggacttgcggcctggccactcaaggaacatagccatctcacctgcttctctctttccccctctccctctgctcctcttcccattttgacagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaaggtgggtgtgggactgggggctgtgagtgtgagtgtgtgcaagagattgctctgcatgtttgctgagggctggagctgggcttttcagagatcgggcatccctggtctctcagggccagttggaggttcccaggaggcatgttcttgatgcctgtggctgcctgaatccaattaactgaattctgaagagtgcatggggtaactgtctcagcctttctcctgtctctgcctctgtcctctgctccaaatcataaaatctcagagctagaagcactttcaagatcattccatccagcgcattcaatttgcaagtttaggcgttgagttccagagagggatggtagcttgctgaggtcccagtcaagcacacttgccattgcctcagctttcccctaaacacggtgtctgtggtcagggttggtgaggaggagctttcctgttttgcctctccttcttcccattggctacacccatctctggccctgctgataccgattcccctgacatttcaggctaagccagcaggaaagggctaggacgggtgcctgggagcccacatggagggagttgggcaagatttgattcggagcaggtgtcaagacgtgttggggaaactgaggcccagtggaatagaagccagtagaggaggaatctagaggcctcctagattaagacctgcctggaatggattgggggtgggtctttggaaaaggaggggacccacctctagcccagtctctcaactgcccctcctttacagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctgttgtgctggaaagctggggacaggttgatggtaataaactgctcaatgaccagtgcttcaggctccagagctctttggagagatgggttggggcagcttactccagccctggcccaaggaggcccagaagttggaaagagatggaatgtggctgggaacattgcatcccaaagagcttctcagtggaggaggctggggaaggcatgagggggctcagaggctccttgactgggaccaggattgggggccagggcttgagtaggcctctccactctcctccttgggggtccagattccttaggagctttgggatgaggcccaggaggctgcatttttccaggtccttagtcttgccaccacacagatgattctgattcatagccaagatgaggacacactgatgtagctgatctctcatttacagaggaggattctaaagttcagagagggaaaggggcttgcctgaggtcacgtagataatcagcagcacattgaacgctgcactcctgggctcctgtccccagcccccattcagacacgctgactcaggaggtccaggcctctaaggcttctctccctggagtgagggtggaggtgagggagagctggcacaagccctccctctggatcctccactcctggggattatgaagatattctggaaagatttgtgcttcagaggtagactgcagaaagcaaacagtctacccagcagctctgaatgtcacctgccctggggcttacagcactatatgagttcctggcctatcctgcaaatatgcccatgctggccttctaaatagctggtacatccatcaccactgacgggcctggcctggaaacctggtttgtcccctgtcttgatggcctacgagaggccaagttccactgggctgggaaaagtcactttgtctgtcttgttcacctggagcctgacacaccgtaggtactgagtacaaatagcttgatttggctaggcttggctgcagggggacgtgcctaaaagacattccgggcatttgcacttgggaaacttgcctcaccttcaggcttgtggggcctctctatgcccaatgagtccaggcagtcctagcaagtactcaggagagcaggggtgggtgtgacagaggctggctctggattgggggacaacagaaccagagtaactcctcgcctgttgctgctttgcaatgaatttcctttacctttctggaacacaagctgctgtgaaccaaactgatatcaagtgattagctcaccgggccttggttgcttttcaaagatccccttcagccccctgccagagtcactgccccataatcaccatgtcagaagggaccctagggcattcgtgtcctatttatcaatcttcagcaccacctctaagatctctgagagagggtggatcagcctctgtgtaaacaaaaagctgttaggacttgttgcctctcaaggtggactattctgttttctgccaggacactgccattcatgcattgtcagatatttattaaacagcagcaaagtgccagccaatttgtcctggaggaattcatagcctcatggggcaaaagtaaataaacagcttattacaattcaacaa

SEQ ID NO: 2895 - DNA, 856 bp, Homo sapiens
ctgtttaaccctctctctgctctgggagcggccccttacatggtgtatgtgactccatggatattactggtttatttgtgtgtctactgctgaggagggctccctcagagccctgtggcagttttcccaaagagggtggggacagaggaggccacccctccatgcccagcccagccagtcctcttccttgcactgctctgcagcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacagtgagtgagatcattggccgagacctgagtggcttccctgcacctcctggagaagagcctcctgcctga

SEQ ID NO: 2896 - DNA, 4085 bp, Homo sapiens
gtgagagagtgagcgagacagaaagagagagaagtgcaccagcgagccggggcaggaagaggaggtttcgccaccggagcggcccggcgacgcgctgacagcttcccctgcccttcccgtcggtcgggccgccagccgccgcagccctcggcctgcacgcagccaccggccccgctcccggagcccagcgccgccgaggccgcagccgcccggccagtaaggcggcgccgccgcccggccaccgcgcgccctgcgcttccctccgcccgcgctgcggccatggcgcggcgctgactggcctggcccggccccgccgcgctcccgctcgccccgacccgcactcgggcccgcccgggctccggcctgccgccgcctcttccttctccagccggcaggcccgcgccgcttaggagggagagcccacccgcgccaggaggccgaacgcggactcgccacccggcttcagaatggcagaagatgatccatatttgggaaggcctgaacaaatgtttcatttggatccttctttgactcatacaatatttaatccagaagtatttcaaccacagatggcactgccaacagcagatggcccataccttcaaatattagagcaacctaaacagagaggatttcgtttccgttatgtatgtgaaggcccatcccatggtggactacctggtgcctctagtgaaaagaacaagaagtcttaccctcaggtcaaaatctgcaactatgtgggaccagcaaaggttattgttcagttggtcacaaatggaaaaaatatccacctgcatgcccacagcctggtgggaaaacactgtgaggatgggatctgcactgtaactgctggacccaaggacatggtggtcggcttcgcaaacctgggtatacttcatgtgacaaagaaaaaagtatttgaaacactggaagcacgaatgacagaggcgtgtataaggggctataatcctggactcttggtgcaccctgaccttgcctatttgcaagcagaaggtggaggggaccggcagctgggagatcgggaaaaagagctaatccgccaagcagctctgcagcagaccaaggagatggacctcagcgtggtgcggctcatgtttacagcttttcttccggatagcactggcagcttcacaaggcgcctggaacccgtggtatcagacgccatctatgacagtaaagcccccaatgcatccaacttgaaaattgtaagaatggacaggacagctggatgtgtgactggaggggaggaaatttatcttctttgtgacaaagttcagaaagatgacatccagattcgattttatgaagaggaagaaaatggtggagtctgggaaggatttggagatttttcccccacagatgttcatagacaatttgccattgtcttcaaaactccaaagtataaagatattaatattacaaaaccagcctctgtgtttgtccagcttcggaggaaatctgacttggaaactagtgaaccaaaacctttcctctactatcctgaaatcaaagataaagaagaagtgcagaggaaacgtcagaagctcatgcccaatttttcggatagtttcggcggtggtagtggtgctggagctggaggcggaggcatgtttggtagtggcggtggaggagggggcactggaagtacaggtccagggtatagcttcccacactatggatttcctacttatggtgggattactttccatcctggaactactaaatctaatgctgggatgaagcatggaaccatggacactgaatctaaaaaggaccctgaaggttgtgacaaaagtgatgacaaaaacactgtaaacctctttgggaaagttattgaaaccacagagcaagatcaggagcccagcgaggccaccgttgggaatggtgaggtcactctaacgtatgcaacaggaacaaaagaagagagtgctggagttcaggataacctctttctagagaaggctatgcagcttgcaaagaggcatgccaatgcccttttcgactacgcggtgacaggagacgtgaagatgctgctggccgtccagcgccatctcactgctgtgcaggatgagaatggggacagtgtcttacacttagcaatcatccaccttcattctcaacttgtgagggatctactagaagtcacatctggtttgatttctgatgacattatcaacatgagaaatgatctgtaccagacgcccttgcacttggcagtgatcactaagcaggaagatgtggtggaggatttgctgagggctggggccgacctgagccttctggaccgcttgggtaactctgttttgcacctagctgccaaagaaggacatgataaagttctcagtatcttactcaagcacaaaaaggcagcactacttcttgaccaccccaacggggacggtctgaatgccattcatctagccatgatgagcaatagcctgccatgtttgctgctgctggtggccgctggggctgacgtcaatgctcaggagcagaagtccgggcgcacagcactgcacctggctgtggagcacgacaacatctcattggcaggctgcctgctcctggagggtgatgcccatgtggacagtactacctacgatggaaccacacccctgcatatagcagctgggagagggtccaccaggctggcagctcttctcaaagcagcaggagcagatcccctggtggagaactttgagcctctctatgacctggatgactcttgggaaaatgcaggagaggatgaaggagttgtgcctggaaccacgcctctagatatggccaccagctggcaggtatttgacatattaaatgggaaaccatatgagccagagtttacatctgatgatttactagcacaaggagacatgaaacagctggctgaagatgtgaagctgcagctgtataagttactagaaattcctgatccagacaaaaactgggctactctggcgcagaaattaggtctggggatacttaataatgccttccggctgagtcctgctccttccaaaacacttatggacaactatgaggtctctgggggtacagtcagagagctggtggaggccctgagacaaatgggctacaccgaagcaattgaagtgatccaggcagcctccagcccagtgaagaccacctctcaggcccactcgctgcctctctcgcctgcctccacaaggcagcaaatagacgagctccgagacagtgacagtgtctgcgacagcggcgtggagacatccttccgcaaactcagctttaccgagtctctgaccagtggtgcctcactgctaactctcaacaaaatgccccatgattatgggcaggaaggacctctagaaggcaaaatttagcctgctgacaatttcccacaccgtgtaaaccaaagccctaaaattccactgcgttgtccacaagacagaagctgaagtgcatccaaaggtgctcagagagccggcccgcctgaatcattctcgatttaactcgagaccttttcaacttggcttcctttcttggttcataaatgaattttagtttggttcacttacagatagtatctagcaatcacaacactggctgagcggatgcatctggggatgaggttgcttactaagctttgccagctgctgctggatcacagctgctttctgttgtcattgctgttgtccctctgctacgttcctattgtcattaaaggtatcacggtcgccacctggcattccttctgaccacagcatcattttgcattcaaattaagggttaagaaaagagatattttaaaatgagagtcacttgatgtgccattttaaaaaaaaaggcatattgctttttctaatgtggttatttctctgatttgcaaaaaaaaaaaaaaaaaaaatacttgtcaatatttaaacatggttacaatcattgctgaaaatggtattttcccccttttctgcattttgctattgtaaatatgttttttagatcaaatactttaaaggaaaaaatgttggatttataaatgctattttttattttacttttataataaaaggaaaagcaaattgatgacctca

SEQ ID NO: 2897 - DNA, 3693 bp, Homo sapiens
gagagagtgagcgagacagaaagagagagaagtgcaccagcgagccggggcaggaagaggaggtttcgccaccggagcggcccggcgacgcgctgacagcttcccctgcccttcccgtcggtcgggccgccagccgccgcagccctcggcctgcacgcagccaccggccccgctcccggagcccagcgccgccgaggccgcagccgcccggccagtaaggcggcgccgccgcccggccaccgcgcgccctgcgcttccctccgcccgcgctgcggccatggcgcggcgctgactggcctggcccggccccgccgcgctcccgctcgccccgacccgcactcgggcccgcccgggctccggcctgccgccgcctcttccttctccagccggcaggcccgcgccgcttaggagggagagcccacccgcgccaggaggccgaacgcggactcgccacccggcttcagaatggcagaagatgatccatatttgggaaggcctgaacaaatgtttcatttggatccttctttgactcatacaatatttaatccagaagtatttcaaccacagatggcactgccaacagatggcccataccttcaaatattagagcaacctaaacagagaggatttcgtttccgttatgtatgtgaaggcccatcccatggtggactacctggtgcctctagtgaaaagaacaagaagtcttaccctcaggtcaaaatctgcaactatgtgggaccagcaaaggttattgttcagttggtcacaaatggaaaaaatatccacctgcatgcccacagcctggtgggaaaacactgtgaggatgggatctgcactgtaactgctggacccaaggacatggtggtcggcttcgcaaacctgggtatacttcatgtgacaaagaaaaaagtatttgaaacactggaagcacgaatgacagaggcgtgtataaggggctataatcctggactcttggtgcaccctgaccttgcctatttgcaagcagaaggtggaggggaccggcagctgggagatcgggaaaaagagctaatccgccaagcagctctgcagcagaccaaggagatggacctcagcgtggtgcggctcatgtttacagcttttcttccggatagcactggcagcttcacaaggcgcctggaacccgtggtatcagacgccatctatgacagtaaagcccccaatgcatccaacttgaaaattgtaagaatggacaggacagctggatgtgtgactggaggggaggaaatttatcttctttgtgacaaagttcagaaagatgacatccagattcgattttatgaagaggaagaaaatggtggagtctgggaaggatttggagatttttcccccacagatgttcatagacaatttgccattgtcttcaaaactccaaagtataaagatattaatattacaaaaccagcctctgtgtttgtccagcttcggaggaaatctgacttggaaactagtgaaccaaaacctttcctctactatcctgaaatcaaagataaagaagaagtgcagaggaaacgtcagaagctcatgcccaatttttcggatagtttcggcggtggtagtggtgctggagctggaggcggaggcatgtttggtagtggcggtggaggagggggcactggaagtacaggtccagggtatagcttcccacactatggatttcctacttatggtgggattactttccatcctggaactactaaatctaatgctgggatgaagcatggaaccatggacactgaatctaaaaaggaccctgaaggttgtgacaaaagtgatgacaaaaacactgtaaacctctttgggaaagttattgaaaccacagagcaagatcaggagcccagcgaggccaccgttgggaatggtgaggtcactctaacgtatgcaacaggaacaaaagaagagagtgctggagttcaggataacctctttctagagaaggctatgcagcttgcaaagaggcatgccaatgcccttttcgactacgcggtgacaggagacgtgaagatgctgctggccgtccagcgccatctcactgctgtgcaggatgagaatggggacagtgtcttacacttagcaatcatccaccttcattctcaacttgtgagggatctactagaagtcacatctggtttgatttctgatgacattatcaacatgagaaatgatctgtaccagacgcccttgcacttggcagtgatcactaagcaggaagatgtggtggaggatttgctgagggctggggccgacctgagccttctggaccgcttgggtaactctgttttgcacctagctgccaaagaaggacatgataaagttctcagtatcttactcaagcacaaaaaggcagcactacttcttgaccaccccaacggggacggtctgaatgccattcatctagccatgatgagcaatagcctgccatgtttgctgctgctggtggccgctggggctgacgtcaatgctcaggagcagaagtccgggcgcacagcactgcacctggctgtggagcacgacaacatctcattggcaggctgcctgctcctggagggtgatgcccatgtggacagtactacctacgatggaaccacacccctgcatatagcagctgggagagggtccaccaggctggcagctcttctcaaagcagcaggagcagatcccctggtggagaactttgagcctctctatgacctggatgactcttgggaaaatgcaggagaggatgaaggagttgtgcctggaaccacgcctctagatatggccaccagctggcaggtatttgacatattaaatgggaaaccatatgagccagagtttacatctgatgatttactagcacaaggagacatgaaacagctggctgaagatgtgaagctgcagctgtataagttactagaaattcctgatccagacaaaaactgggctactctggcgcagaaattaggtctggggatacttaataatgccttccggctgagtcctgctccttccaaaacacttatggacaactatgaggtctctgggggtacagtcagagagctggtggaggccctgagacaaatgggctacaccgaagcaattgaagtgatccaggcagcctccagcccagtgaagaccacctctcaggcccactcgctgcctctctcgcctgcctccacaaggcagcaaatagacgagctccgagacagtgacagtgtctgcgacagcggcgtggagacatccttccgcaaactcagctttaccgagtctctgaccagtggtgcctcactgctaactctcaacaaaatgccccatgattatgggcaggaaggacctctagaaggcaaaatttagcctgctgacaatttcccacaccgtgtaaaccaaagccctaaaattccactgcgttgtccacaagacagaagctgaagtgcatccaaaggtgctcagagagccggcccgcctgaatcattctcgatttaactcgagaccttttcaacttggcttcctttcttggttcataaatgaattttagtttggttcacttacagatagtatctagcaatcacaacactggctgagcggatgcatctggggatgaggttgcttactaagctttgccagctgctgctggatcacagctgctttctgttgtcattgctgttgtccctctgc

SEQ ID NO: 2898 - DNA, 3707 bp, Homo sapiens
gctaaccgctgggctagaccgtgggaggaggttgacagtagctgagaggcacatgggattagcgacagcggggaaagacacatccggacctcgcaggggctagtcggccgaagggccgcggccgcccggcggtcatttctcttcacgtccctccgcggggcgggaacgcgaaccggaggggaactcttacaaacttttaaaatccccaaccccagccccacctgggggatggtgagaaggttggagtgcgctgcggcgcggaggagagagcttcagaatggcagaagatgatccatatttgggaaggcctgaacaaatgtttcatttggatccttctttgactcatacaatatttaatccagaagtatttcaaccacagatggcactgccaacagatggcccataccttcaaatattagagcaacctaaacagagaggatttcgtttccgttatgtatgtgaaggcccatcccatggtggactacctggtgcctctagtgaaaagaacaagaagtcttaccctcaggtcaaaatctgcaactatgtgggaccagcaaaggttattgttcagttggtcacaaatggaaaaaatatccacctgcatgcccacagcctggtgggaaaacactgtgaggatgggatctgcactgtaactgctggacccaaggacatggtggtcggcttcgcaaacctgggtatacttcatgtgacaaagaaaaaagtatttgaaacactggaagcacgaatgacagaggcgtgtataaggggctataatcctggactcttggtgcaccctgaccttgcctatttgcaagcagaaggtggaggggaccggcagctgggagatcgggaaaaagagctaatccgccaagcagctctgcagcagaccaaggagatggacctcagcgtggtgcggctcatgtttacagcttttcttccggatagcactggcagcttcacaaggcgcctggaacccgtggtatcagacgccatctatgacagtaaagcccccaatgcatccaacttgaaaattgtaagaatggacaggacagctggatgtgtgactggaggggaggaaatttatcttctttgtgacaaagttcagaaagatgacatccagattcgattttatgaagaggaagaaaatggtggagtctgggaaggatttggagatttttcccccacagatgttcatagacaatttgccattgtcttcaaaactccaaagtataaagatattaatattacaaaaccagcctctgtgtttgtccagcttcggaggaaatctgacttggaaactagtgaaccaaaacctttcctctactatcctgaaatcaaagataaagaagaagtgcagaggaaacgtcagaagctcatgcccaatttttcggatagtttcggcggtggtagtggtgctggagctggaggcggaggcatgtttggtagtggcggtggaggagggggcactggaagtacaggtccagggtatagcttcccacactatggatttcctacttatggtgggattactttccatcctggaactactaaatctaatgctgggatgaagcatggaaccatggacactgaatctaaaaaggaccctgaaggttgtgacaaaagtgatgacaaaaacactgtaaacctctttgggaaagttattgaaaccacagagcaagatcaggagcccagcgaggccaccgttgggaatggtgaggtcactctaacgtatgcaacaggaacaaaagaagagagtgctggagttcaggataacctctttctagagaaggctatgcagcttgcaaagaggcatgccaatgcccttttcgactacgcggtgacaggagacgtgaagatgctgctggccgtccagcgccatctcactgctgtgcaggatgagaatggggacagtgtcttacacttagcaatcatccaccttcattctcaacttgtgagggatctactagaagtcacatctggtttgatttctgatgacattatcaacatgagaaatgatctgtaccagacgcccttgcacttggcagtgatcactaagcaggaagatgtggtggaggatttgctgagggctggggccgacctgagccttctggaccgcttgggtaactctgttttgcacctagctgccaaagaaggacatgataaagttctcagtatcttactcaagcacaaaaaggcagcactacttcttgaccaccccaacggggacggtctgaatgccattcatctagccatgatgagcaatagcctgccatgtttgctgctgctggtggccgctggggctgacgtcaatgctcaggagcagaagtccgggcgcacagcactgcacctggctgtggagcacgacaacatctcattggcaggctgcctgctcctggagggtgatgcccatgtggacagtactacctacgatggaaccacacccctgcatatagcagctgggagagggtccaccaggctggcagctcttctcaaagcagcaggagcagatcccctggtggagaactttgagcctctctatgacctggatgactcttgggaaaatgcaggagaggatgaaggagttgtgcctggaaccacgcctctagatatggccaccagctggcaggtatttgacatattaaatgggaaaccatatgagccagagtttacatctgatgatttactagcacaaggagacatgaaacagctggctgaagatgtgaagctgcagctgtataagttactagaaattcctgatccagacaaaaactgggctactctggcgcagaaattaggtctggggatacttaataatgccttccggctgagtcctgctccttccaaaacacttatggacaactatgaggtctctgggggtacagtcagagagctggtggaggccctgagacaaatgggctacaccgaagcaattgaagtgatccaggcagcctccagcccagtgaagaccacctctcaggcccactcgctgcctctctcgcctgcctccacaaggcagcaaatagacgagctccgagacagtgacagtgtctgcgacagcggcgtggagacatccttccgcaaactcagctttaccgagtctctgaccagtggtgcctcactgctaactctcaacaaaatgccccatgattatgggcaggaaggacctctagaaggcaaaatttagcctgctgacaatttcccacaccgtgtaaaccaaagccctaaaattccactgcgttgtccacaagacagaagctgaagtgcatccaaaggtgctcagagagccggcccgcctgaatcattctcgatttaactcgagaccttttcaacttggcttcctttcttggttcataaatgaattttagtttggttcacttacagatagtatctagcaatcacaacactggctgagcggatgcatctggggatgaggttgcttactaagctttgccagctgctgctggatcacagctgctttctgttgtcattgctgttgtccctctgctacgttcctattgtcattaaaggtatcacggtcgccacctggcattccttctgaccacagcatcattttgcattcaaattaagggttaagaaaagagatattttaaaatgagagtcacttgatgtgccattttaaaaaaaaaggcatattgctttttctaatgtggttatttctctgatttgcaaaaaaaaaaaaaaaaaaa

SEQ ID NO: 2899 - DNA, 557 bp, Homo sapiens
ggacaaacttgaacacaaaggaacacacgttatatgtacatttaatactggaaccgaaaagctgcttgcagtgaaaagcaaaccacttctaaactctttgagactttttaaagaagcttcagaatggcagaagatgatccatatttgggaaggcctgaacaaatgtttcatttggatccttctttgactcatacaatatttaatccagaagtatttcaaccacagatggcactgccaacagcagatggcccataccttcaaatattagagcaacctaaacagagaggatttcgtttccgttatgtatgtgaaggcccatcccatggtggactacctggtgcctctagtgaaaagaacaagaagtcttaccctcaggtcaaaatctgcaactatgtgggaccagcaaaggttattgttcagttggtcacaaatggaaaaaatatccacctgcatgcccacagcctggtgggaaaacactgtgaggatgggatctgcactgtaactgctggacccaaggacatggtggtcggcttcgcaaacctgggtatacttcatgt

SEQ ID NO: 2900 - DNA, 609 bp, Homo sapiens
ggccgccagccgccgcagccctcggcctgcacgcagccaccggccccgctcccggagcccagcgccgccgaggccgcagccgcccggccagtaaggcggcgccgccgcccggccaccgcgcgccctgcgcttccctccgcccgcgctgcggccatggcgcggcgctgactggcctggcccggccccgccgcgctcccgctcgccccgacccgcactcgggcccgcccgggctccggcctgccgccgcctcttccttctccagccggcaggcccgcgccgcttaggagggagagcccacccgcgccaggaggccgaacgcggactcgccacccggaaggaacacaacgtcctacatcaagaaaaaagacagaagcatatcttggagatatgaaaagaaccaccagcttcagaatggcagaagatgatccatatttgggaaggcctgaacaaatgtttcatttggatccttctttgactcatacaatatttaatccagaagtatttcaaccacagatggcactgccaacagatggcccataccttcaaatattagagcaacctaaacagagaggatttcgtttccgttatgtatgtgaaggcccatcccat

SEQ ID NO: 2901 - DNA, 1558 bp, Homo sapiens
gcagtccgtgccgccgtcccgcccgccagcgccccagcgaggaagcagcgcgcagcccgcggcccagcgcacccgcagcagcgcccgcagctcgtccgcgccatgttccaggcggccgagcgcccccaggagtgggccatggagggcccccgcgacgggctgaagaaggagcggctactggacgaccgccacgacagcggcctggactccatgaaagacgaggagtacgagcagatggtcaaggagctgcaggagatccgcctcgagccgcaggaggtgccgcgcggctcggagccctggaagcagcagctcaccgaggacggggactcgttcctgcacttggccatcatccatgaagaaaaggcactgaccatggaagtgatccgccaggtgaagggagacctggccttcctcaacttccagaacaacctgcagcagactccactccacttggctgtgatcaccaaccagccagaaattgctgaggcacttctgggagctggctgtgatcctgagctccgagactttcgaggaaatacccccctacaccttgcctgtgagcagggctgcctggccagcgtgggagtcctgactcagtcctgcaccaccccgcacctccactccatcctgaaggctaccaactacaatggccacacgtgtctacacttagcctctatccatggctacctgggcatcgtggagcttttggtgtccttgggtgctgatgtcaatgctcaggagccctgtaatggccggactgcccttcacctcgcagtggacctgcaaaatcctgacctggtgtcactcctgttgaagtgtggggctgatgtcaacagagttacctaccagggctattctccctaccagctcacctggggccgcccaagcacccggatacagcagcagctgggccagctgacactagaaaaccttcagatgctgccagagagtgaggatgaggagagctatgacacagagtcagagttcacggagttcacagaggacgagctgccctatgatgactgtgtgtttggaggccagcgtctgacgttatgagcgcaaaggggctgaaagaacatggacttgtatatttgtacaaaaaaaaagttttatttttctaaaaaaagaaaaaagaagaaaaaatttaaagggtgtacttatatccacactgcacactgcctggcccaaaacgtcttattgtggtaggatcagccctcattttgttgcttttgtgaactttttgtaggggacgagaaagatcattgaaattctgagaaaacttcttttaaacctcacctttgtggggtttttggagaaggttatcaaaaatttcatggaaggaccacattttatatttattgtgcttcgagtgactgaccccagtggtatcctgtgacatgtaacagccaggagtgttaagcgttcagtgatgtggggtgaaaagttactacctgtcaaggtttgtgttaccctcctgtaaatggtgtacataatgtattgttggtaattattttggtacttttatgatgtatatttattaaacagatttttacaaatg

SEQ ID NO: 2902 - DNA, 7556 bp, Homo sapiens
gcaggcgccttcgcggaccgagcctgacggagccggaggctgggagccgcggcggcctggggaagtgtttggattgtgagctatttcagaactgttctcaggactcattattttaacatttgggagaaacacagccagaagatgcacacttgactgaaggaggacagggaatctgaagactccggatgacatcagagctacttttcaacagccttctcaattttctttctcagaaagcagaggctcagagcttggagacagacgaacactgatatttgcatttaatggggaacaaaagatgaagaaggaaaaggaatatattcactaaggattctatctgcttactgctacagacctatgtgttaaggaattcttctcctcctccttgcgtagaagttgatcagcactgtggtcagactgcatttatcttgtcattgccagaagaaatcttggacagaatgtaacagtacgtctctctctgattgcgatggaaggtgataaactgatactcctttattaaagttacatcgcactcaccacagaaaaccattctttaaagtgaatagaaaccaagcccttgtgaacacttctattgaacatgactcatggagaagagcttggctctgatgtgcaccaggattctattgttttaacttacctagaaggattactaatgcatcaggcagcagggggatcaggtactgccgttgacaaaaagtctgctgggcataatgaagaggatcagaactttaacatttctggcagtgcatttcccacctgtcaaagtaatggtccagttctcaatacacatacatatcaggggtctggcatgctgcacctcaaaaaagccagactgttgcagtcttctgaggactggaatgcagcaaagcggaagaggctgtctgattctatcatgaatttaaacgtaaagaaggaagctttgctagctggcatggttgacagtgtgcctaaaggcaaacaggatagcacattactggcctctttgcttcagtcattcagctctaggctgcagactgttgctctgtcacaacaaatcaggcagagcctcaaggagcaaggatatgccctcagtcatgattctttaaaagtggagaaggatttaaggtgctatggtgttgcatcaagtcacttaaaaactttgttgaagaaaagtaaagttaaagatcaaaagcctgatacgaatcttcctgatgtgactaaaaacctcatcagagataggtttgcagagtctcctcatcatgttggacaaagtggaacaaaggtcatgagtgaaccgttgtcatgtgctgcaagattacaggctgttgcaagcatggtggaaaaaagggctagtcctgccacctcacctaaacctagtgttgcttgtagccagttagcattacttctgtcaagcgaagcccatttgcagcagtattctcgagaacacgctttaaaaacgcaaaatgcaaatcaagcagcaagtgaaagacttgctgctatggccagattgcaagaaaatggccagaaggatgttggcagttaccagctcccaaaaggaatgtcaagccatcttaatggtcaggcaagaacatcatcaagcaaactgatggctagcaaaagtagtgctacagtgtttcaaaatccaatgggtatcattccttcttcccctaaaaatgcaggttataagaactcactggaaagaaacaatataaaacaagctgctaacaatagtttgcttttacatcttcttaaaagccagactatacctaagccaatgaatggacacagtcacagtgagagaggaagcatttttgaggaaagtagtacacctacaactattgatgaatattcagataacaatcctagttttacagatgacagcagtggtgatgaaagttcttattccaactgtgttcccatagacttgtcttgcaaacaccgaactgaaaaatcagaatctgaccaacctgtttccctggataacttcactcaatccttgctaaacacttgggatccaaaagtcccagatgtagatatcaaagaagatcaagatacctcaaagaattctaagctaaactcacaccagaaagtaacacttcttcaattgctacttggccataagaatgaagaaaatgtagaaaaaaacaccagccctcagggagtacacaatgatgtgagcaagttcaatacacaaaattatgcaaggacttctgtgatagaaagccccagtacaaatcggactactccagtgagcactccacctttacttacatcaagcaaagcagggtctcccatcaatctctctcaacactctctggtcatcaaatggaattccccaccatatgtctgcagtactcagtctgaaaagctaacaaatactgcatctaaccactcaatggaccttacaaaaagcaaagacccaccaggagagaaaccagcccaaaatgaaggtgcacagaactctgcaacgtttagtgccagtaagctgttacaaaatttagcacaatgtggaatgcagtcatccatgtcagtggaagagcagagacccagcaaacagctgttaactggaaacacagataaaccgataggtatgattgatagattaaatagccctttgctctcaaataaaacaaatgcagttgaagaaaataaagcatttagtagtcaaccaacaggtcctgaaccagggctttctggttctgaaatagaaaatctgcttgaaagacgtactgtcctccagttgctcctggggaaccccaacaaagggaagagtgaaaaaaaagagaaaactcccttaagagatgaaagtactcaggaacactcagagagagctttaagtgaacaaatactgatggtgaaaataaaatctgagccttgtgatgacttacaaattcctaacacaaatgtgcacttgagccatgatgctaagagtgccccattcttgggtatggctcctgctgtgcagagaagcgcacctgccttaccagtgtccgaagactttaaatcggagcctgtttcacctcaggatttttctttctccaagaatggtctgctaagtcgattgctaagacaaaatcaagatagttacctggcagatgattcagacaggagtcacagaaataatgaaatggcacttctagaatcaaagaatctttgcatggtccctaagaaaaggaagctttatactgagccattagaaaatccatttaaaaagatgaaaaacaacattgttgatgctgcaaacaatcacagtgccccagaagtactgtatgggtccttgcttaaccaggaagagctgaaatttagcagaaatgatcttgaatttaaatatcctgctggtcatggctcagccagcgaaagtgaacacaggagttgggccagagagagcaaaagctttaatgttctgaaacagctgcttctctcagaaaactgtgtgcgagatttgtccccgcacagaagtaactctgtggctgacagtaaaaagaaaggacacaaaaataatgtgaccaacagcaaacctgaatttagcatttcttctttaaatggactgatgtacagttccactcagcccagcagttgcatggataacaggacattttcatacccaggtgtagtaaaaactcctgtgagtcctactttccctgagcacttgggctgtgcagggtctagaccagaatctgggcttttgaatgggtgttccatgcccagtgagaaaggacccattaagtgggttatcactgatgcggagaagaatgagtatgaaaaagactctccaagattgaccaaaaccaacccaatactatattacatgcttcaaaaaggaggcaattctgttaccagtcgagaaacacaagacaaggacatttggagggaggcttcatctgctgaaagtgtctcacaggtcacagccaaagaagagttacttcctactgcagaaacgaaagcttctttctttaatttaagaagcccttacaatagccatatgggaaataatgcttctcgcccacacagcgcaaatggagaagtttatggacttctgggaagcgtgctaacgataaagaaagaatcagaataaaatgtacctgccatccagttttggatctttttaaaactaatgagtatgaacttgagatctgtataaataagagcatgatttgaaaaaaagcatggtataattgaaacttttttcattttgaaaagtattggttactggtgatgttgaaatatgcatactaatttttgcttaacattagatgtcatgaggaaactactgaactagcaattggttgtttaacacttctgtatgcatcagataacaactgtgagtagcctatgaatgaaattcttttataaatattaggcataaattaaaatgtaaaactccattcatagtggattaatgcattttgctgcctttattagggtactttattttgcttttcagaagtcagcctacataacacatttttaaagtctaaactgttaaacaactctttaaaggataattatccaataaaaaaaaacctagtgctgattcacagcttattatccaattcaaaaataaattagaaaaatatatgcttacatttttcacttttgctaaaaagaaaaaaaaaaggtgtttatttttaactcttggaagaggttttgtggttcccaatgtgtctgtcccaccctgatccttttcaatatatatttctttaaaccttgtgctacttagtaaaaattgattacaattgagggaagtttgatagatcctttaaaaaaaaggcagatttccattttttgtattttaactactttactaaattaatactcctccttttacagaattagaaaagttaacatttatctttaggtggtttcctgaaaagttgaatatttaagaaattgtttttaacagaagcaaaatggcttttctttggacagttttcaccatctcttgtaaaagttaattctcaccattcctgtggtacctgcgagtgttatgaccaggattccttaaacctgaactcagaccacttgcattagaaccatctggagcacttgttttaaaatgcagattcataggcagcatctcagatctacagaacaagaatctctgctaagtggacctggaatcttccatctgcatcttaacatgctctctaggtgtttcttgtgtttgagaaccatgacttatgactttcctcagaacatgagactgtaaaacaaaaacaaaaaactatgtgatgcctctattttccccaatacagtcacacatcagctcaaaatttgcaatattgtagttcatatattaccgttatgtctttggaaatcgggttcagaacactttttatgacaaaaattgggtggaggggataactttcatatctggctcaacatctcaggaaaatctgtgattatttgtgtgttctaatgagtaacatctacttagttagccttagggatggaaaaacagggccacttaccaaactcaggtgattccaggatggtttggaaacttctcctgaatgcatccttaacctttattaaaaccattgtcctaagaacaatgccaacaaagcttacaacatttagtttaaacccaagaagggcactaaactcagattgactaaataaaaagtacaaagggcacatatacgtgacagaattgtacacaatcactccattggatcttttactttaaagtagtgatgaaaagtacatgttgatactgtcttagaagaaattaatatattagtgaagccacatggggtttcagttgcgaaacaggtctgtttttatgttcagtttgtacaatccacaattcattcaccagatattttgttcttaattgtgaaccaggttagcaaatgacctatcaaaaattattctataatcactactagttaggatattgatttaaaattgttctacttgaagtggtttctaagatttttatattaaaaataggtgtgatttcctaatatgatctaaaaccctaaatggttatttttcctcagaatgatttgtaaatagctactggaaatattatacagtaataggagtgggtattatgcaacatcatggagaagtgaaggcataggcttattctgacataaaattccactggccagttgaatatattctattccatgtccatactatgacaatcttattgtcaacactatataaataagcttttaaacaagtcatttttcttgatcgttgtggaaggtttggagccttagaggtatgtcagaaaaaatatgttggtattctcccttgggtagggggaaatgacctttttacaagagagtgaaatttaggtcagggaaaagaccaagggccagcattgctacttttgtgtgtgtgtgtgtgggttttgttttgtttttttggttggctggttgttttcgttgttgttaacaaaggaatgagaatatgtaatacttaaataaacatgaccacgaagaatgctgttctgatttactagagaatgttcccaatttgaatttagggtgattttaaagaacagtgagaaagggcatacatccacagattcactttgtttatgcatatgtagatacaaggatgcacatatacacattttcaaggactattttagatatctagacaatttcttctaataaagtcatttgtgaaagggtactacagcttattgacatcagtaaggtagcattcattacctgtttattctctgctgcatcttacagaagagtaaactggtgagagtatatattttatatatatatatatatatatatatataatatgtatatatatatatattgacttgttacatgaagatgttaaaatcggtttttaaaggtgatgtaaatagtgatttccttaatgaaaaatacatattttgtattgttctaatgcaacagaaaagccttttaatctctttggttcctgtatattccatgtataagtgtaaatataatcagacaggtttaaaagttgtgcatgtatgtatacagttgcaagtctggacaaatgtatagaataaaccttttatttaagttgtgattacctgctgcatgaaaagtgcatgggggaccctgtgcatctgtgcatttggcaaaatgtcttaacaaatcagatcagatgttcatcctaacatgacagtattccatttctggacatgacgtctgtggtttaagctttgtgaaagaatgtgctttgattcgaagggtcttaaagaatttttttaatcgtcaaccacttttaaacataaagaattcacacaactactttcatgaattttttaatcccattgcaaacattattccaagagtatcccagtattagcaatactggaatataggcacattaccattcatagtaagaattctggtgtttacacaaccaaatttgatgcgatctgctcagtaatataatttgccatttttattagaaatttaatttcttcatgtgatgtcatgaaactgtacatactgcagtgtgaatttttttgttttgttttttaatcttttagtgtttacttcctgcagtgaatttgaataaatgagaaaaaatgcattgtc

SEQ ID NO: 2903 - DNA, 7562 bp, Homo sapiens
cgacccggccccacgcccgcccgccacccgcgcgcgcccgtccgcccgtggcctcgcgtccgccgctgcgccgtgagcgccgctggtcggagggaagagctcgccggggcgccgggccaggacggggcggcaggcgccttcgcggaccgagcctgacggagccggaggctgggagccgcggcggcctggggaagtgtttggattgtgagctatttcagaactgttctcaggactcattattttaacatttgggagaaacacagccagaagaacactgatatttgcatttaatggggaacaaaagatgaagaaggaaaaggaatatattcactaaggattctatctgcttactgctacagacctatgtgttaaggaattcttctcctcctccttgcgtagaagttgatcagcactgtggtcagactgcatttatcttgtcattgccagaagaaatcttggacagaatgtaacagtacgtctctctctgattgcgatggaaggtgataaactgatactcctttattaaagttacatcgcactcaccacagaaaaccattctttaaagtgaatagaaaccaagcccttgtgaacacttctattgaacatgactcatggagaagagcttggctctgatgtgcaccaggattctattgttttaacttacctagaaggattactaatgcatcaggcagcagggggatcaggtactgccgttgacaaaaagtctgctgggcataatgaagaggatcagaactttaacatttctggcagtgcatttcccacctgtcaaagtaatggtccagttctcaatacacatacatatcaggggtctggcatgctgcacctcaaaaaagccagactgttgcagtcttctgaggactggaatgcagcaaagcggaagaggctgtctgattctatcatgaatttaaacgtaaagaaggaagctttgctagctggcatggttgacagtgtgcctaaaggcaaacaggatagcacattactggcctctttgcttcagtcattcagctctaggctgcagactgttgctctgtcacaacaaatcaggcagagcctcaaggagcaaggatatgccctcagtcatgattctttaaaagtggagaaggatttaaggtgctatggtgttgcatcaagtcacttaaaaactttgttgaagaaaagtaaagttaaagatcaaaagcctgatacgaatcttcctgatgtgactaaaaacctcatcagagataggtttgcagagtctcctcatcatgttggacaaagtggaacaaaggtcatgagtgaaccgttgtcatgtgctgcaagattacaggctgttgcaagcatggtggaaaaaagggctagtcctgccacctcacctaaacctagtgttgcttgtagccagttagcattacttctgtcaagcgaagcccatttgcagcagtattctcgagaacacgctttaaaaacgcaaaatgcaaatcaagcagcaagtgaaagacttgctgctatggccagattgcaagaaaatggccagaaggatgttggcagttaccagctcccaaaaggaatgtcaagccatcttaatggtcaggcaagaacatcatcaagcaaactgatggctagcaaaagtagtgctacagtgtttcaaaatccaatgggtatcattccttcttcccctaaaaatgcaggttataagaactcactggaaagaaacaatataaaacaagctgctaacaatagtttgcttttacatcttcttaaaagccagactatacctaagccaatgaatggacacagtcacagtgagagaggaagcatttttgaggaaagtagtacacctacaactattgatgaatattcagataacaatcctagttttacagatgacagcagtggtgatgaaagttcttattccaactgtgttcccatagacttgtcttgcaaacaccgaactgaaaaatcagaatctgaccaacctgtttccctggataacttcactcaatccttgctaaacacttgggatccaaaagtcccagatgtagatatcaaagaagatcaagatacctcaaagaattctaagctaaactcacaccagaaagtaacacttcttcaattgctacttggccataagaatgaagaaaatgtagaaaaaaacaccagccctcagggagtacacaatgatgtgagcaagttcaatacacaaaattatgcaaggacttctgtgatagaaagccccagtacaaatcggactactccagtgagcactccacctttacttacatcaagcaaagcagggtctcccatcaatctctctcaacactctctggtcatcaaatggaattccccaccatatgtctgcagtactcagtctgaaaagctaacaaatactgcatctaaccactcaatggaccttacaaaaagcaaagacccaccaggagagaaaccagcccaaaatgaaggtgcacagaactctgcaacgtttagtgccagtaagctgttacaaaatttagcacaatgtggaatgcagtcatccatgtcagtggaagagcagagacccagcaaacagctgttaactggaaacacagataaaccgataggtatgattgatagattaaatagccctttgctctcaaataaaacaaatgcagttgaagaaaataaagcatttagtagtcaaccaacaggtcctgaaccagggctttctggttctgaaatagaaaatctgcttgaaagacgtactgtcctccagttgctcctggggaaccccaacaaagggaagagtgaaaaaaaagagaaaactcccttaagagatgaaagtactcaggaacactcagagagagctttaagtgaacaaatactgatggtgaaaataaaatctgagccttgtgatgacttacaaattcctaacacaaatgtgcacttgagccatgatgctaagagtgccccattcttgggtatggctcctgctgtgcagagaagcgcacctgccttaccagtgtccgaagactttaaatcggagcctgtttcacctcaggatttttctttctccaagaatggtctgctaagtcgattgctaagacaaaatcaagatagttacctggcagatgattcagacaggagtcacagaaataatgaaatggcacttctagaatcaaagaatctttgcatggtccctaagaaaaggaagctttatactgagccattagaaaatccatttaaaaagatgaaaaacaacattgttgatgctgcaaacaatcacagtgccccagaagtactgtatgggtccttgcttaaccaggaagagctgaaatttagcagaaatgatcttgaatttaaatatcctgctggtcatggctcagccagcgaaagtgaacacaggagttgggccagagagagcaaaagctttaatgttctgaaacagctgcttctctcagaaaactgtgtgcgagatttgtccccgcacagaagtaactctgtggctgacagtaaaaagaaaggacacaaaaataatgtgaccaacagcaaacctgaatttagcatttcttctttaaatggactgatgtacagttccactcagcccagcagttgcatggataacaggacattttcatacccaggtgtagtaaaaactcctgtgagtcctactttccctgagcacttgggctgtgcagggtctagaccagaatctgggcttttgaatgggtgttccatgcccagtgagaaaggacccattaagtgggttatcactgatgcggagaagaatgagtatgaaaaagactctccaagattgaccaaaaccaacccaatactatattacatgcttcaaaaaggaggcaattctgttaccagtcgagaaacacaagacaaggacatttggagggaggcttcatctgctgaaagtgtctcacaggtcacagccaaagaagagttacttcctactgcagaaacgaaagcttctttctttaatttaagaagcccttacaatagccatatgggaaataatgcttctcgcccacacagcgcaaatggagaagtttatggacttctgggaagcgtgctaacgataaagaaagaatcagaataaaatgtacctgccatccagttttggatctttttaaaactaatgagtatgaacttgagatctgtataaataagagcatgatttgaaaaaaagcatggtataattgaaacttttttcattttgaaaagtattggttactggtgatgttgaaatatgcatactaatttttgcttaacattagatgtcatgaggaaactactgaactagcaattggttgtttaacacttctgtatgcatcagataacaactgtgagtagcctatgaatgaaattcttttataaatattaggcataaattaaaatgtaaaactccattcatagtggattaatgcattttgctgcctttattagggtactttattttgcttttcagaagtcagcctacataacacatttttaaagtctaaactgttaaacaactctttaaaggataattatccaataaaaaaaaacctagtgctgattcacagcttattatccaattcaaaaataaattagaaaaatatatgcttacatttttcacttttgctaaaaagaaaaaaaaaaggtgtttatttttaactcttggaagaggttttgtggttcccaatgtgtctgtcccaccctgatccttttcaatatatatttctttaaaccttgtgctacttagtaaaaattgattacaattgagggaagtttgatagatcctttaaaaaaaaggcagatttccattttttgtattttaactactttactaaattaatactcctccttttacagaattagaaaagttaacatttatctttaggtggtttcctgaaaagttgaatatttaagaaattgtttttaacagaagcaaaatggcttttctttggacagttttcaccatctcttgtaaaagttaattctcaccattcctgtggtacctgcgagtgttatgaccaggattccttaaacctgaactcagaccacttgcattagaaccatctggagcacttgttttaaaatgcagattcataggcagcatctcagatctacagaacaagaatctctgctaagtggacctggaatcttccatctgcatcttaacatgctctctaggtgtttcttgtgtttgagaaccatgacttatgactttcctcagaacatgagactgtaaaacaaaaacaaaaaactatgtgatgcctctattttccccaatacagtcacacatcagctcaaaatttgcaatattgtagttcatatattaccgttatgtctttggaaatcgggttcagaacactttttatgacaaaaattgggtggaggggataactttcatatctggctcaacatctcaggaaaatctgtgattatttgtgtgttctaatgagtaacatctacttagttagccttagggatggaaaaacagggccacttaccaaactcaggtgattccaggatggtttggaaacttctcctgaatgcatccttaacctttattaaaaccattgtcctaagaacaatgccaacaaagcttacaacatttagtttaaacccaagaagggcactaaactcagattgactaaataaaaagtacaaagggcacatatacgtgacagaattgtacacaatcactccattggatcttttactttaaagtagtgatgaaaagtacatgttgatactgtcttagaagaaattaatatattagtgaagccacatggggtttcagttgcgaaacaggtctgtttttatgttcagtttgtacaatccacaattcattcaccagatattttgttcttaattgtgaaccaggttagcaaatgacctatcaaaaattattctataatcactactagttaggatattgatttaaaattgttctacttgaagtggtttctaagatttttatattaaaaataggtgtgatttcctaatatgatctaaaaccctaaatggttatttttcctcagaatgatttgtaaatagctactggaaatattatacagtaataggagtgggtattatgcaacatcatggagaagtgaaggcataggcttattctgacataaaattccactggccagttgaatatattctattccatgtccatactatgacaatcttattgtcaacactatataaataagcttttaaacaagtcatttttcttgatcgttgtggaaggtttggagccttagaggtatgtcagaaaaaatatgttggtattctcccttgggtagggggaaatgacctttttacaagagagtgaaatttaggtcagggaaaagaccaagggccagcattgctacttttgtgtgtgtgtgtgtgggttttgttttgtttttttggttggctggttgttttcgttgttgttaacaaaggaatgagaatatgtaatacttaaataaacatgaccacgaagaatgctgttctgatttactagagaatgttcccaatttgaatttagggtgattttaaagaacagtgagaaagggcatacatccacagattcactttgtttatgcatatgtagatacaaggatgcacatatacacattttcaaggactattttagatatctagacaatttcttctaataaagtcatttgtgaaagggtactacagcttattgacatcagtaaggtagcattcattacctgtttattctctgctgcatcttacagaagagtaaactggtgagagtatatattttatatatatatatatatatatatatataatatgtatatatatatatattgacttgttacatgaagatgttaaaatcggtttttaaaggtgatgtaaatagtgatttccttaatgaaaaatacatattttgtattgttctaatgcaacagaaaagccttttaatctctttggttcctgtatattccatgtataagtgtaaatataatcagacaggtttaaaagttgtgcatgtatgtatacagttgcaagtctggacaaatgtatagaataaaccttttatttaagttgtgattacctgctgcatgaaaagtgcatgggggaccctgtgcatctgtgcatttggcaaaatgtcttaacaaatcagatcagatgttcatcctaacatgacagtattccatttctggacatgacgtctgtggtttaagctttgtgaaagaatgtgctttgattcgaagggtcttaaagaatttttttaatcgtcaaccacttttaaacataaagaattcacacaactactttcatgaattttttaatcccattgcaaacattattccaagagtatcccagtattagcaatactggaatataggcacattaccattcatagtaagaattctggtgtttacacaaccaaatttgatgcgatctgctcagtaatataatttgccatttttattagaaatttaatttcttcatgtgatgtcatgaaactgtacatactgcagtgtgaatttttttgttttgttttttaatcttttagtgtttacttcctgcagtgaatttgaataaatgagaaaaaatgcattgtc

SEQ ID NO: 2904 - DNA, 7671 bp, Homo sapiens
agacattgcagcagagccccgaactcgggaggcggcggcggaggaggcggcggcgaggcgcagggacgacccggccccacgcccgcccgccacccgcgcgcgcccgtccgcccgtggcctcgcgtccgccgctgcgccgtgagcgccgctggtcggagggaagagctcgccggggcgccgggccaggacggggcggcaggcgccttcgcggaccgagcctgacggagccggaggctgggagccgcggcggcctgggatgcacacttgactgaaggaggacagggaatctgaagactccggatgacatcagagctacttttcaacagccttctcaattttctttctcagaaagcagaggctcagagcttggagacagacgaacactgatatttgcatttaatggggaacaaaagatgaagaaggaaaaggaatatattcactaaggattctatctgcttactgctacagacctatgtgttaaggaattcttctcctcctccttgcgtagaagttgatcagcactgtggtcagactgcatttatcttgtcattgccagaagaaatcttggacagaatgtaacagtacgtctctctctgattgcgatggaaggtgataaactgatactcctttattaaagttacatcgcactcaccacagaaaaccattctttaaagtgaatagaaaccaagcccttgtgaacacttctattgaacatgactcatggagaagagcttggctctgatgtgcaccaggattctattgttttaacttacctagaaggattactaatgcatcaggcagcagggggatcaggtactgccgttgacaaaaagtctgctgggcataatgaagaggatcagaactttaacatttctggcagtgcatttcccacctgtcaaagtaatggtccagttctcaatacacatacatatcaggggtctggcatgctgcacctcaaaaaagccagactgttgcagtcttctgaggactggaatgcagcaaagcggaagaggctgtctgattctatcatgaatttaaacgtaaagaaggaagctttgctagctggcatggttgacagtgtgcctaaaggcaaacaggatagcacattactggcctctttgcttcagtcattcagctctaggctgcagactgttgctctgtcacaacaaatcaggcagagcctcaaggagcaaggatatgccctcagtcatgattctttaaaagtggagaaggatttaaggtgctatggtgttgcatcaagtcacttaaaaactttgttgaagaaaagtaaagttaaagatcaaaagcctgatacgaatcttcctgatgtgactaaaaacctcatcagagataggtttgcagagtctcctcatcatgttggacaaagtggaacaaaggtcatgagtgaaccgttgtcatgtgctgcaagattacaggctgttgcaagcatggtggaaaaaagggctagtcctgccacctcacctaaacctagtgttgcttgtagccagttagcattacttctgtcaagcgaagcccatttgcagcagtattctcgagaacacgctttaaaaacgcaaaatgcaaatcaagcagcaagtgaaagacttgctgctatggccagattgcaagaaaatggccagaaggatgttggcagttaccagctcccaaaaggaatgtcaagccatcttaatggtcaggcaagaacatcatcaagcaaactgatggctagcaaaagtagtgctacagtgtttcaaaatccaatgggtatcattccttcttcccctaaaaatgcaggttataagaactcactggaaagaaacaatataaaacaagctgctaacaatagtttgcttttacatcttcttaaaagccagactatacctaagccaatgaatggacacagtcacagtgagagaggaagcatttttgaggaaagtagtacacctacaactattgatgaatattcagataacaatcctagttttacagatgacagcagtggtgatgaaagttcttattccaactgtgttcccatagacttgtcttgcaaacaccgaactgaaaaatcagaatctgaccaacctgtttccctggataacttcactcaatccttgctaaacacttgggatccaaaagtcccagatgtagatatcaaagaagatcaagatacctcaaagaattctaagctaaactcacaccagaaagtaacacttcttcaattgctacttggccataagaatgaagaaaatgtagaaaaaaacaccagccctcagggagtacacaatgatgtgagcaagttcaatacacaaaattatgcaaggacttctgtgatagaaagccccagtacaaatcggactactccagtgagcactccacctttacttacatcaagcaaagcagggtctcccatcaatctctctcaacactctctggtcatcaaatggaattccccaccatatgtctgcagtactcagtctgaaaagctaacaaatactgcatctaaccactcaatggaccttacaaaaagcaaagacccaccaggagagaaaccagcccaaaatgaaggtgcacagaactctgcaacgtttagtgccagtaagctgttacaaaatttagcacaatgtggaatgcagtcatccatgtcagtggaagagcagagacccagcaaacagctgttaactggaaacacagataaaccgataggtatgattgatagattaaatagccctttgctctcaaataaaacaaatgcagttgaagaaaataaagcatttagtagtcaaccaacaggtcctgaaccagggctttctggttctgaaatagaaaatctgcttgaaagacgtactgtcctccagttgctcctggggaaccccaacaaagggaagagtgaaaaaaaagagaaaactcccttaagagatgaaagtactcaggaacactcagagagagctttaagtgaacaaatactgatggtgaaaataaaatctgagccttgtgatgacttacaaattcctaacacaaatgtgcacttgagccatgatgctaagagtgccccattcttgggtatggctcctgctgtgcagagaagcgcacctgccttaccagtgtccgaagactttaaatcggagcctgtttcacctcaggatttttctttctccaagaatggtctgctaagtcgattgctaagacaaaatcaagatagttacctggcagatgattcagacaggagtcacagaaataatgaaatggcacttctagaatcaaagaatctttgcatggtccctaagaaaaggaagctttatactgagccattagaaaatccatttaaaaagatgaaaaacaacattgttgatgctgcaaacaatcacagtgccccagaagtactgtatgggtccttgcttaaccaggaagagctgaaatttagcagaaatgatcttgaatttaaatatcctgctggtcatggctcagccagcgaaagtgaacacaggagttgggccagagagagcaaaagctttaatgttctgaaacagctgcttctctcagaaaactgtgtgcgagatttgtccccgcacagaagtaactctgtggctgacagtaaaaagaaaggacacaaaaataatgtgaccaacagcaaacctgaatttagcatttcttctttaaatggactgatgtacagttccactcagcccagcagttgcatggataacaggacattttcatacccaggtgtagtaaaaactcctgtgagtcctactttccctgagcacttgggctgtgcagggtctagaccagaatctgggcttttgaatgggtgttccatgcccagtgagaaaggacccattaagtgggttatcactgatgcggagaagaatgagtatgaaaaagactctccaagattgaccaaaaccaacccaatactatattacatgcttcaaaaaggaggcaattctgttaccagtcgagaaacacaagacaaggacatttggagggaggcttcatctgctgaaagtgtctcacaggtcacagccaaagaagagttacttcctactgcagaaacgaaagcttctttctttaatttaagaagcccttacaatagccatatgggaaataatgcttctcgcccacacagcgcaaatggagaagtttatggacttctgggaagcgtgctaacgataaagaaagaatcagaataaaatgtacctgccatccagttttggatctttttaaaactaatgagtatgaacttgagatctgtataaataagagcatgatttgaaaaaaagcatggtataattgaaacttttttcattttgaaaagtattggttactggtgatgttgaaatatgcatactaatttttgcttaacattagatgtcatgaggaaactactgaactagcaattggttgtttaacacttctgtatgcatcagataacaactgtgagtagcctatgaatgaaattcttttataaatattaggcataaattaaaatgtaaaactccattcatagtggattaatgcattttgctgcctttattagggtactttattttgcttttcagaagtcagcctacataacacatttttaaagtctaaactgttaaacaactctttaaaggataattatccaataaaaaaaaacctagtgctgattcacagcttattatccaattcaaaaataaattagaaaaatatatgcttacatttttcacttttgctaaaaagaaaaaaaaaaggtgtttatttttaactcttggaagaggttttgtggttcccaatgtgtctgtcccaccctgatccttttcaatatatatttctttaaaccttgtgctacttagtaaaaattgattacaattgagggaagtttgatagatcctttaaaaaaaaggcagatttccattttttgtattttaactactttactaaattaatactcctccttttacagaattagaaaagttaacatttatctttaggtggtttcctgaaaagttgaatatttaagaaattgtttttaacagaagcaaaatggcttttctttggacagttttcaccatctcttgtaaaagttaattctcaccattcctgtggtacctgcgagtgttatgaccaggattccttaaacctgaactcagaccacttgcattagaaccatctggagcacttgttttaaaatgcagattcataggcagcatctcagatctacagaacaagaatctctgctaagtggacctggaatcttccatctgcatcttaacatgctctctaggtgtttcttgtgtttgagaaccatgacttatgactttcctcagaacatgagactgtaaaacaaaaacaaaaaactatgtgatgcctctattttccccaatacagtcacacatcagctcaaaatttgcaatattgtagttcatatattaccgttatgtctttggaaatcgggttcagaacactttttatgacaaaaattgggtggaggggataactttcatatctggctcaacatctcaggaaaatctgtgattatttgtgtgttctaatgagtaacatctacttagttagccttagggatggaaaaacagggccacttaccaaactcaggtgattccaggatggtttggaaacttctcctgaatgcatccttaacctttattaaaaccattgtcctaagaacaatgccaacaaagcttacaacatttagtttaaacccaagaagggcactaaactcagattgactaaataaaaagtacaaagggcacatatacgtgacagaattgtacacaatcactccattggatcttttactttaaagtagtgatgaaaagtacatgttgatactgtcttagaagaaattaatatattagtgaagccacatggggtttcagttgcgaaacaggtctgtttttatgttcagtttgtacaatccacaattcattcaccagatattttgttcttaattgtgaaccaggttagcaaatgacctatcaaaaattattctataatcactactagttaggatattgatttaaaattgttctacttgaagtggtttctaagatttttatattaaaaataggtgtgatttcctaatatgatctaaaaccctaaatggttatttttcctcagaatgatttgtaaatagctactggaaatattatacagtaataggagtgggtattatgcaacatcatggagaagtgaaggcataggcttattctgacataaaattccactggccagttgaatatattctattccatgtccatactatgacaatcttattgtcaacactatataaataagcttttaaacaagtcatttttcttgatcgttgtggaaggtttggagccttagaggtatgtcagaaaaaatatgttggtattctcccttgggtagggggaaatgacctttttacaagagagtgaaatttaggtcagggaaaagaccaagggccagcattgctacttttgtgtgtgtgtgtgtgggttttgttttgtttttttggttggctggttgttttcgttgttgttaacaaaggaatgagaatatgtaatacttaaataaacatgaccacgaagaatgctgttctgatttactagagaatgttcccaatttgaatttagggtgattttaaagaacagtgagaaagggcatacatccacagattcactttgtttatgcatatgtagatacaaggatgcacatatacacattttcaaggactattttagatatctagacaatttcttctaataaagtcatttgtgaaagggtactacagcttattgacatcagtaaggtagcattcattacctgtttattctctgctgcatcttacagaagagtaaactggtgagagtatatattttatatatatatatatatatatatatataatatgtatatatatatatattgacttgttacatgaagatgttaaaatcggtttttaaaggtgatgtaaatagtgatttccttaatgaaaaatacatattttgtattgttctaatgcaacagaaaagccttttaatctctttggttcctgtatattccatgtataagtgtaaatataatcagacaggtttaaaagttgtgcatgtatgtatacagttgcaagtctggacaaatgtatagaataaaccttttatttaagttgtgattacctgctgcatgaaaagtgcatgggggaccctgtgcatctgtgcatttggcaaaatgtcttaacaaatcagatcagatgttcatcctaacatgacagtattccatttctggacatgacgtctgtggtttaagctttgtgaaagaatgtgctttgattcgaagggtcttaaagaatttttttaatcgtcaaccacttttaaacataaagaattcacacaactactttcatgaattttttaatcccattgcaaacattattccaagagtatcccagtattagcaatactggaatataggcacattaccattcatagtaagaattctggtgtttacacaaccaaatttgatgcgatctgctcagtaatataatttgccatttttattagaaatttaatttcttcatgtgatgtcatgaaactgtacatactgcagtgtgaatttttttgttttgttttttaatcttttagtgtttacttcctgcagtgaatttgaataaatgagaaaaaatgcattgtc

SEQ ID NO: 2905 - DNA, 720 bp, Homo sapiens
ttgtggttatctcagcagaagacataccgccctcctccttgtattggtcgggacctgggcattagggagtcaaggcaaaggagaaagaaaagagattttacattagtattctatgaaagccttacggtctgcagaacaaattgattactccggtgtacctgtgcttggcaccactgctgtgagagaaagaacactgatatttgcatttaatggggaacaaaagatgaagaaggaaaaggaatatattcactaaggattctatctgcttactgctacagacctatgtgttaaggaattcttctcctcctccttgcgtagaagttgatcagcactgtggtcagactgcatttatcttgtcattgccagaagaaatcttggacagaatgtaacagtacgtctctctctgattgcgatggaaggtgataaactgatactcctttattaaagttacatcgcactcaccacagaaaaccattctttaaagtgaatagaaaccaagcccttgtgaacacttctattgaacatgactcatggagaagagcttggctctgatgtgcaccaggattctattgttttaacttacctagaaggattactaatgcatcaggcagcagggggatcaggtactgccgttgacaaaaagtctgctgggcataatgaagaggatcagaactttaacatttctggcagtgcatttcccacctgtcaaagtaatggtcc

SEQ ID NO: 2906 - DNA, 3556 bp, Homo sapiens
ggcgccgcctccacccgctccccgctcggtcccgctcgctcgcccaggccgggctgccctttcgcgtgtccgcgctctcttccctccgccgccgcctcctccattttgcgagctcgtgtctgtgacgggagcccgagtcaccgcctgcccgtcggggacggattctgtgggtggaaggagacgccgcagccggagcggccgaagcagctgggaccgggacggggcacgcgcgcccggaacctcgacccgcggagcccggcgcggggcggagggctggcttgtcagctgggcaatgggagactttcttaaataggggctctccccccacccatggagaaaggggcggctgtttacttcctttttttagaaaaaaaaaatatatttccctcctgctccttctgcgttcacaagctaagttgtttatctcggctgcggcgggaactgcggacggtggcgggcgagcggctcctctgccagagttgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactgctgtgtctgctgcccccacagagaaggagtttccaaaaactcactctgatgtatcttcagaacagcaacatttgaagggccagactggcaccaacggtggcaatgtgaaattgtataccacagaccaaagcacctttgacattttgcaggatttggagttttcttctgggtccccaggtaaagagacgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagccccagtaatgtaacactgccccaagtgaaaacagaaaaagaagatttcatcgaactctgcacccctggggtaattaagcaagagaaactgggcacagtttactgtcaggcaagctttcctggagcaaatataattggtaataaaatgtctgccatttctgttcatggtgtgagtacctctggaggacagatgtaccactatgacatgaatacagcatccctttctcaacagcaggatcagaagcctatttttaatgtcattccaccaattcccgttggttccgaaaattggaataggtgccaaggatctggagatgacaacttgacttctctggggactctgaacttccctggtcgaacagttttttctaatggctattcaagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggtagacagcacaattacctatgtgctggaaggaatgattgcatcatcgataaaattcgaagaaaaaactgcccagcatgccgctatcgaaaatgtcttcaggctggaatgaacctggaagctcgaaaaacaaagaaaaaaataaaaggaattcagcaggccactacaggagtctcacaagaaacctctgaaaatcctggtaacaaaacaatagttcctgcaacgttaccacaactcacccctaccctggtgtcactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtttcaggaacttacacctggatgaccaaatgaccctactgcagtactcctggatgtttcttatggcatttgctctggggtggagatcatatagacaatcaagtgcaaacctgctgtgttttgctcctgatctgattattaatgagcagagaatgactctaccctgcatgtacgaccaatgtaaacacatgctgtatgtttcctctgagttacacaggcttcaggtatcttatgaagagtatctctgtatgaaaaccttactgcttctctcttcagttcctaaggacggtctgaagagccaagagctatttgatgaaattagaatgacctacatcaaagagctaggaaaagccattgtcaagagggaaggaaactccagccagaactggcagcggttttatcaactgacaaaactcttggattctatgcatgaagtggttgaaaatctccttaactattgcttccaaacatttttggataagaccatgagtattgaattccccgagatgttagctgaaatcatcaccaatcagataccaaaatattcaaatggaaatatcaaaaaacttctgtttcatcaaaagtgactgccttaataagaatggttgccttaaagaaagtcgaattaatagcttttattgtataaactatcagtttgtcctgtagaggttttgttgttttattttttattgttttcatctgttgttttgttttaaatacgcactacatgtggtttatagagggccaagacttggcaacagaagcagttgagtcgtcatcacttttcagtgatgggagagtagatggtgaaatttattagttaatatatcccagaaattagaaaccttaatatgtggacgtaatctccacagtcaaagaaggatggcacctaaaccaccagtgcccaaagtctgtgtgatgaactttctcttcatactttttttcacagttggctggatgaaattttctagactttctgttggtgtatcccccccctgtatagttaggatagcatttttgatttatgcatggaaacctgaaaaaaagtttacaagtgtatatcagaaaagggaagttgtgccttttatagctattactgtctggttttaacaatttcctttatatttagtgaactacgcttgctcattttttcttacataattttttattcaagttattgtacagctgtttaagatgggcagctagttcgtagctttcccaaataaactctaaacattaatcaatcatctgtgtgaaaatgggttggtgcttctaacctgatggcacttagctatcagaagaccacaaaaattg

SEQ ID NO: 2907 - DNA, 7286 bp, Homo sapiens
aggttatgtaagggtttgctttcaccccattcaaaaggtacctcttcctcttctcttgctccctctcgccctcattcttgtgcctatgcagacatttgagtagaggcgaatcactttcacttctgctggggaaattgcaacacgcttctttaaatggcagagagaaggagaaaacttagatcttctgataccaaatcactggaccttagaaggtcagaaatctttcaagccctgcaggaccgtaaaatgcgcatgtgtccaacggaagcactggggcatgagtggggaaggaatagaaacagaaagagggtaagagaagaaaaaagggaaagtggtgaaggcagggaggaaaattgcttagtgtgaatatgcacgcattcatttagttttcaaatccttgttgagcatgataaaattcccagcatcagacctcacatgttggtttccattaggatctgcctgggggaatatctgctgaatcagtggctctgagctgaactaggaaattcaccataattaggagagtcactgtatttctctccaaaaaaaaaaaagttatacccgagagacaggatcttctgatctgaaattttcttcacttctgaaattctctggtttgtgctcatcgttggtagctatttgttcatcaagagttgtgtagctggcttcttctgaaaaaaggaatctgcgtcatatctaagtcagatttcattctggtgctctcagagcagttagcccaggaaaggggccagcttctgtgacgactgctgcagaggcaggtgcagtttgtgtgccacagatattaactttgataagcacttaatgagtgccttctctgtgcgagaatggggaggaacaaaatgcagctcctaccctcctcgggctttagttgtaccttaataacaggaattttcatctgcctggctcctttcctcaaagaacaaagaagactttgcttcattaaagtgtctgagaaggaagttgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactgctgtgtctgctgcccccacagagaaggagtttccaaaaactcactctgatgtatcttcagaacagcaacatttgaagggccagactggcaccaacggtggcaatgtgaaattgtataccacagaccaaagcacctttgacattttgcaggatttggagttttcttctgggtccccaggtaaagagacgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagccccagtaatgtaacactgccccaagtgaaaacagaaaaagaagatttcatcgaactctgcacccctggggtaattaagcaagagaaactgggcacagtttactgtcaggcaagctttcctggagcaaatataattggtaataaaatgtctgccatttctgttcatggtgtgagtacctctggaggacagatgtaccactatgacatgaatacagcatccctttctcaacagcaggatcagaagcctatttttaatgtcattccaccaattcccgttggttccgaaaattggaataggtgccaaggatctggagatgacaacttgacttctctggggactctgaacttccctggtcgaacagttttttctaatggctattcaagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggacagcacaattacctatgtgctggaaggaatgattgcatcatcgataaaattcgaagaaaaaactgcccagcatgccgctatcgaaaatgtcttcaggctggaatgaacctggaagctcgaaaaacaaagaaaaaaataaaaggaattcagcaggccactacaggagtctcacaagaaacctctgaaaatcctggtaacaaaacaatagttcctgcaacgttaccacaactcacccctaccctggtgtcactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtttcaggaacttacacctggatgaccaaatgaccctactgcagtactcctggatgtttcttatggcatttgctctggggtggagatcatatagacaatcaagtgcaaacctgctgtgttttgctcctgatctgattattaatgagcagagaatgactctaccctgcatgtacgaccaatgtaaacacatgctgtatgtttcctctgagttacacaggcttcaggtatcttatgaagagtatctctgtatgaaaaccttactgcttctctcttcagttcctaaggacggtctgaagagccaagagctatttgatgaaattagaatgacctacatcaaagagctaggaaaagccattgtcaagagggaaggaaactccagccagaactggcagcggttttatcaactgacaaaactcttggattctatgcatgaagtggttgaaaatctccttaactattgcttccaaacatttttggataagaccatgagtattgaattccccgagatgttagctgaaatcatcaccaatcagataccaaaatattcaaatggaaatatcaaaaaacttctgtttcatcaaaagtgactgccttaataagaatggttgccttaaagaaagtcgaattaatagcttttattgtataaactatcagtttgtcctgtagaggttttgttgttttattttttattgttttcatctgttgttttgttttaaatacgcactacatgtggtttatagagggccaagacttggcaacagaagcagttgagtcgtcatcacttttcagtgatgggagagtagatggtgaaatttattagttaatatatcccagaaattagaaaccttaatatgtggacgtaatctccacagtcaaagaaggatggcacctaaaccaccagtgcccaaagtctgtgtgatgaactttctcttcatactttttttcacagttggctggatgaaattttctagactttctgttggtgtatcccccccctgtatagttaggatagcatttttgatttatgcatggaaacctgaaaaaaagtttacaagtgtatatcagaaaagggaagttgtgccttttatagctattactgtctggttttaacaatttcctttatatttagtgaactacgcttgctcattttttcttacataattttttattcaagttattgtacagctgtttaagatgggcagctagttcgtagctttcccaaataaactctaaacattaatcaatcatctgtgtgaaaatgggttggtgcttctaacctgatggcacttagctatcagaagaccacaaaaattgactcaaatctccagtattcttgtcaaaaaaaaaaaaaaaaaagctcatattttgtatatatctgcttcagtggagaattatataggttgtgcaaattaacagtcctaactggtatagagcacctagtccagtgacctgctgggtaaactgtggatgatggttgcaaaagactaatttaaaaaataactaccaagaggccctgtctgtacctaacgccctatttttgcaatggctatatggcaagaaagctggtaaactatttgtctttcaggaccttttgaagtagtttgtataacttcttaaaagttgtgattccagataaccagctgtaacacagctgagagacttttaatcagacaaagtaattcctctcactaaactttacccaaaaactaaatctctaatatggcaaaaatggctagacacccattttcacattcccatctgtcaccaattggttaatctttcctgatggtacaggaaagctcagctactgatttttgtgatttagaactgtatgtcagacatccatgtttgtaaaactacacatccctaatgtgtgccatagagtttaacacaagtcctgtgaatttcttcactgttgaaaattattttaaacaaaatagaagctgtagtagccctttctgtgtgcaccttaccaactttctgtaaactcaaaacttaacatatttactaagccacaagaaatttgatttctattcaaggtggccaaattatttgtgtaatagaaaactgaaaatctaatattaaaaatatggaacttctaatatatttttatatttagttatagtttcagatatatatcatattggtattcactaatctgggaagggaagggctactgcagctttacatgcaatttattaaaatgattgtaaaatagcttgtatagtgtaaaataagaatgatttttagatgagattgttttatcatgacatgttatatattttttgtaggggtcaaagaaatgctgatggataacctatatgatttatagtttgtacatgcattcatacaggcagcgatggtctcagaaaccaaacagtttgctctaggggaagagggagatggagactggtcctgtgtgcagtgaaggttgctgaggctctgacccagtgagattacagaggaagttatcctctgcctcccattctgaccacccttctcattccaacagtgagtctgtcagcgcaggtttagtttactcaatctccccttgcactaaagtatgtaaagtatgtaaacaggagacaggaaggtggtgcttacatccttaaaggcaccatctaatagcgggttactttcacatacagccctcccccagcagttgaatgacaacagaagcttcagaagtttggcaatagtttgcatagaggtaccagcaatatgtaaatagtgcagaatctcataggttgccaataatacactaattcctttctatcctacaacaagagtttatttccaaataaaatgaggacatgtttttgttttctttgaatgctttttgaatgttatttgttattttcagtattttggagaaattatttaataaaaaaacaatcatttgctttttgaatgctctctaaaagggaatgtaatattttaagatggtgtgtaacccggctggataaatttttggtgcctaagaaaactgcttgaatattcttatcaatgacagtgttaagtttcaaaaagagcttctaaaacgtagattatcattcctttatagaatgttatgtggttaaaaccagaaagcacatctcacacattaatctgattttcatcccaacaatcttggcgctcaaaaaatagaactcaatgagaaaaagaagattatgtgcacttcgttgtcaataataagtcaactgatgctcatcgacaactataggaggcttttcattaaatgggaaaagaagctgtgcccttttaggatacgtgggggaaaagaaagtcatcttaattatgtttaattgtggatttaagtgctatatggtggtgctgtttgaaagcagatttatttcctatgtatgtgttatctggccatcccaacccaaactgttgaagtttgtagtaacttcagtgagagttggttactcacaacaaatcctgaaaagtatttttagtgtttgtaggtattctgtgggatactatacaagcagaactgaggcacttaggacataacacttttggggtatatatatccaaatgcctaaaactatgggaggaaaccttggccaccccaaaaggaaaactaacatgatttgtgtctatgaagtgctggataattagcatgggatgagctctgggcatgccatgaaggaaagccacgctcccttcagaattcagaggcagggagcaattccagtttcacctaagtctcataattttagttcccttttaaaaaccctgaaaactacatcaccatggaatgaaaaatattgttatacaatacattgatctgtcaaacttccagaaccatggtagccttcagtgagatttccatcttggctggtcactccctgactgtagctgtaggtgaatgtgtttttgtgtgtgtgtgtctggttttagtgtcagaagggaaataaaagtgtaaggaggacactttaaaccctttgggtggagtttcgtaatttcccagactattttcaagcaacctggtccacccaggattagtgaccaggttttcaggaaaggatttgcttctctctagaaaatgtctgaaaggattttattttctgatgaaaggctgtatgaaaataccctcctcaaataacttgcttaactacatatagattcaagtgtgtcaatattctattttgtatattaaatgctatataatggggacaaatctatattatactgtgtatggcattattaagaagctttttcattattttttatcacagtaattttaaaatgtgtaaaaattaaaaccagtgactcctgtttaaaaataaaagttgtagttttttattcatgctgaataataatctgtagttaaaaaaaaagtgtctttttacctacgcagtgaaatgtcagactgtaaaaccttgtgtggaaatgtttaacttttattttttcatttaaatttgctgttctggtattaccaaaccacacatttgtaccgaattggcagtaaatgttagccatttacagcaatgccaaatatggagaaacatcataataaaaaaatctgctttttcatta

SEQ ID NO: 2908 - DNA, 6232 bp, Homo sapiens
ggcgccgcctccacccgctccccgctcggtcccgctcgctcgcccaggccgggctgccctttcgcgtgtccgcgctctcttccctccgccgccgcctcctccattttgcgagctcgtgtctgtgacgggagcccgagtcaccgcctgcccgtcggggacggattctgtgggtggaaggagacgccgcagccggagcggccgaagcagctgggaccgggacggggcacgcgcgcccggaacctcgacccgcggagcccggcgcggggcggagggctggcttgtcagctgggcaatgggagactttcttaaataggggctctccccccacccatggagaaaggggcggctgtttacttcctttttttagaaaaaaaaaatatatttccctcctgctccttctgcgttcacaagctaagttgtttatctcggctgcggcgggaactgcggacggtggcgggcgagcggctcctctgccagagttgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactgctgtgtctgctgcccccacagagaaggagtttccaaaaactcactctgatgtatcttcagaacagcaacatttgaagggccagactggcaccaacggtggcaatgtgaaattgtataccacagaccaaagcacctttgacattttgcaggatttggagttttcttctgggtccccaggtaaagagacgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagccccagtaatgtaacactgccccaagtgaaaacagaaaaagaagatttcatcgaactctgcacccctggggtaattaagcaagagaaactgggcacagtttactgtcaggcaagctttcctggagcaaatataattggtaataaaatgtctgccatttctgttcatggtgtgagtacctctggaggacagatgtaccactatgacatgaatacagcatccctttctcaacagcaggatcagaagcctatttttaatgtcattccaccaattcccgttggttccgaaaattggaataggtgccaaggatctggagatgacaacttgacttctctggggactctgaacttccctggtcgaacagttttttctaatggctattcaagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggacagcacaattacctatgtgctggaaggaatgattgcatcatcgataaaattcgaagaaaaaactgcccagcatgccgctatcgaaaatgtcttcaggctggaatgaacctggaagtagttcctaaggacggtctgaagagccaagagctatttgatgaaattagaatgacctacatcaaagagctaggaaaagccattgtcaagagggaaggaaactccagccagaactggcagcggttttatcaactgacaaaactcttggattctatgcatgaagtggttgaaaatctccttaactattgcttccaaacatttttggataagaccatgagtattgaattccccgagatgttagctgaaatcatcaccaatcagataccaaaatattcaaatggaaatatcaaaaaacttctgtttcatcaaaagtgactgccttaataagaatggttgccttaaagaaagtcgaattaatagcttttattgtataaactatcagtttgtcctgtagaggttttgttgttttattttttattgttttcatctgttgttttgttttaaatacgcactacatgtggtttatagagggccaagacttggcaacagaagcagttgagtcgtcatcacttttcagtgatgggagagtagatggtgaaatttattagttaatatatcccagaaattagaaaccttaatatgtggacgtaatctccacagtcaaagaaggatggcacctaaaccaccagtgcccaaagtctgtgtgatgaactttctcttcatactttttttcacagttggctggatgaaattttctagactttctgttggtgtatcccccccctgtatagttaggatagcatttttgatttatgcatggaaacctgaaaaaaagtttacaagtgtatatcagaaaagggaagttgtgccttttatagctattactgtctggttttaacaatttcctttatatttagtgaactacgcttgctcattttttcttacataattttttattcaagttattgtacagctgtttaagatgggcagctagttcgtagctttcccaaataaactctaaacattaatcaatcatctgtgtgaaaatgggttggtgcttctaacctgatggcacttagctatcagaagaccacaaaaattgactcaaatctccagtattcttgtcaaaaaaaaaaaaaaaaaagctcatattttgtatatatctgcttcagtggagaattatataggttgtgcaaattaacagtcctaactggtatagagcacctagtccagtgacctgctgggtaaactgtggatgatggttgcaaaagactaatttaaaaaataactaccaagaggccctgtctgtacctaacgccctatttttgcaatggctatatggcaagaaagctggtaaactatttgtctttcaggaccttttgaagtagtttgtataacttcttaaaagttgtgattccagataaccagctgtaacacagctgagagacttttaatcagacaaagtaattcctctcactaaactttacccaaaaactaaatctctaatatggcaaaaatggctagacacccattttcacattcccatctgtcaccaattggttaatctttcctgatggtacaggaaagctcagctactgatttttgtgatttagaactgtatgtcagacatccatgtttgtaaaactacacatccctaatgtgtgccatagagtttaacacaagtcctgtgaatttcttcactgttgaaaattattttaaacaaaatagaagctgtagtagccctttctgtgtgcaccttaccaactttctgtaaactcaaaacttaacatatttactaagccacaagaaatttgatttctattcaaggtggccaaattatttgtgtaatagaaaactgaaaatctaatattaaaaatatggaacttctaatatatttttatatttagttatagtttcagatatatatcatattggtattcactaatctgggaagggaagggctactgcagctttacatgcaatttattaaaatgattgtaaaatagcttgtatagtgtaaaataagaatgatttttagatgagattgttttatcatgacatgttatatattttttgtaggggtcaaagaaatgctgatggataacctatatgatttatagtttgtacatgcattcatacaggcagcgatggtctcagaaaccaaacagtttgctctaggggaagagggagatggagactggtcctgtgtgcagtgaaggttgctgaggctctgacccagtgagattacagaggaagttatcctctgcctcccattctgaccacccttctcattccaacagtgagtctgtcagcgcaggtttagtttactcaatctccccttgcactaaagtatgtaaagtatgtaaacaggagacaggaaggtggtgcttacatccttaaaggcaccatctaatagcgggttactttcacatacagccctcccccagcagttgaatgacaacagaagcttcagaagtttggcaatagtttgcatagaggtaccagcaatatgtaaatagtgcagaatctcataggttgccaataatacactaattcctttctatcctacaacaagagtttatttccaaataaaatgaggacatgtttttgttttctttgaatgctttttgaatgttatttgttattttcagtattttggagaaattatttaataaaaaaacaatcatttgctttttgaatgctctctaaaagggaatgtaatattttaagatggtgtgtaacccggctggataaatttttggtgcctaagaaaactgcttgaatattcttatcaatgacagtgttaagtttcaaaaagagcttctaaaacgtagattatcattcctttatagaatgttatgtggttaaaaccagaaagcacatctcacacattaatctgattttcatcccaacaatcttggcgctcaaaaaatagaactcaatgagaaaaagaagattatgtgcacttcgttgtcaataataagtcaactgatgctcatcgacaactataggaggcttttcattaaatgggaaaagaagctgtgcccttttaggatacgtgggggaaaagaaagtcatcttaattatgtttaattgtggatttaagtgctatatggtggtgctgtttgaaagcagatttatttcctatgtatgtgttatctggccatcccaacccaaactgttgaagtttgtagtaacttcagtgagagttggttactcacaacaaatcctgaaaagtatttttagtgtttgtaggtattctgtgggatactatacaagcagaactgaggcacttaggacataacacttttggggtatatatatccaaatgcctaaaactatgggaggaaaccttggccaccccaaaaggaaaactaacatgatttgtgtctatgaagtgctggataattagcatgggatgagctctgggcatgccatgaaggaaagccacgctcccttcagaattcagaggcagggagcaattccagtttcacctaagtctcataattttagttcccttttaaaaaccctgaaaactacatcaccatggaatgaaaaatattgttatacaatacattgatctgtcaaacttccagaaccatggtagccttcagtgagatttccatcttggctggtcactccctgactgtagctgtaggtgaatgtgtttttgtgtgtgtgtgtctggttttagtgtcagaagggaaataaaagtgtaaggaggacactttaaaccctttgggtggagtttcgtaatttcccagactattttcaagcaacctggtccacccaggattagtgaccaggttttcaggaaaggatttgcttctctctagaaaatgtctgaaaggattttattttctgatgaaaggctgtatgaaaataccctcctcaaataacttgcttaactacatatagattcaagtgtgtcaatattctattttgtatattaaatgctatataatggggacaaatctatattatactgtgtatggcattattaagaagctttttcattattttttatcacagtaattttaaaatgtgtaaaaattaaaaccagtgactcctgtttaaaaataaaagttgtagttttttattcatgctgaataataatctgtagttaaaaaaaaagtgtctttttacctacgcagtgaaatgtcagactgtaaaaccttgtgtggaaatgtttaacttttattttttcatttaaatttgctgttctggtattaccaaaccacacatttgtaccgaattggcagtaaatgttagccatttacagcaatgccaaatatggagaaacatcataataaaaaaatctgctttttcatta

SEQ ID NO: 2909 - DNA, 6795 bp, Homo sapiens
gtgcgcgccgtggcgccgcctccacccgctccccgctcggtcccgctcgctcgcccaggccgggctgccctttcgcgtgtccgcgctctcttccctccgccgccgcctcctccattttgcgagctcgtgtctgtgacgggagcccgagtcaccgcctgcccgtcggggacggattctgtgggtggaaggagacgccgcagccggagcggccgaagcagctgggaccgggacggggcacgcgcgcccggaacctcgacccgcggagcccggcgcggggcggagggctggcttgtcagctgggcaatgggagactttcttaaataggggctctccccccacccatggagaaaggggcggctgtttacttcctttttttagaaaaaaaaaatatatttccctcctgctccttctgcgttcacaagctaagttgtttatctcggctgcggcgggaactgcggacggtggcgggcgagcggctcctctgccagagttgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactgctgtgtctgctgcccccacagagaaggagtttccaaaaactcactctgatgtatcttcagaacagcaacatttgaagggccagactggcaccaacggtggcaatgtgaaattgtataccacagaccaaagcacctttgacattttgcaggatttggagttttcttctgggtccccaggtaaagagacgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagccccagtaatgtaacactgccccaagtgaaaacagaaaaagaagatttcatcgaactctgcacccctggggtaattaagcaagagaaactgggcacagtttactgtcaggcaagctttcctggagcaaatataattggtaataaaatgtctgccatttctgttcatggtgtgagtacctctggaggacagatgtaccactatgacatgaatacagcatccctttctcaacagcaggatcagaagcctatttttaatgtcattccaccaattcccgttggttccgaaaattggaataggtgccaaggatctggagatgacaacttgacttctctggggactctgaacttccctggtcgaacagttttttctaatggctattcaagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggacagcacaattacctatgtgctggaaggaatgattgcatcatcgataaaattcgaagaaaaaactgcccagcatgccgctatcgaaaatgtcttcaggctggaatgaacctggaagctcgaaaaacaaagaaaaaaataaaaggaattcagcaggccactacaggagtctcacaagaaacctctgaaaatcctggtaacaaaacaatagttcctgcaacgttaccacaactcacccctaccctggtgtcactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtttcaggaacttacacctggatgaccaaatgaccctactgcagtactcctggatgtttcttatggcatttgctctggggtggagatcatatagacaatcaagtgcaaacctgctgtgttttgctcctgatctgattattaatgagcagagaatgactctaccctgcatgtacgaccaatgtaaacacatgctgtatgtttcctctgagttacacaggcttcaggtatcttatgaagagtatctctgtatgaaaaccttactgcttctctcttcagttcctaaggacggtctgaagagccaagagctatttgatgaaattagaatgacctacatcaaagagctaggaaaagccattgtcaagagggaaggaaactccagccagaactggcagcggttttatcaactgacaaaactcttggattctatgcatgaagtggttgaaaatctccttaactattgcttccaaacatttttggataagaccatgagtattgaattccccgagatgttagctgaaatcatcaccaatcagataccaaaatattcaaatggaaatatcaaaaaacttctgtttcatcaaaagtgactgccttaataagaatggttgccttaaagaaagtcgaattaatagcttttattgtataaactatcagtttgtcctgtagaggttttgttgttttattttttattgttttcatctgttgttttgttttaaatacgcactacatgtggtttatagagggccaagacttggcaacagaagcagttgagtcgtcatcacttttcagtgatgggagagtagatggtgaaatttattagttaatatatcccagaaattagaaaccttaatatgtggacgtaatctccacagtcaaagaaggatggcacctaaaccaccagtgcccaaagtctgtgtgatgaactttctcttcatactttttttcacagttggctggatgaaattttctagactttctgttggtgtatcccccccctgtatagttaggatagcatttttgatttatgcatggaaacctgaaaaaaagtttacaagtgtatatcagaaaagggaagttgtgccttttatagctattactgtctggttttaacaatttcctttatatttagtgaactacgcttgctcattttttcttacataattttttattcaagttattgtacagctgtttaagatgggcagctagttcgtagctttcccaaataaactctaaacattaatcaatcatctgtgtgaaaatgggttggtgcttctaacctgatggcacttagctatcagaagaccacaaaaattgactcaaatctccagtattcttgtcaaaaaaaaaaaaaaaaaagctcatattttgtatatatctgcttcagtggagaattatataggttgtgcaaattaacagtcctaactggtatagagcacctagtccagtgacctgctgggtaaactgtggatgatggttgcaaaagactaatttaaaaaataactaccaagaggccctgtctgtacctaacgccctatttttgcaatggctatatggcaagaaagctggtaaactatttgtctttcaggaccttttgaagtagtttgtataacttcttaaaagttgtgattccagataaccagctgtaacacagctgagagacttttaatcagacaaagtaattcctctcactaaactttacccaaaaactaaatctctaatatggcaaaaatggctagacacccattttcacattcccatctgtcaccaattggttaatctttcctgatggtacaggaaagctcagctactgatttttgtgatttagaactgtatgtcagacatccatgtttgtaaaactacacatccctaatgtgtgccatagagtttaacacaagtcctgtgaatttcttcactgttgaaaattattttaaacaaaatagaagctgtagtagccctttctgtgtgcaccttaccaactttctgtaaactcaaaacttaacatatttactaagccacaagaaatttgatttctattcaaggtggccaaattatttgtgtaatagaaaactgaaaatctaatattaaaaatatggaacttctaatatatttttatatttagttatagtttcagatatatatcatattggtattcactaatctgggaagggaagggctactgcagctttacatgcaatttattaaaatgattgtaaaatagcttgtatagtgtaaaataagaatgatttttagatgagattgttttatcatgacatgttatatattttttgtaggggtcaaagaaatgctgatggataacctatatgatttatagtttgtacatgcattcatacaggcagcgatggtctcagaaaccaaacagtttgctctaggggaagagggagatggagactggtcctgtgtgcagtgaaggttgctgaggctctgacccagtgagattacagaggaagttatcctctgcctcccattctgaccacccttctcattccaacagtgagtctgtcagcgcaggtttagtttactcaatctccccttgcactaaagtatgtaaagtatgtaaacaggagacaggaaggtggtgcttacatccttaaaggcaccatctaatagcgggttactttcacatacagccctcccccagcagttgaatgacaacagaagcttcagaagtttggcaatagtttgcatagaggtaccagcaatatgtaaatagtgcagaatctcataggttgccaataatacactaattcctttctatcctacaacaagagtttatttccaaataaaatgaggacatgtttttgttttctttgaatgctttttgaatgttatttgttattttcagtattttggagaaattatttaataaaaaaacaatcatttgctttttgaatgctctctaaaagggaatgtaatattttaagatggtgtgtaacccggctggataaatttttggtgcctaagaaaactgcttgaatattcttatcaatgacagtgttaagtttcaaaaagagcttctaaaacgtagattatcattcctttatagaatgttatgtggttaaaaccagaaagcacatctcacacattaatctgattttcatcccaacaatcttggcgctcaaaaaatagaactcaatgagaaaaagaagattatgtgcacttcgttgtcaataataagtcaactgatgctcatcgacaactataggaggcttttcattaaatgggaaaagaagctgtgcccttttaggatacgtgggggaaaagaaagtcatcttaattatgtttaattgtggatttaagtgctatatggtggtgctgtttgaaagcagatttatttcctatgtatgtgttatctggccatcccaacccaaactgttgaagtttgtagtaacttcagtgagagttggttactcacaacaaatcctgaaaagtatttttagtgtttgtaggtattctgtgggatactatacaagcagaactgaggcacttaggacataacacttttggggtatatatatccaaatgcctaaaactatgggaggaaaccttggccaccccaaaaggaaaactaacatgatttgtgtctatgaagtgctggataattagcatgggatgagctctgggcatgccatgaaggaaagccacgctcccttcagaattcagaggcagggagcaattccagtttcacctaagtctcataattttagttcccttttaaaaaccctgaaaactacatcaccatggaatgaaaaatattgttatacaatacattgatctgtcaaacttccagaaccatggtagccttcagtgagatttccatcttggctggtcactccctgactgtagctgtaggtgaatgtgtttttgtgtgtgtgtgtctggttttagtgtcagaagggaaataaaagtgtaaggaggacactttaaaccctttgggtggagtttcgtaatttcccagactattttcaagcaacctggtccacccaggattagtgaccaggttttcaggaaaggatttgcttctctctagaaaatgtctgaaaggattttattttctgatgaaaggctgtatgaaaataccctcctcaaataacttgcttaactacatatagattcaagtgtgtcaatattctattttgtatattaaatgctatataatggggacaaatctatattatactgtgtatggcattattaagaagctttttcattattttttatcacagtaattttaaaatgtgtaaaaattaaaaccagtgactcctgtttaaaaataaaagttgtagttttttattcatgctgaataataatctgtagttaaaaaaaaagtgtctttttacctacgcagtgaaatgtcagactgtaaaaccttgtgtggaaatgtttaacttttattttttcatttaaatttgctgttctggtattaccaaaccacacatttgtaccgaattggcagtaaatgttagccatttacagcaatgccaaatatggagaaacatcataataaaaaaatctgctttttcatta

SEQ ID NO: 2910 - DNA, 3245 bp, Homo sapiens
actggcggcgcttgccgccaaggggcagagcgagctcccgagtgggtctggagccgcggagctgggcgggggcgggaaggaggtagcgagaaaagaaactggagaaactcggtggccctcttaacgccgccccagagagaccagttgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactgctgtgtctgctgcccccacagagaaggagtttccaaaaactcactctgatgtatcttcagaacagcaacatttgaagggccagactggcaccaacggtggcaatgtgaaattgtataccacagaccaaagcacctttgacattttgcaggatttggagttttcttctgggtccccaggtaaagagacgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagccccagtaatgtaacactgccccaagtgaaaacagaaaaagaagatttcatcgaactctgcacccctggggtaattaagcaagagaaactgggcacagtttactgtcaggcaagctttcctggagcaaatataattggtaataaaatgtctgccatttctgttcatggtgtgagtacctctggaggacagatgtaccactatgacatgaatacagcatccctttctcaacagcaggatcagaagcctatttttaatgtcattccaccaattcccgttggttccgaaaattggaataggtgccaaggatctggagatgacaacttgacttctctggggactctgaacttccctggtcgaacagttttttctaatggctattcaagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggtagacagcacaattacctatgtgctggaaggaatgattgcatcatcgataaaattcgaagaaaaaactgcccagcatgccgctatcgaaaatgtcttcaggctggaatgaacctggaagctcgaaaaacaaagaaaaaaataaaaggaattcagcaggccactacaggagtctcacaagaaacctctgaaaatcctggtaacaaaacaatagttcctgcaacgttaccacaactcacccctaccctggtgtcactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtttcaggaacttacacctggatgaccaaatgaccctactgcagtactcctggatgtttcttatggcatttgctctggggtggagatcatatagacaatcaagtgcaaacctgctgtgttttgctcctgatctgattattaatgagcagagaatgactctaccctgcatgtacgaccaatgtaaacacatgctgtatgtttcctctgagttacacaggcttcaggtatcttatgaagagtatctctgtatgaaaaccttactgcttctctcttcagttcctaaggacggtctgaagagccaagagctatttgatgaaattagaatgacctacatcaaagagctaggaaaagccattgtcaagagggaaggaaactccagccagaactggcagcggttttatcaactgacaaaactcttggattctatgcatgaagtggttgaaaatctccttaactattgcttccaaacatttttggataagaccatgagtattgaattccccgagatgttagctgaaatcatcaccaatcagataccaaaatattcaaatggaaatatcaaaaaacttctgtttcatcaaaagtgactgccttaataagaatggttgccttaaagaaagtcgaattaatagcttttattgtataaactatcagtttgtcctgtagaggttttgttgttttattttttattgttttcatctgttgttttgttttaaatacgcactacatgtggtttatagagggccaagacttggcaacagaagcagttgagtcgtcatcacttttcagtgatgggagagtagatggtgaaatttattagttaatatatcccagaaattagaaaccttaatatgtggacgtaatctccacagtcaaagaaggatggcacctaaaccaccagtgcccaaagtctgtgtgatgaactttctcttcatactttttttcacagttggctggatgaaattttctagactttctgttggtgtatcccccccctgtatagttaggatagcatttttgatttatgcatggaaacctgaaaaaaagtttacaagtgtatatcagaaaagggaagttgtgccttttatagctattactgtctggttttaacaatttcctttatatttagtgaactacgcttgctcattttttcttacataattttttattcaagttattgtacagctgtttaagatgggcagctagttcgtagctttcccaaataaactctaaacattaatcaatcatctgtgtgaaaatgggttggtgcttctaacctgatggcacttagctatcagaagaccacaaaaattgactcaaatctccagtattcttgtc

SEQ ID NO: 2911 - DNA, 3789 bp, Homo sapiens
tttttagaaaaaaaaaatatatttccctcctgctccttctgcgttcacaagctaagttgtttatctcggctgcggcgggaactgcggacggtggcgggcgagcggctcctctgccagagttgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactgctgtgtctgctgcccccacagagaaggagtttccaaaaactcactctgatgtatcttcagaacagcaacatttgaagggccagactggcaccaacggtggcaatgtgaaattgtataccacagaccaaagcacctttgacattttgcaggatttggagttttcttctgggtccccaggtaaagagacgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagccccagtaatgtaacactgccccaagtgaaaacagaaaaagaagatttcatcgaactctgcacccctggggtaattaagcaagagaaactgggcacagtttactgtcaggcaagctttcctggagcaaatataattggtaataaaatgtctgccatttctgttcatggtgtgagtacctctggaggacagatgtaccactatgacatgaatacagcatccctttctcaacagcaggatcagaagcctatttttaatgtcattccaccaattcccgttggttccgaaaattggaataggtgccaaggatctggagatgacaacttgacttctctggggactctgaacttccctggtcgaacagttttttctaatggctattcaagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggacagcacaattacctatgtgctggaaggaatgattgcatcatcgataaaattcgaagaaaaaactgcccagcatgccgctatcgaaaatgtcttcaggctggaatgaacctggaagctcgaaaaacaaagaaaaaaataaaaggaattcagcaggccactacaggagtctcacaagaaacctctgaaaatcctggtaacaaaacaatagttcctgcaacgttaccacaactcacccctaccctggtgtcactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtttcaggaacttacacctggatgaccaaatgaccctactgcagtactcctggatgtttcttatggcatttgctctggggtggagatcatatagacaatcaagtgcaaacctgctgtgttttgctcctgatctgattattaatgagcagagaatgactctaccctgcatgtacgaccaatgtaaacacatgctgtatgtttcctctgagttacacaggcttcaggtatcttatgaagagtatctctgtatgaaaaccttactgcttctctcttcagttcctaaggacggtctgaagagccaagagctatttgatgaaattagaatgacctacatcaaagagctaggaaaagccattgtcaagagggaaggaaactccagccagaactggcagcggttttatcaactgacaaaactcttggattctatgcatgaaaatgttatgtggttaaaaccagaaagcacatctcacacattaatctgattttcatcccaacaatcttggcgctcaaaaaatagaactcaatgagaaaaagaagattatgtgcacttcgttgtcaataataagtcaactgatgctcatcgacaactataggaggcttttcattaaatgggaaaagaagctgtgcccttttaggatacgtgggggaaaagaaagtcatcttaattatgtttaattgtggatttaagtgctatatggtggtgctgtttgaaagcagatttatttcctatgtatgtgttatctggccatcccaacccaaactgttgaagtttgtagtaacttcagtgagagttggttactcacaacaaatcctgaaaagtatttttagtgtttgtaggtattctgtgggatactatacaagcagaactgaggcacttaggacataacacttttggggtatatatatccaaatgcctaaaactatgggaggaaaccttggccaccccaaaaggaaaactaacatgatttgtgtctatgaagtgctggataattagcatgggatgagctctgggcatgccatgaaggaaagccacgctcccttcagaattcagaggcagggagcaattccagtttcacctaagtctcataattttagttcccttttaaaaaccctgaaaactacatcaccatggaatgaaaaatattgttatacaatacattgatctgtcaaacttccagaaccatggtagccttcagtgagatttccatcttggctggtcactccctgactgtagctgtaggtgaatgtgtttttgtgtgtgtgtgtctggttttagtgtcagaagggaaataaaagtgtaaggaggacactttaaaccctttgggtggagtttcgtaatttcccagactattttcaagcaacctggtccacccaggattagtgaccaggttttcaggaaaggatttgcttctctctagaaaatgtctgaaaggattttattttctgatgaaaggctgtatgaaaataccctcctcaaataacttgcttaactacatatagattcaagtgtgtcaatattctattttgtatattaaatgctatataatggggacaaatctatattatactgtgtatggcattattaagaagctttttcattattttttatcacagtaattttaaaatgtgtaaaaattaaaaccagtgactcctgtttaaaaataaaagttgtagttttttattcatgctgaataataatctgtagttaaaaaaaaagtgtctttttacctacgcagtgaaatgtcagactgtaaaaccttgtgtggaaatgtttaacttttattttttcatttaaatttgctgttctggtattaccaaaccacacatttgtaccgaattggcagtaaatgttagccatttacagcaatgccaaatatggagaaacatcataataaaaaaatctgcttttt

SEQ ID NO: 2912 - DNA, 1430 bp, Homo sapiens
agtgcgagagcgcggcggcggcagctgaagacccggccgcccagatgatgcggtggtgggggacctgccggcacgcgactccccccgggcccaaaccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggacagcacaattacctatgtgctggaaggaatgattgcatcatcgataaaattcgaagaaaaaactgcccagcatgccgctatcgaaaatgtcttcaggctggaatgaacctggaagctcgaaaaacaaagaaaaaaataaaaggaattcagcaggccactacaggagtctcacaagaaacctctgaaaatcctggtaacaaaacaatagttcctgcaacgttaccacaactcacccctaccctggtgtcactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtttcaggaacttacacctggatgaccaaatgaccctactgcagtactcctggatgtttcttatggcatttgctctggggtggagatcatatagacaatcaagtgcaaacctgctgtgttttgctcctgatctgattattaatgagcagagaatgactctaccctgcatgtacgaccaatgtaaacacatgctgtatgtttcctctgagttacacaggcttcaggtatcttatgaagagtatctctgtatgaaaaccttactgcttctctcttcagttcctaaggacggtctgaagagccaagagctatttgatgaaattagaatgacctacatcaaagagctaggaaaagccattgtcaagagggaaggaaactccagccagaactggcagcggttttatcaactgacaaaactcttggattctatgcatgaagtggttgaaaatctccttaactattgcttccaaacatttttggataagaccatgagtattgaattccccgagatgttagctgaaatcatcaccaatcagataccaaaatattcaaatggaaatatcaaaaaacttctgtttcatcaaaagtgactgccttaataagaatggttgccttaaagaaagtcgaattaatagcttttattgtataaactatcagtttgtcctgtagaggttttgttgttttattttttattgttttcatctgttgttttgttttaaatacgcactacatgtggtttatagagggccaagacttggcaacagaagcagttgag

SEQ ID NO: 2913 - DNA, 4591 bp, Homo sapiens
ttgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactgctgtgtctgctgcccccacagagaaggagtttccaaaaactcactctgatgtatcttcagaacagcaacatttgaagggccagactggcaccaacggtggcaatgtgaaattgtataccacagaccaaagcacctttgacattttgcaggatttggagttttcttctgggtccccaggtaaagagacgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagccccagtaatgtaacactgccccaagtgaaaacagaaaaagaagatttcatcgaactctgcacccctggggtaattaagcaagagaaactgggcacagtttactgtcaggcaagctttcctggagcaaatataattgcatccctttctcaacagcaggatcagaagcctatttttaatgtcattccaccaattcccgttggttccgaaaattggaataggtgccaaggatctggagatgacaacttgacttctctggggactctgaacttccctggtcgaacagttttttctaatggctattcaagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggacagcacaattacctatgtgctggaaggaatgattgcatcatcgataaaattcgaagaaaaaactgcccagcatgccgctatcgaaaatgtcttcaggctggaatgaacctggaagctcgaaaaacaaagaaaaaaataaaaggaattcagcaggccactacaggagtctcacaagaaacctctgaaaatcctggtaacaaaacaatagttcctgcaacgttaccacaactcacccctaccctggtgtcactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtttcaggaacttacacctggatgaccaaatgaccctactgcagtactcctggatgtttcttatggcatttgctctggggtggagatcatatagacaatcaagtgcaaacctgctgtgttttgctcctgatctgattattaatgagcagagaatgactctaccctgcatgtacgaccaatgtaaacacatgctgtatgtttcctctgagttacacaggcttcaggtatcttatgaagagtatctctgtatgaaaaccttactgcttctctcttcagttcctaaggacggtctgaagagccaagagctatttgatgaaattagaatgacctacatcaaagagctaggaaaagccattgtcaagagggaaggaaactccagccagaactggcagcggttttatcaactgacaaaactcttggattctatgcatgaagtggttgaaaatctccttaactattgcttccaaacatttttggataagaccatgagtattgaattccccgagatgttagctgaaatcatcaccaatcagataccaaaatattcaaatggaaatatcaaaaaacttctgtttcatcaaaagtgactgccttaataagaatggttgccttaaagaaagtcgaattaatagcttttattgtataaactatcagtttgtcctgtagaggttttgttgttttattttttattgttttcatctgttgttttgttttaaatacgcactacatgtggtttatagagggccaagacttggcaacagaagcagttgagtcgtcatcacttttcagtgatgggagagtagatggtgaaatttattagttaatatatcccagaaattagaaaccttaatatgtggacgtaatctccacagtcaaagaaggatggcacctaaaccaccagtgcccaaagtctgtgtgatgaactttctcttcatactttttttcacagttggctggatgaaattttctagactttctgttggtgtatcccccccctgtatagttaggatagcatttttgatttatgcatggaaacctgaaaaaaagtttacaagtgtatatcagaaaagggaagttgtgccttttatagctattactgtctggttttaacaatttcctttatatttagtgaactacgcttgctcattttttcttacataattttttattcaagttattgtacagctgtttaagatgggcagctagttcgtagctttcccaaataaactctaaacattaatcaatcatctgtgtgaaaatgggttggtgcttctaacctgatggcacttagctatcagaagaccacaaaaattgactcaaatctccagtattcttgtcaaaaaaaaaaaaaaaaaagctcatattttgtatatatctgcttcagtggagaattatataggttgtgcaaattaacagtcctaactggtatagagcacctagtccagtgacctgctgggtaaactgtggatgatggttgcaaaagactaatttaaaaaataactaccaagaggccctgtctgtacctaacgccctatttttgcaatggctatatggcaagaaagctggtaaactatttgtctttcaggaccttttgaagtagtttgtataacttcttaaaagttgtgattccagataaccagctgtaacacagctgagagacttttaatcagacaaagtaattcctctcactaaactttacccaaaaactaaatctctaatatggcaaaaatggctagacacccattttcacattcccatctgtcaccaattggttaatctttcctgatggtacaggaaagctcagctactgatttttgtgatttagaactgtatgtcagacatccatgtttgtaaaactacacatccctaatgtgtgccatagagtttaacacaagtcctgtgaatttcttcactgttgaaaattattttaaacaaaatagaagctgtagtagccctttctgtgtgcaccttaccaactttctgtaaactcaaaacttaacatatttactaagccacaagaaatttgatttctattcaaggtggccaaattatttgtgtaatagaaaactgaaaatctaatattaaaaatatggaacttctaatatatttttatatttagttatagtttcagatatatatcatattggtattcactaatctgggaagggaagggctactgcagctttacatgcaatttattaaaatgattgtaaaatagcttgtatagtgtaaaataagaatgatttttagatgagattgttttatcatgacatgttatatattttttgtaggggtcaaagaaatgctgatggataacctatatgatttatagtttgtacatgcattcatacaggcagcgatggtctcagaaaccaaacagtttgctctaggggaagagggagatggagactggtcctgtgtgcagtgaaggttgctgaggctctgacccagtgagattacagaggaagttatcctctgcctcccattctgaccacccttctcattccaacagtgagtctgtcagcgcaggtttagtttactcaatctccccttgcactaaagtatgtaaagtatgtaaacaggagacaggaaggtggtgcttacatccttaaaggcaccatctaatagcgggttactttcacatacagccctcccccagcagttgaatgacaacagaagcttcagaagtttggcaatagtttgcatagaggtaccagcaatatgtaaatagtgcagaatctcataggttgccaataatacactaattcctttctatcctacaacaagagtttatttccaaataaaatgaggacatgtttttgttttctttgaatgctttttgaatgttatttgttattttcagtattttggagaaattatttaataaaaaaacaatcatttgctttttg

SEQ ID NO: 2914 - DNA, 585 bp, Homo sapiens
gtactcaaaggtttggatgtgtgactagctggtaggagggaaatttggaagtaattagggattgagaattctagcatagtatttatcaaatgttatatgtattggttctcagaaaagcaaacagccgtgattgaaaagagttgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatcc

SEQ ID NO: 2915 - DNA, 498 bp, Homo sapiens
aatccagctcgctggaggttttgcatttggcgtgcaacttccttcgagtttgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactg

SEQ ID NO: 2916 - DNA, 2594 bp, Homo sapiens
gcagactcggggaagagggtgggggacggtcggggcgcgggggagggtgggttctgctttgcaacttctctcccagtgcgagagcgcggcggcggcagctgaagacccggccgcccagatgatgcggtggtgggggacctgccggcacgcgactccccccgggcccaaattgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactgctgtgtctgctgcccccacagagaaggagtttccaaaaactcactctgatgtatcttcagaacagcaacatttgaagggccagactggcaccaacggtggcaatgtgaaattgtataccacagaccaaagcacctttgacattttgcaggatttggagttttcttctgggtccccaggtaaagagacgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagccccagtaatgtaacactgccccaagtgaaaacagaaaaagaagatttcatcgaactctgcacccctggggtaattaagcaagagaaactgggcacagtttactgtcaggcaagctttcctggagcaaatataattggtaataaaatgtctgccatttctgttcatggtgtgagtacctctggaggacagatgtaccactatgacatgaatacagcatccctttctcaacagcaggatcagaagcctatttttaatgtcattccaccaattcccgttggttccgaaaattggaataggtgccaaggatctggagatgacaacttgacttctctggggactctgaacttccctggtcgaacagttttttctaatggctattcaagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggacagcacaattacctatgtgctggaaggaatgattgcatcatcgataaaattcgaagaaaaaactgcccagcatgccgctatcgaaaatgtcttcaggctggaatgaacctggaagctcgaaaaacaaagaaaaaaataaaaggaattcagcaggccactacaggagtctcacaagaaacctctgaaaatcctggtaacaaaacaatagttcctgcaacgttaccacaactcacccctaccctggtgtcactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtttcaggaacttacacctggatgaccaaatgaccctactgcagtactcctggatgtttcttatggcatttgctctggggtggagatcatatagacaatcaagtgcaaacctgctgtgttttgctcctgatctgattattaatgagcagagaatgactctaccctgcatgtacgaccaatgtaaacacatgctgtatgtttcctctgagttacacaggcttcaggtatcttatgaagagtatctctgtatgaaaaccttactgcttctctcttcagttcctaaggacggtctgaagagccaagagctatttgatgaaattagaatgacctacatcaaagagctaggaaaagccattgtcaagagggaaggaaactccagccagaactggcagcggttttatcaactgacaaaactcttggattctatgcatgaagtggttgaaaatctccttaactattgcttccaaacatttttggataagaccatgagtattgaattccccgagatgttagctgaaatcatcaccaatcagataccaaaatattcaaatggaaatatcaaaaaacttctgtttcatcaaaagtgactgccttaataagaatggttgccttaaagaaagtcgaattaatagcttttattgtataaactatcagtttgtcctgta

SEQ ID NO: 2917 - DNA, 3389 bp, Homo sapiens
gataagcacttaatgagtgccttctctgtgcgagaatggggaggaacaaaatgcagctcctaccctcctcgggctttagttgtaccttaataacaggaattttcatctgcctggctcctttcctcaaagaacaaagaagactttgcttcattaaagtgtctgagaaggaaggatccctctggctggtgtgtgaagaattaactgtagatgggcaagtgtggaaggaaggagagcagtcaggaagctgccataaccatctacatgagagagttgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactgctgtgtctgctgcccccacagagaaggagtttccaaaaactcactctgatgtatcttcagaacagcaacatttgaagggccagactggcaccaacggtggcaatgtgaaattgtataccacagaccaaagcacctttgacattttgcaggatttggagttttcttctgggtccccaggtaaagagacgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagccccagtaatgtaacactgccccaagtgaaaacagaaaaagaagatttcatcgaactctgcacccctggggtaattaagcaagagaaactgggcacagtttactgtcaggcaagctttcctggagcaaatataattggtaataaaatgtctgccatttctgttcatggtgtgagtacctctggaggacagatgtaccactatgacatgaatacagcatccctttctcaacagcaggatcagaagcctatttttaatgtcattccaccaattcccgttggttccgaaaattggaataggtgccaaggatctggagatgacaacttgacttctctggggactctgaacttccctggtcgaacagttttttctaatggctattcaagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggtagacagcacaattacctatgtgctggaaggaatgattgcatcatcgataaaattcgaagaaaaaactgcccagcatgccgctatcgaaaatgtcttcaggctggaatgaacctggaagctcgaaaaacaaagaaaaaaataaaaggaattcagcaggccactacaggagtctcacaagaaacctctgaaaatcctggtaacaaaacaatagttcctgcaacgttaccacaactcacccctaccctggtgtcactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtttcaggaacttacacctggatgaccaaatgaccctactgcagtactcctggatgtttcttatggcatttgctctggggtggagatcatatagacaatcaagtgcaaacctgctgtgttttgctcctgatctgattattaatgagcagagaatgactctaccctgcatgtacgaccaatgtaaacacatgctgtatgtttcctctgagttacacaggcttcaggtatcttatgaagagtatctctgtatgaaaaccttactgcttctctcttcagttcctaaggacggtctgaagagccaagagctatttgatgaaattagaatgacctacatcaaagagctaggaaaagccattgtcaagagggaaggaaactccagccagaactggcagcggttttatcaactgacaaaactcttggattctatgcatgaagtggttgaaaatctccttaactattgcttccaaacatttttggataagaccatgagtattgaattccccgagatgttagctgaaatcatcaccaatcagataccaaaatattcaaatggaaatatcaaaaaacttctgtttcatcaaaagtgactgccttaataagaatggttgccttaaagaaagtcgaattaatagcttttattgtataaactatcagtttgtcctgtagaggttttgttgttttattttttattgttttcatctgttgttttgttttaaatacgcactacatgtggtttatagagggccaagacttggcaacagaagcagttgagtcgtcatcacttttcagtgatgggagagtagatggtgaaatttattagttaatatatcccagaaattagaaaccttaatatgtggacgtaatctccacagtcaaagaaggatggcacctaaaccaccagtgcccaaagtctgtgtgatgaactttctcttcatactttttttcacagttggctggatgaaattttctagactttctgttggtgtatcccccccctgtatagttaggatagcatttttgatttatgcatggaaacctgaaaaaaagtttacaagtgtatatcagaaaagggaagttgtgccttttatagctattactgtctggttttaacaatttcctttatatttagtgaactacgcttgctcattttttcttacataattttttattcaagttattgtacagctgtttaagatgggcagctagttcgtagctttcccaaataaactctaaacattaatcaatcatctgtgtgaaaatgggttggtgcttctaacctgatggcacttagctatcagaagaccacaaaaattgactcaaatctccagtattcttgtcaaaaaaaaaaaaaaaaaa

SEQ ID NO: 2918 - DNA, 547 bp, Homo sapiens
cgtgcaggcgccgtcggggccggggtggcggggcccgcgcggagggcgtgggggcagggaccgcgggcgcccctgcagttgccaagcgtcaccaacagttgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactg

SEQ ID NO: 2919 - DNA, 585 bp, Homo sapiens
ggcgcctggcttgaggagggcgtgcggggcgcgtgagggtgcacacgcggggggctgacagcccgcaacttggagactgcggccggggccggcgttatctgttagaagtgggcgtgtcggagagagaactcaacagttgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactg

SEQ ID NO: 2920 - DNA, 623 bp, Homo sapiens
ggctgtggccgagcgcccgagcaggattaggtggagctgcggcagcccccgcccgtgtcaggagctggcaagcgatgtcacctgtgggggcgcaaaagttacctccccaaaccctaaacccacacagcacaacctttcccagagtcacaaaaatcataatctgtgccgcacaagttgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactg

SEQ ID NO: 2921 - DNA, 4982 bp, Homo sapiens
caggccctcatcaccttttttcaagtcaagatttcatcccatacatgcatgactcaatcagatttggaaatgtggatatgccctgcgtccaagcccaatatagcccttcccctccaggttccagttatgcggcgcagacatacagctcggaatacaccacggagatcatgaaccccgactacaccaagctgaccatggaccttggcagcactgagatcacggctacagccaccacgtccctgcccagcatcagtaccttcgtggagggctactcgagcaactacgaactcaagccttcctgcgtgtaccaaatgcagcggcccttgatcaaagtggaggaggggcgggcgcccagctaccatcaccatcaccaccaccaccaccaccaccaccaccatcaccagcagcagcatcagcagccatccattcctccagcctccagcccggaggacgaggtgctgcccagcacctccatgtacttcaagcagtccccaccgtccacccccaccacgccggccttccccccgcaggcgggggcgttatgggacgaggcactgccctcggcgcccggctgcatcgcacccggcccgctgctggacccgccgatgaaggcggtccccacggtggccggcgcgcgcttcccgctcttccacttcaagccctcgccgccgcatccccccgcgcccagcccggccggcggccaccacctcggctacgacccgacggccgctgccgcgctcagcctgccgctgggagccgcagccgccgcgggcagccaggccgccgcgcttgagagccacccgtacgggctgccgctggccaagagggcggccccgctggccttcccgcctctcggcctcacgccctcccctaccgcgtccagcctgctgggcgagagtcccagcctgccgtcgccgcccagcaggagctcgtcgtctggcgagggcacgtgtgccgtgtgcggggacaacgccgcctgccagcactacggcgtgcgaacctgcgagggctgcaagggctttttcaagagaacagtgcagaaaaatgcaaaatatgtttgcctggcaaataaaaactgcccagtagacaagagacgtcgaaaccgatgtcagtactgtcgatttcagaagtgtctcagtgttggaatggtaaaagaagttgtccgtacagatagtctgaaagggaggagaggtcgtctgccttccaaaccaaagagcccattacaacaggaaccttctcagccctctccaccttctcctccaatctgcatgatgaatgcccttgtccgagctttaacagactcaacacccagagatcttgattattccagatactgtcccactgaccaggctgctgcaggcacagatgctgagcatgtgcaacaattctacaacctcctgacagcctccattgatgtatccagaagctgggcagaaaagattccgggatttactgatctccccaaagaagatcagacattacttattgaatcagcctttttggagctgtttgtcctcagactttccatcaggtcaaacactgctgaagataagtttgtgttctgcaatggacttgtcctgcatcgacttcagtgccttcgtggatttggggagtggctcgactctattaaagacttttccttaaatttgcagagcctgaaccttgatatccaagccttagcctgcctgtcagcactgagcatgatcacagaaagacatgggttaaaagaaccaaagagagtcgaagagctatgcaacaagatcacaagcagtttaaaagaccaccagagtaagggacaggctctggagcccaccgagtccaaggtcctgggtgccctggtagaactgaggaagatctgcaccctgggcctccagcgcatcttctacctgaagctggaagacttggtgtctccaccttccatcattgacaagctcttcctggacaccctacctttctaatcaggagcagtggagcagtgagctgcctcctctcctagcacctgcttgctacgcagcaaagggataggtttggaaacctatcatttcctgtccttccttaagaggaaaagcagctcctgtagaaagcaaagactttcttttttttctggctcttttccttacaacctaaagccagaaaacttgcagagtattgtgttggggttgtgttttatatttaggcattgggggatggggtgggagggggttatagttcatgagggttttctaagaaattgctaacaaagcacttttggacaatgctatcccagcaggaaaaaaaaggataatataactgttttaaaactctttctggggaatccaattatagttgctttgtatttaaaaacaagaacagccaagggttgttcgccagggtaggatgtgtcttaaagattggtcccttgaaaatatgcttcctgtatcaaaggtacgtatgtggtgcaaacaaggcagaaacttccttttaatttccttcttcctttattttaacaaatggtgaaagatggaggattacctacaaatcagacatggcaaaacaataatggctgtttgcttccataaacaagtgcaattttttaaagtgctgtcttactaagtcttgtttattaactctcctttattctatatggaaataaaaaggaggcagtcatgttagcaaatgacacgttaatatccctagcagaggctgtgttcaccttccctgtcgatcccttctgaggtatggcccatccaagacttttaggccattcttgatggaaccagatccctgccctgactgtccagctatcctgaaagtggatcagattataaactggattacatgtaactgttttggttgtgttctatcaaccccaccagagttccctaaacttgcttcagttatagtaactgactggtatattcattcagaagcgccataagtcagttgagtatttgatccctagataagaacatgcaaatcagcaggaactggtcatacagggtaagcaccagggacaataaggatttttatagatataatttaatttttgttattggttaaggagacaattttggagagcaagcaaatctttttaaaaaatagtatgaatgtgaatactagaaaagatttaaaaaatagtatgagtgtgagtactaggaaggattagtgggctgcgtttcaacattccgtgttcgtactcccttttgtatgtttctactgttaatgccatattactatgagataatttgttgcatagtgtccttatttgtataaacatttgtatgcacgttatattgtaatagctttgcctgtatttattgcaagaccaccagctcctggaagctgagttacagagtaattaaatggggtgttcacagtgacttggatacaccaattagaaattaaataagcaaatatatatatatatataaatatagcaggttacatatatatatttataatgtgtctttttattaaccatttgtacaataaatgtcacttcccatgccgttattttatggttcatttgcagtgacttttaaggcagtactgtttagcactttgatattaaaattttgcttatgttttgctaaattcgaataatgtttgaagatttttaggtctaaaagtctttatattatatactctgtatcaagtcaaaatatctttggccattttgctaagaaacaaactttgaatgtcaaactgatgtcacagtagtttttgttagctttaaatcatttttgctttagtctttttaaaggaaaataacaaaactatgctgtttatattgtcattaaattatacaatcaaacaaatgccaaatgaattgcctaattgctgcaaagtataacccagataggaaatcatatgtttttttccaagagtcattctaatatttgattatgttatgtgtgcttttatgaaagattgttatttttatatatcaagatgatagaacctggaatgttaggattttgaaatgttagacttggaaggggcctggtctgtcaactagtccaaccccttaaaattcatagaggagcaaactggggcccattgaagggtgaagagttactcaaggtcaaacagctggtaacagaatcaagactaagacctaatttacctttccatactctttttttttctcaacttcatctatataaaatcaggcttttaaacataaccactaatatttacctgaagataaccatgagtaaagtatacttttgcattaattttttgagcttatatgcaaacataataaatattattaaatatcaggaaagctaacatttcatacaagatagcttcagaccaaattcaaattgaatttgaataaattagaaatactgtgcatacataaccttcttgtgcaccatgagtatttggaaagttaatccttgtttttgtcgtgtctataaaggaagaacaaaacaaaataaaaacagagccctagagaaatgctgttactttttatttttacacccatcagatttaaggaaaagactttttagccattataatctagtggttggaaggaatgaagaagcttttttagtaataggtccagatatgagtgctaaaaataaagatgatagcatgttcttctgtcttccatagttattacaactatgagagcctcccaagtcatcttatcaactcaactcccttttttttgtcttaatgttgcacataagtttatacagagtggatgaccacactagcacagaagagaacaacatgtattaaagcaggtgattcctccccttggcgggagagctctctcagtgtgaacatgccttctgtgggcggaaatcaggaagccaccagctgttaatggagagtgccttgcttttatttcagacagcagagttttccaaagtttctctgctcctctaacagcattgctctttagtgtgtgttaacctgtggtttgaaagaaatgctcttgtacattaacaatgtaaatttaaatgattaaattacattttatcaatggc

SEQ ID NO: 2922 - DNA, 2588 bp, Homo sapiens
ataaatgacgtgccgagagagcgagcgaacgcgcagccgggagagcggagtctcctgcctcccgccccccacccctccagctcctgctcctcctccgctccccatacacagacgcgctcacacccgctccctcactcgcacacacagacacaagcgcgcacacaggctccgcacacacacttcgctctcccgcgcgctcacacccctcttgccctgagcccttgccggtgcagcgcggcgccgcagctggacgcccctcccgggctcactttgcaacgctgacggtgccggcagtggccgtggaggtgggaacagcggcggcatcctcccccctggtcacagcccaagccaggacgcccgcggaacctctcggctgtgctctcccatgagtcgggatcgcagcatcccccaccagccgctcaccgcctccgggagccgctgggcttgtacaccgcagcccttccgggacagcagctgtgactcccccccagtgcagatttcgggacagctctctagaaactcgctctaaagacggaaccgccacagcactcaaagcccactgcggaagagggcagcccggcaagcccgggccctgagcctggacccttagcggtgccgggcagcactgccggcgcttcgcctcgccggacgtccgctcctcctacactctcagcctccgctggagagacccccagccccaccattcagcgcgcaagataccctccagatatgccctgcgtccaagcccaatatagcccttcccctccaggttccagttatgcggcgcagacatacagctcggaatacaccacggagatcatgaaccccgactacaccaagctgaccatggaccttggcagcactgagatcacggctacagccaccacgtccctgcccagcatcagtaccttcgtggagggctactcgagcaactacgaactcaagccttcctgcgtgtaccaaatgcagcggcccttgatcaaagtggaggaggggcgggcgcccagctaccatcaccatcaccaccaccaccaccaccaccaccaccatcaccagcagcagcatcagcagccatccattcctccagcctccagcccggaggacgaggtgctgcccagcacctccatgtacttcaagcagtccccaccgtccacccccaccacgccggccttccccccgcaggcgggggcgttatgggacgaggcactgccctcggcgcccggctgcatcgcacccggcccgctgctggacccgccgatgaaggcggtccccacggtggccggcgcgcgcttcccgctcttccacttcaagccctcgccgccgcatccccccgcgcccagcccggccggcggccaccacctcggctacgacccgacggccgctgccgcgctcagcctgccgctgggagccgcagccgccgcgggcagccaggccgccgcgcttgagagccacccgtacgggctgccgctggccaagagggcggccccgctggccttcccgcctctcggcctcacgccctcccctaccgcgtccagcctgctgggcgagagtcccagcctgccgtcgccgcccagcaggagctcgtcgtctggcgagggcacgtgtgccgtgtgcggggacaacgccgcctgccagcactacggcgtgcgaacctgcgagggctgcaagggctttttcaagagaacagtgcagaaaaatgcaaaatatgtttgcctggcaaataaaaactgcccagtagacaagagacgtcgaaaccgatgtcagtactgtcgatttcagaagtgtctcagtgttggaatggtaaaagaagttgtccgtacagatagtctgaaagggaggagaggtcgtctgccttccaaaccaaagagcccattacaacaggaaccttctcagccctctccaccttctcctccaatctgcatgatgaatgcccttgtccgagctttaacagactcaacacccagagatcttgattattccagagtaagttttatgatttcctgctttcaaatgaatgatcagggtctctatttatggctactagtaataagagttgattgaatgattttgtgtctggcaccatgttagacagttttcatactttttctatatttctcgcttcatttagcaattcagtgcatccattgcagcaaataatttttgccttattgaatctctaaatgccttaacaagtgaccctgacagtgctgcacctgtcatacacattgttgcaggattcctggtggttgtgccaatgaaaatctgcacagacaaactacaatttgtagatttatctcgtgatctagacaaagtgactactgttttttttcatattgtgttcaaaccatctgggtgagcctcaagttattactaagcagtttatccaattgcatcagcattgattgacctgctgcttattcagagggattagaccattggtggagagaagcgagctctggctgtgacatcagttgtcaggagaactgggatggaacgccacctctgctacttcctgcctgtgtcacctggttcctgcttttggctctctcctgcctacagtggaaatggctacaatatttaacctcaga

SEQ ID NO: 2923 - DNA, 2133 bp, Homo sapiens
gagcgagcgaacgcgcagccgggagagcggagtctcctgcctcccgccccccacccctccagctcctgctcctcctccgctccccatacacagacgcgctcacacccgctccctcactcgcacacacagacacaagcgcgcacacaggctccgcacacacacttcgctctcccgcgcgctcacacccctcttgccctgagcccttgccggtgcagcgcggcgccgcagctggacgcccctcccgggctcactttgcaacgctgacggtgccggcagtggccgtggaggtgggaacagcggcggcatcctcccccctggtcacagcccaagccaggacgcccgcggaacctctcggctgtgctctcccatgagtcgggatcgcagcatcccccaccagccgctcaccgcctccgggagccgctgggcttgtacaccgcagcccttccgggacagcagctgtgactcccccccagtgcagatttcgggacagctctctagaaactcgctctaaagacggaaccgccacagcactcaaagcccactgcggaagagggcagcccggcaagcccgggccctgagcctggacccttagcggtgccgggcagcactgccggcgcttcgcctcgccggacgtccgctcctcctacactctcagcctccgctggagagacccccagccccaccattcagcgcgcaagataccctccagatatgccctgcgtccaagcccaatatagcccttcccctccaggttccagttatgcggcgcagacatacagctcggaatacaccacggagatcatgaaccccgactacaccaagctgaccatggaccttggcagcactgagatcacggctacagccaccacgtccctgcccagcatcagtaccttcgtggagggctactcgagcaactacgaactcaagccttcctgcgtgtaccaaatgcagcggcccttgatcaaagtggaggaggggcgggcgcccagctaccatcaccatcaccaccaccaccaccaccaccaccaccatcaccagcagcagcatcagcagccatccattcctccagcctccagcccggaggacgaggtgctgcccagcacctccatgtacttcaagcagtccccaccgtccacccccaccacgccggccttccccccgcaggcgggggcgttatgggacgaggcactgccctcggcgcccggctgcatcgcacccggcccgctgctggacccgccgatgaaggcggtccccacggtggccggcgcgcgcttcccgctcttccacttcaagccctcgccgccgcatccccccgcgcccagcccggccggcggccaccacctcggctacgacccgacggccgctgccgcgctcagcctgccgctgggagccgcagccgccgcgggcagccaggccgccgcgcttgagagccacccgtacgggctgccgctggccaagagggcggccccgctggccttcccgcctctcggcctcacgccctcccctaccgcgtccagcctgctgggcgagagtcccagcctgccgtcgccgcccagcaggagctcgtcgtctggcgagggcacgtgtgccgtgtgcggggacaacgccgcctgccagcactacggcgtgcgaacctgcgagggctgcaagggctttttcaagagaacagtgcagaaaaatgcaaaatatgtttgcctggcaaataaaaactgcccagtagacaagagacgtcgaaaccgatgtcagtactgtcgatttcagaagtgtctcagtgttggaatggtaaaagaagttgtccgtacagatagtctgaaagggaggagaggtcgtctgccttccaaaccaaagagcccattacaacaggaaccttctcagccctctccaccttctcctccaatctgcatgatgaatgcccttgtccgagctttaacagactcaacacccagagatcttgattattccagagtaagttttatgatttcctgctttcaaatgaatgatcagggtctctatttatggctactagtaataagagtgttagacagttttcatactttttctatatttctcgcttcatttagcaattcagtgcatccattgcagcaaataatttttgccttattgaatctctaa

SEQ ID NO: 2924 - DNA, 3794 bp, Homo sapiens
ataaatgacgtgccgagagagcgagcgaacgcgcagccgggagagcggagtctcctgcctcccgccccccacccctccagctcctgctcctcctccgctccccatacacagacgcgctcacacccgctccctcactcgcacacacagacacaagcgcgcacacaggctccgcacacacacttcgctctcccgcgcgctcacacccctcttgccctgagcccttgccggtgcagcgcggcgccgcagctggacgcccctcccgggctcactttgcaacgctgacggtgccggcagtggccgtggaggtgggaacagcggcggcatcctcccccctggtcacagcccaagccaggacgcccgcggaacctctcggctgtgctctcccatgagtcgggatcgcagcatcccccaccagccgctcaccgcctccgggagccgctgggcttgtacaccgcagcccttccgggacagcagctgtgactcccccccagtgcagatttcgggacagctctctagaaactcgctctaaagacggaaccgccacagcactcaaagcccactgcggaagagggcagcccggcaagcccgggccctgagcctggacccttagcggtgccgggcagcactgccggcgcttcgcctcgccggacgtccgctcctcctacactctcagcctccgctggagagacccccagccccaccattcagcgcgcaagataccctccagatatgccctgcgtccaagcccaatatagcccttcccctccaggttccagttatgcggcgcagacatacagctcggaatacaccacggagatcatgaaccccgactacaccaagctgaccatggaccttggcagcactgagatcacggctacagccaccacgtccctgcccagcatcagtaccttcgtggagggctactcgagcaactacgaactcaagccttcctgcgtgtaccaaatgcagcggcccttgatcaaagtggaggaggggcgggcgcccagctaccatcaccatcaccaccaccaccaccaccaccaccaccatcaccagcagcagcatcagcagccatccattcctccagcctccagcccggaggacgaggtgctgcccagcacctccatgtacttcaagcagtccccaccgtccacccccaccacgccggccttccccccgcaggcgggggcgttatgggacgaggcactgccctcggcgcccggctgcatcgcacccggcccgctgctggacccgccgatgaaggcggtccccacggtggccggcgcgcgcttcccgctcttccacttcaagccctcgccgccgcatccccccgcgcccagcccggccggcggccaccacctcggctacgacccgacggccgctgccgcgctcagcctgccgctgggagccgcagccgccgcgggcagccaggccgccgcgcttgagagccacccgtacgggctgccgctggccaagagggcggccccgctggccttcccgcctctcggcctcacgccctcccctaccgcgtccagcctgctgggcgagagtcccagcctgccgtcgccgcccagcaggagctcgtcgtctggcgagggcacgtgtgccgtgtgcggggacaacgccgcctgccagcactacggcgtgcgaacctgcgagggctgcaagggctttttcaagagaacagtgcagaaaaatgcaaaatatgtttgcctggcaaataaaaactgcccagtagacaagagacgtcgaaaccgatgtcagtactgtcgatttcagaagtgtctcagtgttggaatggtaaaagaagttgtccgtacagatagtctgaaagggaggagaggtcgtctgccttccaaaccaaagagcccattacaacaggaaccttctcagccctctccaccttctcctccaatctgcatgatgaatgcccttgtccgagctttaacagactcaacacccagagatcttgattattccagatactgtcccactgaccaggctgctgcaggcacagatgctgagcatgtgcaacaattctacaacctcctgacagcctccattgatgtatccagaagctgggcagaaaagattccgggatttactgatctccccaaagaagatcagacattacttattgaatcagcctttttggagctgtttgtcctcagactttccatcaggtcaaacactgctgaagataagtttgtgttctgcaatggacttgtcctgcatcgacttcagtgccttcgtggatttggggagtggctcgactctattaaagacttttccttaaatttgcagagcctgaaccttgatatccaagccttagcctgcctgtcagcactgagcatgatcacagaaagacatgggttaaaagaaccaaagagagtcgaagagctatgcaacaagatcacaagcagtttaaaagaccaccagagtaagggacaggctctggagcccaccgagtccaaggtcctgggtgccctggtagaactgaggaagatctgcaccctgggcctccagcgcatcttctacctgaagctggaagacttggtgtctccaccttccatcattgacaagctcttcctggacaccctacctttctaatcaggagcagtggagcagtgagctgcctcctctcctagcacctgcttgctacgcagcaaagggataggtttggaaacctatcatttcctgtccttccttaagaggaaaagcagctcctgtagaaagcaaagactttcttttttttctggctcttttccttacaacctaaagccagaaaacttgcagagtattgtgttggggttgtgttttatatttaggcattgggggatggggtgggagggggttatagttcatgagggttttctaagaaattgctaacaaagcacttttggacaatgctatcccagcaggaaaaaaaaggataatataactgttttaaaactctttctggggaatccaattatagttgctttgtatttaaaaacaagaacagccaagggttgttcgccagggtaggatgtgtcttaaagattggtcccttgaaaatatgcttcctgtatcaaaggtacgtatgtggtgcaaacaaggcagaaacttccttttaatttccttcttcctttattttaacaaatggtgaaagatggaggattacctacaaatcagacatggcaaaacaataatggctgtttgcttccataaacaagtgcaattttttaaagtgctgtcttactaagtcttgtttattaactctcctttattctatatggaaataaaaaggaggcagtcatgttagcaaatgacacgttaatatccctagcagaggctgtgttcaccttccctgtcgatcccttctgaggtatggcccatccaagacttttaggccattcttgatggaaccagatccctgccctgactgtccagctatcctgaaagtggatcagattataaactggattacatgtaactgttttggttgtgttctatcaaccccaccagagttccctaaacttgcttcagttatagtaactgactggtatattcattcagaagcgccataagtcagttgagtatttgatccctagataagaacatgcaaatcagcaggaactggtcatacagggtaagcaccagggacaataaggatttttatagatataatttaatttttgttattggttaaggagacaattttggagagcaagcaaatctttttaaaaaatagtatgaatgtgaatactagaaaagatttaaaaaatagtatgagtgtgagtactaggaaggat

SEQ ID NO: 2925 - DNA, 1382 bp, Homo sapiens
gagaggcaggaggacaccgagttccccgtgttggcctccaggtcctgtgcttgcggagccgtccggcggctgggatcgagccccgacaatgggcaacgcgcaggagcggccgtcagagactatcgaccgcgagcggaaacgcctggtcgagacgctgcaggcggactcgggactgctgttggacgcgctgctggcgcggggcgtgctcaccgggccagagtacgaggcattggatgcactgcctgatgccgagcgcagggtgcgccgcctactgctgctggtgcagggcaagggcgaggccgcctgccaggagctgctacgctgtgcccagcgtaccgcgggcgcgccggaccccgcttgggactggcagcacgtgggtccgggctaccgggaccgcagctatgaccctccatgcccaggccactggacgccggaggcacccggctcggggaccacatgccccgggttgcccagagcttcagaccctgacgaggccgggggccctgagggctccgaggcggtgcaatccgggaccccggaggagccagagccagagctggaagctgaggcctctaaagaggctgaaccggagccggagccagagccagagctggaacccgaggctgaagcagaaccagagccggaactggagccagaaccggacccagagcccgagcccgacttcgaggaaagggacgagtccgaagattcctgaaggccagagctctgacaggcggtgccccgcccatgctggataggacctgggatgctgctggagctgaatcggatgccaccaaggctcggtccagcccagtaccgctggaagtgaataaactccggagggtcggacgggacctgggctctctccacgattctggctgtttgcccaggaacttagggtgggtacctctgagtcccagggacctgggcaggcccaagcccaccacgagcatcatccagtcctcagccctaatctgcccttaggagtccaggctgcaccctggagatcccaaacctagccccctagtgggacaaggacctgaccctcctgcccgcatacacaacccatttcccctggtgagccacttggcagcatatgtaggtaccagctcaaccccacgcaagttcctgagctgaacatggagcaaggggagggtgacttctctccacatagggagggcttagagctcacagccttgggaagtgagactagaagaggggagcagaaagggaccttgagtagacaaaggccacacacatcattgtcattactgttttaattgtctggcttctctctggactgggagctcagtgaggattctgaccagtgacttacacaaaaggcgctctatacatattataatatattcgcttactaaatg

SEQ ID NO: 2926 - DNA, 1885 bp, Homo sapiens
agctgctgcacccacccccaccctgcccggccctttctgcaccgtcatctcctgccccgccgaggcttgacccgtgctgtccccctctcccttcctttgcccaccgattggagggacactctggaaaactcagttgaagaaagcggagagtctgcgtgtacacagtgcaatgatgtcagttaatgcactagtgagggcatgtgttgttcacggtacacagaagaaggaaccaccagcccttgggacacttaggcattggtgtagacaagggaacatttgagtcctggacgatggataggtccacggagcggagggaggagaaaaggattccagtcttagcgatcagcatcagcaaaggctccgaggtgccagaggcataagagtagatgccagtcctgggaaaggcaggggaggagaggagagccacggctgacgcttggggacagaaggaggagcctgaggaggagacaggacagagcgtctggagaggcaggaggacaccgagttccccgtgttggcctccaggtcctgtgcttgcggagccgtccggcggctgggatcgagccccgacaatgggcaacgcgcaggagcggccgtcagagactatcgaccgcgagcggaaacgcctggtcgagacgctgcaggcggactcgggactgctgttggacgcgctgctggcgcggggcgtgctcaccgggccagagtacgaggcattggatgcactgcctgatgccgagcgcagggtgcgccgcctactgctgctggtgcagggcaagggcgaggccgcctgccaggagctgctacgctgtgcccagcgtaccgcgggcgcgccggaccccgcttgggactggcagcacgtgggtccgggctaccgggaccgcagctatgaccctccatgcccaggccactggacgccggaggcacccggctcggggaccacatgccccgggttgcccagagcttcagaccctgacgaggccgggggccctgagggctccgaggcggtgcaatccgggaccccggaggagccagagccagagctggaagctgaggcctctaaagaggctgaaccggagccggagccagagccagagctggaacccgaggctgaagcagaaccagagccggaactggagccagaaccggacccagagcccgagcccgacttcgaggaaagggacgagtccgaagattcctgaaggccagagctctgacaggcggtgccccgcccatgctggataggacctgggatgctgctggagctgaatcggatgccaccaaggctcggtccagcccagtaccgctggaagtgaataaactccggagggtcggacgggacctgggctctctccacgattctggctgtttgcccaggaacttagggtgggtacctctgagtcccagggacctgggcaggcccaagcccaccacgagcatcatccagtcctcagccctaatctgcccttaggagtccaggctgcaccctggagatcccaaacctagccccctagtgggacaaggacctgaccctcctgcccgcatacacaacccatttcccctggtgagccacttggcagcatatgtaggtaccagctcaaccccacgcaagttcctgagctgaacatggagcaaggggagggtgacttctctccacatagggagggcttagagctcacagccttgggaagtgagactagaagaggggagcagaaagggaccttgagtagacaaaggccacacacatcattgtcattactgttttaattgtctggcttctctctggactgggagctcagtgaggattctgaccagtgacttacacaaaaggcgctctatacatattataatatattcgcttactaaatgaataaggactttccaactg

SEQ ID NO: 2927 - DNA, 4034 bp, Homo sapiens
gattggctcatggggacggccgcgagctttggttggtcggcgcggagtcacgagggcgccgtcgtcgcctttccacaggcgattactgggcaggctcagtctttcgcctcagtctcgagctctcgctggccttcgggtgtacgtgctccgggatcttcagcacccgcggccgccatcgccgtcgcttggcttcttctggactcatctgcgccacttgtccgcttcacactccgccgccatcatggtgaagctcgcgaaggcaggtaaaaatcaaggtgaccccaagaaaatggctcctcctccaaaggaggtagaagaagatagtgaagatgaggaaatgtcagaagatgaagaagatgatagcagtggagaagaggtcgtcatacctcagaagaaaggcaagaaggctgctgcaacctcagcaaagaaggtggtcgtttccccaacaaaaaaggttgcagttgccacaccagccaagaaagcagctgtcactccaggcaaaaaggcagcagcaacacctgccaagaagacagttacaccagccaaagcagttaccacacctggcaagaagggagccacaccaggcaaagcattggtagcaactcctggtaagaagggtgctgccatcccagccaagggggcaaagaatggcaagaatgccaagaaggaagacagtgatgaagaggaggatgatgacagtgaggaggatgaggaggatgacgaggacgaggatgaggatgaagatgaaattgaaccagcagcgatgaaagcagcagctgctgcccctgcctcagaggatgaggacgatgaggatgacgaagatgatgaggatgacgatgacgatgaggaagatgactctgaagaagaagctatggagactacaccagccaaaggaaagaaagctgcaaaagttgttcctgtgaaagccaagaacgtggctgaggatgaagatgaagaagaggatgatgaggacgaggatgacgacgacgacgaagatgatgaagatgatgatgatgaagatgatgaggaggaggaagaagaggaggaggaagagcctgtcaaagaagcacctggaaaacgaaagaaggaaatggccaaacagaaagcagctcctgaagccaagaaacagaaagtggaaggcacagaaccgactacggctttcaatctctttgttggaaacctaaactttaacaaatctgctcctgaattaaaaactggtatcagcgatgtttttgctaaaaatgatcttgctgttgtggatgtcagaattggtatgactaggaaatttggttatgtggattttgaatctgctgaagacctggagaaagcgttggaactcactggtttgaaagtctttggcaatgaaattaaactagagaaaccaaaaggaaaagacagtaagaaagagcgagatgcgagaacacttttggctaaaaatctcccttacaaagtcactcaggatgaattgaaagaagtgtttgaagatgctgcggagatcagattagtcagcaaggatgggaaaagtaaagggattgcttatattgaatttaagacagaagctgatgcagagaaaacctttgaagaaaagcagggaacagagatcgatgggcgatctatttccctgtactatactggagagaaaggtcaaaatcaagactatagaggtggaaagaatagcacttggagtggtgaatcaaaaactctggttttaagcaacctctcctacagtgcaacagaagaaactcttcaggaagtatttgagaaagcaacttttatcaaagtaccccagaaccaaaatggcaaatctaaagggtatgcatttatagagtttgcttcattcgaagacgctaaagaagctttaaattcctgtaataaaagggaaattgagggcagagcaatcaggctggagttgcaaggacccaggggatcacctaatgccagaagccagccatccaaaactctgtttgtcaaaggcctgtctgaggataccactgaagagacattaaaggagtcatttgacggctccgttcgggcaaggatagttactgaccgggaaactgggtcctccaaagggtttggttttgtagacttcaacagtgaggaggatgccaaagctgccaaggaggccatggaagacggtgaaattgatggaaataaagttaccttggactgggccaaacctaagggtgaaggtggcttcgggggtcgtggtggaggcagaggcggctttggaggacgaggtggtggtagaggaggccgaggaggatttggtggcagaggccggggaggctttggagggcgaggaggcttccgaggaggcagaggaggaggaggtgaccacaagccacaaggaaagaagacgaagtttgaatagcttctgtccctctgctttcccttttccatttgaaagaaaggactctggggtttttactgttacctgatcaatgacagagccttctgaggacattccaagacagtatacagtcctgtggtctccttggaaatccgtctagttaacatttcaagggcaataccgtgttggttttgactggatattcatataaactttttaaagagttgagtgatagagctaacccttatctgtaagttttgaatttatattgtttcatcccatgtacaaaaccattttttcctacaaatagtttgggttttgttgttgtttcttttttttgttttgtttttgttttttttttttttgcgttcgtggggttgtaaaagaaaagaaagcagaatgttttatcatggtttttgcttcagcggctttaggacaaattaaaagtcaactctggtgccagacgtgttacttcctaaagagtgtttcccctggaatgtcactggagagcatggcaaagccagctctgccacttgcttcacccatcccaatggaaatggcttagtgcgtgtttccagtatcccagccctaactaacttggttgaaatgctggtgaggggacctgctcctgcagccctggtgctgacttgaaggctgctgcagcttctcctacttttagcaggtctgaggattatgtcctgaagaccactctggaaagaggtgcaggaacagattagtcaggtttcctaggacaaggaagagcttcagggaagagcagtggctaactcctgtaatcccaacacttggggaggccgaggcaggcagatcaactgaggtcaggagttgaagaccagcctggccaacatggtgaaagcccatctctactaaaaatacaaaaattagctgggcatggtggtgtactcctgtagtcccagctactcaggaggctgaagcgggagagtcacgtgaacccgggaagcagagtgagctgagcacacactactatactccaggctgggtaacaaagcgagactcccatctcccaaaaagcagttctggaatagaactcacgctagatggatagaccagtggacactttggaaccttggggctggggaggaaactgcccatccagtaaacccccaaaaagccatttgttctgcactacgtatattgcttattctttctggtcttaagtacttgcctctcaacctccctttttagtaaaagacaaggccacgtgagaggcgggactatcaacattgtgatgaatttacttgaaacccagtgcccaaaatcaatgtaggtagccaagtccaaaaacctgttctagtccaactagtgaaatcaaactgtgatacttggataagcttagaaggaaacgtgaagaatacgtagctgctttgggtttactctggttcagttgggctgttgaaatcttaacatccttgggcttatcacctactgcttgtcagccctgttccatgtccaggggatgggggtggtgacaatccagttccaagaccctcatgctctagagaggaaggtggccagccagggttgtaactacgatgaaaaagcagtgggagggtctcctatgaggcaagcctaaggacaaaaaggaaggccttgcagcctgtattctggataaggaattaaaagctcagttaattgaagccca

SEQ ID NO: 2928 - DNA, 1877 bp, Homo sapiens
ctcagtctttcgcctcagtctcgagctctcgctggccttcgggtgtacgtgctccgggatcttcagcacccgcggccgccatcgccgtcgcttggcttcttctggactcatctgcgccacttgtccgcttcacactccgccgccatcatggtgaagctcgcgaaggcaggtaaaaatcaaggtgaccccaagaaaatggctcctcctccaaaggaggtagaagaagatagtgaagatgaggaaatgtcagaagatgaagaagatgatagcagtggagaagaggtcgtcatacctcagaagaaaggcaagaaggctgctgcaacctcagcaaagaaggtggtcgtttccccaacaaaaaaggttgcagttgccacaccagccaagaaagcagctgtcactccaggcaaaaaggcagcagcaacacctgccaagaagacagttacaccagccaaagcagttaccacacctggcaagaagggagccacaccaggcaaagcattggtagcaactcctggtaagaagggtgctgccatcccagccaagggggcaaagaatggcaagaatgccaagaaggaagacagtgatgaagaggaggatgatgacagtgaggaggatgaggaggatgacgaggacgaggatgaggatgaagatgaaattgaaccagcagcgatgaaagcagcagctgctgcccctgcctcagaggatgaggacgatgaggatgacgaagatgatgaggatgggaaaagtaaagggattgcttatattgaatttaagacagaagctgatgcagagaaaacctttgaagaaaagcagggaacagagatcgatgggcgatctatttccctgtactatactggagagaaaggtcaaaatcaagactatagaggtggaaagaatagcacttggagtggtgaatcaaaaactctggttttaagcaacctctcctacagtgcaacagaagaaactcttcaggaagtatttgagaaagcaacttttatcaaagtaccccagaaccaaaatggcaaatctaaagggtatgcatttatagagtttgcttcattcgaagacgctaaagaagctttaaattcctgtaataaaagggaaattgagggcagagcaatcaggctggagttgcaaggacccaggggatcacctaatgccagaagccagccatccaaaactctgtttgtcaaaggcctgtctgaggataccactgaagagacattaaaggagtcatttgacggctccgttcgggcaaggatagttactgaccgggaaactgggtcctccaaagggtttggttttgtagacttcaacagtgaggaggatgccaaagctgccaaggaggccatggaagacggtgaaattgatggaaataaagttaccttggactgggccaaacctaagggtgaaggtggcttcgggggtcgtggtggaggcagaggcggctttggaggacgaggtggtggtagaggaggccgaggaggatttggtggcagaggccggggaggctttggagggcgaggaggcttccgaggaggcagaggaggaggaggtgaccacaagccacaaggaaagaagacgaagtttgaatagcttctgtccctctgctttcccttttccatttgaaagaaaggactctggggtttttactgttacctgatcaatgacagagccttctgaggacattccaagacagtatacagtcctgtggtctccttggaaatccgtctagttaacatttcaagggcaataccgtgttggttttgactggatattcatataaactttttaaagagttgagtgatagagctaacccttatctgtaagttttgaatttatattgtttcatcccatgtacaaaaccattttttcct

SEQ ID NO: 2929 - DNA, 2380 bp, Homo sapiens
agtctcgagctctcgctggccttcgggtgtacgtgctccgggatcttcagcacccgcggccgccatcgccgtcgcttggcttcttctggactcatctgcgccacttgtccgcttcacactccgccgccatcatggtgaagctcgcgaaggcaggtaaaaatcaaggtgaccccaagaaaatggctcctcctccaaaggaggtagaagaagatagtgaagatgaggaaatgtcagaagatgaagaagatgatagcagtggagaagagctaaatgatgacttttatcaaactaccatgcacactctttggaagaaaggcaagaaggctgctgcaacctcagccatcccagccaagggggcaaagaatggcaagaatgccaagaaggaagacagtgatgaagaggaggatgatgacagtgaggaggatgaggaggatgacgaggacgaggatgaggatgaagatgaaattgaaccagcagcgatgaaagcagcagctgctgcccctgcctcagaggatgaggacgatgaggatgacgaagatgatgaggatgacgatgacgatgaggaagatgatgatgatgatgaagatgatgaggaggaggaagaagaggaggaggaagagcctgtcaaagaagcacctggaaaacgaaagaaggaaatggccaaacagaaagcagctcctgaagccaagaaacagaaagtggaaggcacagaaccgactacggctttcaatctctttgttggaaacctaaactttaacaaatctgctcctgaattaaaaactggtatcagcgatgtttttgctaaaaatgatcttgctgttgtggatgtcagaattggtatgactaggaaatttggttatgtggattttgaatctgctgaagacctggagaaagcgttggaactcactggtttgaaagtctttggcaatgaaattaaactagagaaaccaaaaggaaaagacagtaagaaagagcgagatgcgagaacacttttggctaaaaatctcccttacaaagtcactcaggatgaattgaaagaagtgtttgaagatgctgcggagatcagattagtcagcaaggatgggaaaagtaaagggattgcttatattgaatttaagacagaagctgatgcagagaaaacctttgaagaaaagcagggaacagagatcgatgggcgatctatttccctgtactatactggagagaaaggtcaaaatcaagactatagaggtggaaagaatagcacttggagtggtgaatcaaaaactctggttttaagcaacctctcctacagtgcaacagaagaaactcttcaggaagtatttgagaaagcaacttttatcaaagtaccccagaaccaaaatggcaaatctaaagggtatgcatttatagagtttgcttcattcgaagacgctaaagaagctttaaattcctgtaataaaagggaaattgagggcagagcaatcaggctggagttgcaaggacccaggggatcacctaatgccagaagccagccatccaaaactctgtttgtcaaaggcctgtctgaggataccactgaagagacattaaaggagtcatttgacggctccgttcgggcaaggatagttactgaccgggaaactgggtcctccaaagggtttggttttgtagacttcaacagtgaggaggatgccaaagctgccaaggaggccatggaagacggtgaaattgatggaaataaagttaccttggactgggccaaacctaagggtgaaggtggcttcgggggtcgtggtggaggcagaggcggctttggaggacgaggtggtggtagaggaggccgaggaggatttggtggcagaggccggggaggctttggagggcgaggaggcttccgaggaggcagaggaggaggaggtgaccacaagccacaaggaaagaagacgaagtttgaatagcttctgtccctctgctttcccttttccatttgaaagaaaggactctggggtttttactgttacctgatcaatgacagagccttctgaggacattccaagacagtatacagtcctgtggtctccttggaaatccgtctagttaacatttcaagggcaataccgtgttggttttgactggatattcatataaactttttaaagagttgagtgatagagctaacccttatctgtaagttttgaatttatattgtttcatcccatgtacaaaaccattttttcctacaaatagtttgggttttgttgttgtttcttttttttgttttgtttttgttttttttttttttgcgttcgtggggttgtaaaagaaaagaaagcagaatgttttatcatggtttttgcttcagcggctttaggacaaattaaaagtcaactctggtgcc

SEQ ID NO: 2930 - DNA, 1758 bp, Homo sapiens
agtgcgcgtgctcggtgggagcccgcggagtacctggaaggaggtgggggcgaggtagaaaggagtggggttgaaaagcgcttgcgcaggacggctacggtacgggggtgggagggcttcggagcacgcgcgcggaggcgggacttgggaagcgctcgcgagatcttcagggtctatatataagcgcggggagcctgcgtcctttccctggtgtgattccgtcctgcgcggttgttctctggagcagcgttcttttatctccgtccgccttctctcctacctaagtgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatgatgacgatgatgatgaagaggatgatgatgaagatgatgatgatgatgattttgatgatgaggaagctgaagaaaaagcgccagtgaagaaatctatacgagatactccagccaaaaatgcacaaaagtcaaatcagaatggaaaagactcaaaaccatcatcaacaccaagatcaaaaggacaagaatccttcaagaaacaggaaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactgaccaagaggctattcaagatctctggcagtggaggaagtctctttaagaaaatagtttaaacaatttgttaaaaaattttccgtcttatttcatttctgtaacagttgatatctggctgtcctttttataatgcagagtgagaactttccctaccgtgtttgataaatgttgtccaggttctattgccaagaatgtgttgtccaaaatgcctgtttagtttttaaagatggaactccaccctttgcttggttttaagtatgtatggaatgttatgataggacatagtagtagcggtggtcagacatggaaatggtggggagacaaaaatatacatgtgaaataaaactcagtattttaataaagtagcacggtttctattgacttatttaactgctttatactttgtcaaagaaataattaatgtagttaggaatggcaaatagtcttgtaaaattctatgagaatgtccctgccctccccttcaatattctctctggagctaaccactttttcatcataaggatttagtgctgtgttcccacctcctgatgatagttaacaattattataactatgcaacatgtttccaaatgttccattagacctcctatctgccta

SEQ ID NO: 2931 - DNA, 1237 bp, Homo sapiens
aagcgcggggagcctgcgtcctttccctggtgtgattccgtcctgcgcggttgttctctggagcagcgttcttttatctccgtccgccttctctcctacctaagtgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatgatgacgatgatgatgaagaggatgatgatgaagatgatgatgatgatgattttgatgatgaggaagctgaagaaaaagcgccagtgaagaaaggacaagaatccttcaagaaacaggaaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactgaccaagaggctattcaagatctctggcagtggaggaagtctctttaagaaaatagtttaaacaatttgttaaaaaattttccgtcttatttcatttctgtaacagttgatatctggctgtcctttttataatgcagagtgagaactttccctaccgtgtttgataaatgttgtccaggttctattgccaagaatgtgttgtccaaaatgcctgtttagtttttaaagatggaactccaccctttgcttggttttaagtatgtatggaatgttatgataggacatagtagtagcggtggtcagacatggaaatggtggggagacaaaaatatacatgtgaaataaaactcagtattttaataaagta

SEQ ID NO: 2932 - DNA, 1598 bp, Homo sapiens
ttccctggtgtgattccgtcctgcgcggttgttctctggagcagcgttcttttatctccgtccgccttctctcctacctaagtgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatgatgacgatgatgatgaagaggatgatgatgaagatgatgatgatgatgattttgatgatgaggaagctgaagaaaaagcgccagtgaagaaatctatacgagatactccagccaaaaatgcacaaaagtcaaatcagaatggaaaagactcaaaaccatcatcaacaccaagatcaaaaggacaagaatccttcaagaaacaggaaaaaactcctaaaacaccaaaaggacctagttctgtagaagacattaaagcaaaaatgcaagcaagtatagaaaaagcgcattgaacagtcctgggcactacatgtaaattaagcccaaagatggggagaaaggaaaaggagagacaaatatagtccatactgagtgtcatcaacaatccagactgaagtcttctattttaatctcaatccccttttctgatttgccacccatgcctcttcaggctggaaacaatctcttggttccctaaagcactttcttctgactgctgtgattcagtgaaccttgccctttgctttctattacttgtgcatttgcctcacctgacaatgttttaaatcgcctttgtatctccttagctgctcaataaatatttgaatgcatcaattaagaatgtatgtgacaataattttgaaatggaaattgtgaggtttattttactaggttattggaggcagttaagtttcttaatgctatacctgattctgccaaagtcccttggacatttgaaaaccttttcaatcttttaaaaatgcataaaagatacttagagggaaaggtattaattaaatttagtaaaaacaaatatattcaatgctttaaattccaaagtagtgataaatacaaacatttcaagatatttgcaatagtaatgttttgaaattttggttacaaagtcacaggtcttgccaatactgttgtagtttcttgcctatatccgtaatttgaaggaaatggtgagagtgattagagaagtgtaattactgtaattttttcccctattg

SEQ ID NO: 2933 - DNA, 1338 bp, Homo sapiens
gggcgatgtccttgctaatttggagactgattcagtccccttttggcccccaagttacgtaaagataaggactttggagatgttttctcaggaaggacagagctgaaaaacaaagttcctgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatgatgacgatgatgatgaagaggatgatgatgaagatgatgatgatgatgattttgatgatgaggaagctgaagaaaaagcgccagtgaagaaatctatacgagatactccagccaaaaatgcacaaaagtcaaatcagaatggaaaagactcaaaaccatcatcaacaccaagatcaaaaggacaagaatccttcaagaaacaggaaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactgaccaagaggctattcaagatctctggcagtggaggaagtctctttaagaaaatagtttaaacaatttgttaaaaaattttccgtcttatttcatttctgtaacagttgatatctggctgtcctttttataatgcagagtgagaactttccctaccgtgtttgataaatgttgtccaggttctattgccaagaatgtgttgtccaaaatgcctgtttagtttttaaagatggaactccaccctttgcttggttttaagtatgtatggaatgttatgataggacatagtagtagcggtggtcagacatggaaatggtggggagacaaaaatatacatgtgaaataaaactcagtattttaataaagt

SEQ ID NO: 2934 - DNA, 4499 bp, Homo sapiens
cccgttccgggcccgcgaggcagccgccccggtcctgcccctccctcgcgctactgcgggagcagcgtcctcccgggccacggcgcttcccggccccggcgtccccggaccatggcgctctccgggctcttctctagctctcagcggctgcgaagtctgtaaacctggtggccaagtgattgtaagtcaggagactttccttcggtttctgcctttgatggcaagaggtggagattgtggcggcgattacagaaaacatctgggaagacaagttgctgtttttatgggaatcgcaggcttggaagagacagaagcaattccagaaataaattggaaattgaagatttaaacaatgttgttttaaaatattctaacttcaaagaatgatgccagaaacttaaaaaggggctgcgcagagtagcaggggccctggagggcgcggcctgaatcctgattgcccttctgctgagaggacacacgcagctgaagatgaatttgggaaaagtagccgcttgctactttaactatggaagagcagggccacagtgagatggaaataatcccatcagagtctcacccccacattcaattactgaaaagcaatcgggaacttctggtcactcacatccgcaatactcagtgtctggtggacaacttgctgaagaatgactacttctcggccgaagatgcggagattgtgtgtgcctgccccacccagcctgacaaggtccgcaaaattctggacctggtacagagcaagggcgaggaggtgtccgagttcttcctctacttgctccagcaactcgcagatgcctacgtggacctcaggccttggctgctggagatcggcttctccccttccctgctcactcagagcaaagtcgtggtcaacactgacccagtgagcaggtatacccagcagctgcgacaccatctgggccgtgactccaagttcgtgctgtgctatgcccagaaggaggagctgctgctggaggagatctacatggacaccatcatggagctggttggcttcagcaatgagagcctgggcagcctgaacagcctggcctgcctcctggaccacaccaccggcatcctcaatgagcagggtgagaccatcttcatcctgggtgatgctggggtgggcaagtccatgctgctacagcggctgcagagcctctgggccacgggccggctagacgcaggggtcaaattcttcttccactttcgctgccgcatgttcagctgcttcaaggaaagtgacaggctgtgtctgcaggacctgctcttcaagcactactgctacccagagcgggaccccgaggaggtgtttgccttcctgctgcgcttcccccacgtggccctcttcaccttcgatggcctggacgagctgcactcggacttggacctgagccgcgtgcctgacagctcctgcccctgggagcctgcccaccccctggtcttgctggccaacctgctcagtgggaagctgctcaagggggctagcaagctgctcacagcccgcacaggcatcgaggtcccgcgccagttcctgcggaagaaggtgcttctccggggcttctcccccagccacctgcgcgcctatgccaggaggatgttccccgagcgggccctgcaggaccgcctgctgagccagctggaggccaaccccaacctctgcagcctgtgctctgtgcccctcttctgctggatcatcttccggtgcttccagcacttccgtgctgcctttgaaggctcaccacagctgcccgactgcacgatgaccctgacagatgtcttcctcctggtcactgaggtccatctgaacaggatgcagcccagcagcctggtgcagcggaacacacgcagcccagtggagaccctccacgccggccgggacactctgtgctcgctggggcaggtggcccaccggggcatggagaagagcctctttgtcttcacccaggaggaggtgcaggcctccgggctgcaggagagagacatgcagctgggcttcctgcgggctttgccggagctgggccccgggggtgaccagcagtcctatgagtttttccacctcaccctccaggccttctttacagccttcttcctcgtgctggacgacagggtgggcactcaggagctgctcaggttcttccaggagtggatgccccctgcgggggcagcgaccacgtcctgctatcctcccttcctcccgttccagtgcctgcagggcagtggtccggcgcgggaagacctcttcaagaacaaggatcacttccagttcaccaacctcttcctgtgcgggctgttgtccaaagccaaacagaaactcctgcggcatctggtgcccgcggcagccctgaggagaaagcgcaaggccctgtgggcacacctgttttccagcctgcggggctacctgaagagcctgccccgcgttcaggtcgaaagcttcaaccaggtgcaggccatgcccacgttcatctggatgctgcgctgcatctacgagacacagagccagaaggtggggcagctggcggccaggggcatctgcgccaactacctcaagctgacctactgcaacgcctgctcggccgactgcagcgccctctccttcgtcctgcatcacttccccaagcggctggccctagacctagacaacaacaatctcaacgactacggcgtgcgggagctgcagccctgcttcagccgcctcactgttctcagactcagcgtaaaccagatcactgacggtggggtaaaggtgctaagcgaagagctgaccaaatacaaaattgtgacctatttgggtttatacaacaaccagatcaccgatgtcggagccaggtacgtcaccaaaatcctggatgaatgcaaaggcctcacgcatcttaaactgggaaaaaacaaaataacaagtgaaggagggaagtatctcgccctggctgtgaagaacagcaaatcaatctctgaggttgggatgtggggcaatcaagttggggatgaaggagcaaaagccttcgcagaggctctgcggaaccaccccagcttgaccaccctgagtcttgcgtccaacggcatctccacagaaggaggaaagagccttgcgagggccctgcagcagaacacgtctctagaaatactgtggctgacccaaaatgaactcaacgatgaagtggcagagagtttggcagaaatgttgaaagtcaaccagacgttaaagcatttatggcttatccagaatcagatcacagctaaggggactgcccagctggcagatgcgttacagagcaacactggcataacagagatttgcctaaatggaaacctgataaaaccagaggaggccaaagtctatgaagatgagaagcggattatctgtttctgagaggatgctttcctgttcatggggtttttgccctggagcctcagcagcaaatgccactctgggcagtcttttgtgtcagtgtcttaaaggggcctgcgcaggcgggactatcaggagtccactgcctccatgatgcaagccagcttcctgtgcagaaggtctggtcggcaaactccctaagtacccgctacaattctgcagaaaaagaatgtgtcttgcgagctgttgtagttacagtaaatacactgtgaagagactttattgcctattataattatttttatctgaagctagaggaataaagctgtgagcaaacagaggaggccagcctcacctcattccaacacctgccatagggaccaacgggagcgagttggtcaccgctcttttcattgaagagttgaggatgtggcacaaagttggtgccaagcttcttgaataaaacgtgtttgatggattagtattatacctgaaatattttcttccttctcagcactttcccatgtattgatactggtcccacttcacagctggagacaccggagtatgtgcagtgtgggatttgactcctccaaggttttgtggaaagttaatgtcaaggaaaggatgcaccacgggcttttaattttaatcctggagtctcactgtctgctggcaaagatagagaatgccctcagctcttagctggtctaagaatgacgatgccttcaaaatgctgcttccactcagggcttctcctctgctaggctaccctcctctagaaggctgagtaccatgggctacagtgtctggccttgggaagaagtgattctgtccctccaaagaaatagggcatggcttgcccctgtggccctggcatccaaatggctgcttttgtctcccttacctcgtgaagaggggaagtctcttcctgcctcccaagcagctgaagggtgactaaacgggcgccaagactcaggggatcggctgggaactgggccagcagagcatgttggacaccccccaccatggtgggcttgtggtggctgctccatgagggtgggggtgatactactagatcacttgtcctcttgccagctcatttgttaataaaatactgaaaacactctta

SEQ ID NO: 2935 - DNA, 794 bp, Homo sapiens
actgcgggagcagcgtcctcccgggccacggcgcttcccggccccggcgtccccggaccatggcgctctccgggctcttctctagctctcagcggctgcgaagtctgtaaacctggtggccaaggacagtcagttgcatgtcacacaaggggcctcctttgatttatccaaaaggtctgacctggtttctggaaaaactctttagcgcatcaaatactcgttgagggcaagtgttgtttctaaacttgactcttgtggtgagaggtgattgtaagtcaggagactttccttcggtttctgcctttgatggcaagaggtggagattgtggcggcgattacagaaaacatctgggaagacaagttgctgtttttatgggaatcgcaggcttggaagagacagaagcaattccagaaataaattggaaattgaagatttaaacaatgttgttttaaaatattctaacttcaaagaatgatgccagaaacttaaaaaggggctgcgcagagtagcaggggccctggagggcgcggcctgaatcctgattgcccttctgctgagaggacacacgcagctgaagatgaatttgggaaaagtagccgcttgctactttaactatggaagagcagggccacagtgagatggaaataatcccatcagagtctcacccccacattcaattactgaaaagcaatcgggaacttctggtcactcacatccgcaatactcagtgtctggtggacaacttgctgaagaatgactacttctcggccgaagatgcggagattgtgtgtgc

SEQ ID NO: 2936 - DNA, 637 bp, Homo sapiens
cggctgcgaagtctgtaaacctggtggccaaaagccaagtcatccagaagccagcttctgcagctccaaagagggccttagcagttacaaagaaacacaagataacggtgattgtaagtcaggagactttccttcggtttctgcctttgatggcaagaggtggagattgtggcggcgattacagaaaacatctgggaagacaagttgctgtttttatgggaatcgcaggcttggaagagacagaagcaattccagaaataaattggaaattgaagatttaaacaatgttgttttaaaatattctaacttcaaagaatgatgccagaaacttaaaaaggggctgcgcagagtagcaggggccctggagggcgcggcctgaatcctgattgcccttctgctgagaggacacacgcagctgaagatgaatttgggaaaagtagccgcttgctactttaactatggaagagcagggccacagtgagatggaaataatcccatcagagtctcacccccacattcaattactgaaaagcaatcgggaacttctggtcactcacatccgcaatactcagtgtctggtggacaacttgctgaagaatgactacttctcggccgaagatgcggagattgtgtgtgc

SEQ ID NO: 2937 - DNA, 578 bp, Homo sapiens
agttcccgttccgggcccgcgaggcagccgccccggtcctgcccctccctcgcgctactgcgggagcagcgtcctcccgggccacggcgcttcccggccccggcgtccccggaccatggcgctctccgggctcttctctagctctcagcggctgcgaagtctgtaaacctggtggccaagtgattgtaagtcaggagactttccttcggtttctgcctttgatggcaagaggtggagattgtggcggcgattacagaaaacatctgggaagacaagttgctgtttttatgggaatcgcaggcttggaagagacagaagcagggctgcgcagagtagcaggggccctggagggcgcggcctgaatcctgattgcccttctgctgagaggacacacgcagctgaagatgaatttgggaaaagtagccgcttgctactttaactatggaagagcagggccacagtgagatggaaataatcccatcagagtctcacccccacattcaattactgaaaagcaatcgggaacttctggtcactcacatccgcaatactcagtgtctggtggacaacttgctgaa

SEQ ID NO: 2938 - DNA, 757 bp, Homo sapiens
ccctccctcgcgctactgcgggagcagcgtcctcccgggccacggcgcttcccggccccggcgtccccggaccatggcgctctccgggctcttctctagctctcagcggctgcgaagtctgtaaacctggtggccaacatctcagttataagaaatgcacatctccgctcaaggtcccctgggacagtgcaaggaaagaaagaagcctgcggtgaaagtgacactgagtgattgtaagtcaggagactttccttcggtttctgcctttgatggcaagaggtggagattgtggcggcgattacagaaaacatctgggaagacaagttgctgtttttatgggaatcgcaggcttggaagagacagaagcaattccagaaataaattggaaattgaagatttaaacaatgttgttttaaaatattctaacttcaaagaatgatgccagaaacttaaaaaggggctgcgcagagtagcaggggccctggagggcgcggcctgaatcctgattgcccttctgctgagaggacacacgcagctgaagatgaatttgggaaaagtagccgcttgctactttaactatggaagagcagggccacagtgagatggaaataatcccatcagagtctcacccccacattcaattactgaaaagcaatcgggaacttctggtcactcacatccgcaatactcagtgtctggtggacaacttgctgaagaatgactacttctcggccgaagatgcggagattgtgtgtgc

SEQ ID NO: 2939 - DNA, 1587 bp, Homo sapiens
gcttcccggccccggcgtccccggaccatggcgctctccgggctcttctctagctctcagcggctgcgaagtctgtaaacctggtggccaagtgattgtaagtcaggagactttccttcggtttctgcctttgatggcaagaggtggagattgtggcggcgattacagaaaacatctgggaagacaagttgctgtttttatgggaatcgcaggcttggaagagacagaagcaattccagaaataaattggaaattgaagatttaaacaatgttgttttaaaatattctaacttcaaagaatgatgccagaaacttaaaaaggggctgcgcagagtagcaggggccctggagggcgcggcctgaatcctgattgcccttctgctgagaggacacacgcagctgaagatgaatttgggaaaagtagccgcttgctactttaactatggaagagcagggccacagtgagatggaaataatcccatcagagtctcacccccacattcaattactgaaaagcaatcgggaacttctggtcactcacatccgcaatactcagtgtctggtggacaacttgctgaagaatgactacttctcggccgaagatgcggagattgtgtgtgcctgccccacccagcctgacaaggtccgcaaaattctggacctggtacagagcaagggcgaggaggtgtccgagttcttcctctacttgctccagcaactcgcagatgcctacgtggacctcaggccttggctgctggagatcggcttctccccttccctgctcactcagagcaaagtcgtggtcaacactgacccagtgagcaggtatacccagcagctgcgacaccatctgggccgtgactccaagttcgtgctgtgctatgcccagaaggaggagctgctgctggaggagatctacatggacaccatcatggagctggttggcttcagcaatgagagcctgggcagcctgaacagcctggcctgcctcctggaccacaccaccggcatcctcaatgagcaggctgcttcaaggaaagtgacaggctgtgtctgcaggacctgctcttcaagcactactgctacccagagcgggaccccgaggaggtgtttgccttcctgctgcgcttcccccacgtggccctcttcaccttcgatggcctggacgagctgcactcggacttggacctgagccgcgtgcctgacagctcctgcccctgggagcctgcccaccccctggtcttgctggccaacctgctcagtgggaagctgctcaagggggctagcaagctgctcacagcccgcacaggcatcgaggtcccgcgccagttcctgcggaagaaggtgcttctccggggcttctcccccagccacctgcgcgcctatgccaggaggatgttccccgagcgggccctgcaggaccgcctgctgagccagctggaggccaaccccaacctctgcagcctgtgctctgtgcccctcttctgctggatcatcttccggtgcttccagcacttccgtgctgcctttgaaggctcaccacagctgcccgactgcacgatgaccctgacagatgtcttcctcctg

SEQ ID NO: 2940 - DNA, 4610 bp, Homo sapiens
ccctcgcgctactgcgggagcagcgtcctcccgggccacggcgcttcccggccccggcgtccccggaccatggcgctctccgggctcttctctagctctcagcggctgcgaagtctgtaaacctggtggccaagtgattgtaagtcaggagactttccttcggtttctgcctttgatggcaagaggtggagattgtggcggcgattacagaaaacatctgggaagacaagttgctgtttttatgggaatcgcaggcttggaagagacagaagcaattccagaaataaattggaaattgaagatttaaacaatgttgttttaaaatattctaacttcaaagaatgatgccagaaacttaaaaaggggctgcgcagagtagcaggggccctggagggcgcggcctgaatcctgattgcccttctgctgagaggacacacgcagctgaagatgaatttgggaaaagtagccgcttgctactttaactatggaagagcagggccacagtgagatggaaataatcccatcagagtctcacccccacattcaattactgaaaagcaatcgggaacttctggtcactcacatccgcaatactcagtgtctggtggacaacttgctgaagaatgactacttctcggccgaagatgcggagattgtgtgtgcctgccccacccagcctgacaaggtccgcaaaattctggacctggtacagagcaagggcgaggaggtgtccgagttcttcctctacttgctccagcaactcgcagatgcctacgtggacctcaggccttggctgctggagatcggcttctccccttccctgctcactcagagcaaagtcgtggtcaacactgacccagtgagcaggtatacccagcagctgcgacaccatctgggccgtgactccaagttcgtgctgtgctatgcccagaaggaggagctgctgctggaggagatctacatggacaccatcatggagctggttggcttcagcaatgagagcctgggcagcctgaacagcctggcctgcctcctggaccacaccaccggcatcctcaatgagcagggtgagaccatcttcatcctgggtgatgctggggtgggcaagtccatgctgctacagcggctgcagagcctctgggccacgggccggctagacgcaggggtcaaattcttcttccactttcgctgccgcatgttcagctgcttcaaggaaagtgacaggctgtgtctgcaggacctgctcttcaagcactactgctacccagagcgggaccccgaggaggtgtttgccttcctgctgcgcttcccccacgtggccctcttcaccttcgatggcctggacgagctgcactcggacttggacctgagccgcgtgcctgacagctcctgcccctgggagcctgcccaccccctggtcttgctggccaacctgctcagtgggaagctgctcaagggggctagcaagctgctcacagcccgcacaggcatcgaggtcccgcgccagttcctgcggaagaaggtgcttctccggggcttctcccccagccacctgcgcgcctatgccaggaggatgttccccgagcgggccctgcaggaccgcctgctgagccagctggaggccaaccccaacctctgcagcctgtgctctgtgcccctcttctgctggatcatcttccggtgcttccagcacttccgtgctgcctttgaaggctcaccacagctgcccgactgcacgatgaccctgacagatgtcttcctcctggtcactgaggtccatctgaacaggatgcagcccagcagcctggtgcagcggaacacacgcagcccagtggagaccctccacgccggccgggacactctgtgctcgctggggcaggtggcccaccggggcatggagaagagcctctttgtcttcacccaggaggaggtgcaggcctccgggctgcaggagagagacatgcagctgggcttcctgcgggctttgccggagctgggccccgggggtgaccagcagtcctatgagtttttccacctcaccctccaggccttctttacagccttcttcctcgtgctggacgacagggtgggcactcaggagctgctcaggttcttccaggagtggatgccccctgcgggggcagcgaccacgtcctgctatcctcccttcctcccgttccagtgcctgcagggcagtggtccggcgcgggaagacctcttcaagaacaaggatcacttccagttcaccaacctcttcctgtgcgggctgttgtccaaagccaaacagaaactcctgcggcatctggtgcccgcggcagccctgaggagaaagcgcaaggccctgtgggcacacctgttttccagcctgcggggctacctgaagagcctgccccgcgttcaggtcgaaagcttcaaccaggtgcaggccatgcccacgttcatctggatgctgcgctgcatctacgagacacagagccagaaggtggggcagctggcggccaggggcatctgcgccaactacctcaagctgacctactgcaacgcctgctcggccgactgcagcgccctctccttcgtcctgcatcacttccccaagcggctggccctagacctagacaacaacaatctcaacgactacggcgtgcgggagctgcagccctgcttcagccgcctcactgttctcagactcagcgtaaaccagatcactgacggtggggtaaaggtgctaagcgaagagctgaccaaatacaaaattgtgacctatttgggactttggaaatcagtagacaccatatgcttcaaaaaacaggggctattaaaatgacatcaggagccagaaagtctcatggctgtgctttctcttgaagtttatacaacaaccagatcaccgatgtcggagccagactgggaaaaaacaaaataacaagtgaaggagggaagtatctcgccctggctgtgaagaacagcaaatcaatctctgaggttgggatgtggggcaatcaagttggggatgaaggagcaaaagccttcgcagaggctctgcggaaccaccccagcttgaccaccctgagtcttgcgtccaacggcatctccacagaaggaggaaagagccttgcgagggccctgcagcagaacacgtctctagaaatactgtggctgacccaaaatgaactcaacgatgaagtggcagagagtttggcagaaatgttgaaagtcaaccagacgttaaagcatttatggcttatccagaatcagatcacagctaaggggactgcccagctggcagatgcgttacagagcaacactggcataacagagatttgaacttgtttggaacttgtcataaaatcgatcagtttggtgaattgcaaccaacaatatttaaaaagaaaacagaacagaacaaaatatcaggatgcaatgtgcatgcctaaatggaaacctgataaaaccagaggaggccaaagtctatgaagatgagaagcggattatctgtttctgagaggatgctttcctgttcatggggtttttgccctggagcctcagcagcaaatgccactctgggcagtcttttgtgtcagtgtcttaaaggggcctgcgcaggcgggactatcaggagtccactgcctccatgatgcaagccagcttcctgtgcagaaggtctggtcggcaaactccctaagtacccgctacaattctgcagaaaaagaatgtgtcttgcgagctgttgtagttacagtaaatacactgtgaagagactttattgcctattataattatttttatctgaagctagaggaataaagctgtgagcaaacagaggaggccagcctcacctcattccaacacctgccatagggaccaacgggagcgagttggtcaccgctcttttcattgaagagttgaggatgtggcacaaagttggtgccaagcttcttgaataaaacgtgtttgatggattagtattatacctgaaatattttcttccttctcagcactttcccatgtattgatactggtcccacttcacagctggagacaccggagtatgtgcagtgtgggatttgactcctccaaggttttgtggaaagttaatgtcaaggaaaggatgcaccacgggcttttaattttaatcctggagtctcactgtctgctggcaaagatagagaatgccctcagctcttagctggtctaagaatgacgatgccttcaaaatgctgcttccactcagggcttctcctctgctaggctaccctcctctagaaggctgagtaccatgggctacagtgtctggccttgggaagaagtgattctgtccctccaaagaaatagggcatggcttgcccctgtggccctggcatccaaatggctgcttttgtctcccttacctcgtgaagaggggaagtctcttcctgcctcccaagcagctgaagggtgactaaacgggcgccaagactcaggggatcggctgggaactgggccagcagagcatgttggacaccccccaccatggtgggcttgtggtggctgctccatgagggtgggggtgatactactagatcacttgtcctcttgccagctcatttgttaataaaatactgaaaacactc

SEQ ID NO: 2941 - DNA, 2385 bp, Homo sapiens
gggcagacggaggcgcctctctttccccgcccctcgcctcggccctttctcttcccagcacctcggctgttccccggcggcggcagcggcagcggcggcccacacagcagcgagaggcgagaggaggctgcctcgaggaggctgcctcgaggatgaagtgcaaacccaaccagacgcggacctacgaccccgaggggttcaagaagcgggcggcgtgcctgtgcttccggagcgaacgcgaggacgaggtcctgttagtgagtagcagccggtacccggaccgctggatcgtgccgggcgggggcatggagcccgaggaggagccgggcggtgcggcggtccgagaggtgtacgaagaagcgggagtcaaggggaagttaggccggctcctgggcgtcttcgaacagaaccaggatcgcaagcacagaacgtacgtgtatgtactgactgtcacggagctgctggaggattgggaagattcggttagcattgggaggaagcgagagtggttcaaagtcgaagatgccatcaaggttctccagtgccacaagcccgtgcacgccgaatatctggagaaactaaagctgggcggttccccaaccaatggaaactccatggccccatcctcgccagatagcgatccctaatgaacagcaaagatgttcagtattgtgctgaaagaaacattgatgtgaacccagtgatcagtggaattgtcaagtacaggtgagcacttctgtgttcccaagaagacagctcatctggtttcttcctgcatcttgggacactccttccctgtctataccactgactcttgctctggttgttgtactcttatacgtgaatagactcttaattcagcacctatagccttttgttgtgcttttttgatgtgtctgccttcattagactatgatgtctttgagagcaaagactatttttccttactctttgcatattctgcatctgagacactacttgaaatatggttggcatcactgaaggttctttgattcaattaatattttgtaatcaccgtgtggcaaaacattccccttccaatctggtgctagtagagtatatgctatctaggcaccatgtgtgtggcttttgtgtatcaggtgtttcagaaatatttcaagacagttgtaagatgtttgaggacaagaattattactcctatttctatgtcataccacacagtagctgcacagttttaagattatgccatcacctagggtaatgttttgtagaatcagtccttcgtgtaacaactctagtgtttttgtactgttgatgatttgcttaaattttattcaaaaactatcacttgctataaaggtaattgtaaaaataaatacagtggacgcaaaataatgttgtgagtttttataaaaataaattttaaaatgatatataagacatttttttgcaatgcctgccctaaccacttcttacatgtcatcttaacatctctttgaggaaacactgtttcctcattttacagatttaacatactgtattatttgatgccagagccaacaggctatatcataggcagtttccaaacttaattatgccatttagtttgtctagatttcttttgcctctctcactgatccatttggctgtagttttcatcccttttccagtacacacagctagctcctcatcctacctggtttctgcatatgagaatgcagagggctgagagagggcaaaattgttgtcatttagaaaaggcatttaggaaagaggctgctattagaggggaacacaaagtgaaggtttttttaaaaaagaggacttgcatcagctgcctccagaacaattttaagaaaataacaaagatgtttagaagaaatcttacggagtttgccatgggatgtgtgatatcagcagtcttcagctccttacaaattaccaaaagtggttctaatatgctagtttgtttgattttttcttttatattataaagcaattgcatcgataaaagcttggactccattttagtgtgacactcttcctcatgataccagtgaaatgtattgattgtgtccccagttgttacataatttgaaataaaaatataacttcttgatttattgttttttaagatgtgatatggtactgtggttatgttgttttaaaaaatgattatcttttagagaagtatactgaaaaatgtacaggtgaaatgatatgttactggtattcgcttcaaaatcatctgagtgtggggtaattgagtacatagatgaaacaagattggccataaattggtaattgctgaagctgtgtgatggatgtttgagagttcattatactattctctatacttttgtatatgtttgaaattttccataataaaaattgaaaaaagta

SEQ ID NO: 2942 - DNA, 1835 bp, Homo sapiens
gcagcaatggtccctccagggaacggaagccgttgaacgtgaacatttggagtttcctcttttgtgctgattcctgaggactaggaaggtgccccgaaaagaattcagagacctgacaatgtccctgtattgtggaatagcttgcaggagaaaatttttttggtgctataggctgctgtcaacctatgttactaagacacggtatttatttgaactgaaggaagatgatgatgcatgtaaaaaagcccagcaaacaggagcgttttacctctttcatagtctggctcctctgcttcagacttcagcacatcaatacctggccccccggcacagcctgttagagttggaaaggctcctgggtaaatttggacaggatgcacaaagaatagaagattctgtgctgattggatgctctgagcagcaggaagcatggtttgctctggatctaggtctggatagctccttttccataagtgcctccttacacaaacctgaaatggagacagagctcaaggggtctttcattgagctgagaaaggcactctttcaactcaatgcaagggatgcctccttgctgtccacggctcaagctcttctccgctggcatgatgctcatcagttctgcagcagaagtgggcagcccaccaagaagaacgtggctggcagcaagcgtgtgtgcccttccaataatataatctattatccacagatccaggtgaacttgagagaattagagacagctgcctggttcagtcatgatgaggtagccacagccctgaagagaaagggcccctatactcagcaacagaatgggactttcccattctggctgccccctaagttagccatctcccaccaactgattaaggagtgggtggaaaaacagacctgttcttccctgcctgcttagcccggatcaagtcacttagatcgctccttggtattcctgagggacaaactagagatcagttgacaaaggagaagtgacaaaagataagctgcagaaggacctcagaagggcagagcaaagggtgagcctacagtaagacacttctatcagcagtgttaatggaagaaattcctaccaatgggcaatcaaaaaagccagtgtgagaagaaaactgatgagctgtcaactgtcaaaaatcagggggaagggggaagcattagtttggatgtaggcccttgttcagtcattttctctaaggccttggaagcaaacatcttctggcatatggcttgttaatgttgtgtttacactaactgccaaaatgtgcctgttgtaagtttggttaaaacttttatcttagtattgaaaatatatagcaagttttaagtcattactgagttacttgttacccttacagaattaagaaaaatagcacagtatgacattttaaaattcatgtacaggtgcattctagttacatgaacatgctagttaaataaaagtcacaattaagtcattatgactcagagtactttataataaatcagatgccctgaggctctgttgaggaagtagaatcccaatgggactccagacagtaaatctttttcgctgttttcagctctgtcacatgctcagtttgtgacccagggaaaagactattgctttgccatgcctgttttcctaaataaaacagttgctggcatttgcacatccacaacgtgttgattaacaaagggattggtggagataaacagatgccaaacctgacctatttcttaaactttatggaataaactaaatttaggatttctcatcattcatatatgatgccataagggagaagagtttatttggggaaaataaaagaaatttccacaccttt

SEQ ID NO: 2943 - DNA, 2102 bp, Homo sapiens
gcagcaatggtccctccagggaacggaagccgttgaacgtgaacatttggagtttcctcttttgtgctgattcctgaggactaggaaggtgccccgaaaagaattcagagacctgacaatgtccctgtattgtggaatagcttgcaggagaaaatttttttggtgctataggctgctgtcaacctatgttactaagacacggtatttatttgaactgaaggaagatgatgatgcatgtaaaaaagcccagcaaacaggagcgttttacctctttcatagtctggctcctctgcttcagacttcagcacatcaatacctggccccccggcacagcctgttagagttggaaaggctcctgggtaaatttggacaggatgcacaaagaatagaagattctgtgctgattggatgctctgagcagcaggaagcatggtttgctctggatctaggtctggatagctccttttccataagtgcctccttacacaaacctgaaatggagacagagctcaaggggtctttcattgagctgagaaaggcactctttcaactcaatgcaagggatgcctccttgctgtccacggctcaagctcttctccgctggcatgatgctcatcagttctgcagcagaagtgggcagcccaccaagaagaacgtggctggcagcaagcgtgtgtgcccttccaataatataatctattatccacagatggctcctgtggcgatcacgctggtgtcagatgggacccgatgcctgcttgcccgccaaagctcctttcccaagggaatgtattctgccttggcaggtttttgtgatataggtgaaagtgtggaagagaccatccgccgagaagttgcagaagaggtgggattggaggtggaaagcctgcagtactatgcatcccagcattggcccttccctagtggctcactcatgattgcttgccatgcaactgtgaaaccagggcagacagaaatccaggtgaacttgagagaattagagacagctgcctggttcagtcatgatgaggtagccacagccctgaagagaaagggcccctatactcagcaacagaatgggactttcccattctggctgccccctaagttagccatctcccaccaactgattaaggagtgggtggaaaaacagacctgttcttccctgcctgcttagcccggatcaagtcacttagatcgctccttggtattcctgagggacaaactagagatcagttgacaaaggagaagtgacaaaagataagctgcagaaggacctcagaagggcagagcaaagggtgagcctacagtaagacacttctatcagcagtgttaatggaagaaattcctaccaatgggcaatcaaaaaagccagtgtgagaagaaaactgatgagctgtcaactgtcaaaaatcagggggaagggggaagcattagtttggatgtaggcccttgttcagtcattttctctaaggccttggaagcaaacatcttctggcatatggcttgttaatgttgtgtttacactaactgccaaaatgtgcctgttgtaagtttggttaaaacttttatcttagtattgaaaatatatagcaagttttaagtcattactgagttacttgttacccttacagaattaagaaaaatagcacagtatgacattttaaaattcatgtacaggtgcattctagttacatgaacatgctagttaaataaaagtcacaattaagtcattatgactcagagtactttataataaatcagatgccctgaggctctgttgaggaagtagaatcccaatgggactccagacagtaaatctttttcgctgttttcagctctgtcacatgctcagtttgtgacccagggaaaagactattgctttgccatgcctgttttcctaaataaaacagttgctggcatttgcacatccacaacgtgttgattaacaaagggattggtggagataaacagatgccaaacctgacctatttcttaaactttatggaataaactaaatttaggatttctcatcattcatatatgatgccataagggagaagagtttatttggggaaaataaaagaaatttccacaccttt

SEQ ID NO: 2944 - DNA, 1919 bp, Homo sapiens
tcctgaggactaggaaggtgccccgaaaagaattcagagacctgacaatgtccctgtattgtggaatagcttgcaggagaaaatttttttggtgctataggctgctgtcaacctatgttactaagacacggtatttatttgaactgaaggaagatgatgatgcatgtaaaaaagcccagcaaacaggagcgttttacctctttcatagtctggctcctctgcttcagacttcagcacatcaatacctggccccccggcacagcctgttagagttggaaaggctcctgggtaaatttggacaggatgcacaaagaatagaagattctgtgctgattggatgctctgagcagcaggaagcatggtttgctctggatctaggtctggatagctccttttccataagtgcctccttacacaaacctgaaatggagacagagctcaaggggtctttcattgagctgagaaaggcactctttcaactcaatgcaagggatgcctccttgctgtccacggctcaagctcttctccgctggcatgatgctcatcagttctgcagcagaagtgggcagcccaccaagaagaacgtggctggcagcaagcgtgtgtgcccttccaataatataatctattatccacaggtgaaagtgtggaagagaccatccgccgagaagttgcagaagaggtgggattggaggtggaaagcctgcagtactatgcatcccagcattggcccttccctagtggctcactcatgattgcttgccatgcaactgtgaaaccagggcagacagaaatccaggtgaacttgagagaattagagacagctgcctggttcagtcatgatgaggtagccacagccctgaagagaaagggcccctatactcagcaacagaatgggactttcccattctggctgccccctaagttagccatctcccaccaactgattaaggagtgggtggaaaaacagacctgttcttccctgcctgcttagcccggatcaagtcacttagatcgctccttggtattcctgagggacaaactagagatcagttgacaaaggagaagtgacaaaagataagctgcagaaggacctcagaagggcagagcaaagggtgagcctacagtaagacacttctatcagcagtgttaatggaagaaattcctaccaatgggcaatcaaaaaagccagtgtgagaagaaaactgatgagctgtcaactgtcaaaaatcagggggaagggggaagcattagtttggatgtaggcccttgttcagtcattttctctaaggccttggaagcaaacatcttctggcatatggcttgttaatgttgtgtttacactaactgccaaaatgtgcctgttgtaagtttggttaaaacttttatcttagtattgaaaatatatagcaagttttaagtcattactgagttacttgttacccttacagaattaagaaaaatagcacagtatgacattttaaaattcatgtacaggtgcattctagttacatgaacatgctagttaaataaaagtcacaattaagtcattatgactcagagtactttataataaatcagatgccctgaggctctgttgaggaagtagaatcccaatgggactccagacagtaaatctttttcgctgttttcagctctgtcacatgctcagtttgtgacccagggaaaagactattgctttgccatgcctgttttcctaaataaaacagttgctggcatttgcacatccacaacgtgttgattaacaaagggattggtggagataaacagatgccaaacctgacctatttcttaaactttatggaataaactaaatttaggatttctcatcattcatatatgatgccataagggagaagagtttatttggggaaaataaaagaaatttccacaccttt

SEQ ID NO: 2945 - DNA, 1118 bp, Homo sapiens
gtgctgattcctgaggactaggaaggtgccccgaaaagaattcagagacctgacaatgtccctgtattgtggaatagcttgcaggagaaaatttttttggtgctataggctgctgtcaacctatgttactaagacacgattgaatgagggtcactgaagatacagtgtttactctttgtctgctgtgaaaaagtctgttcccatctctaggtatttatttgaactgaaggaagatgatgatgcatgtaaaaaagcccagcaaacaggagcgttttacctctttcatagtctggctcctctgcttcagacttcagcacatcaatacctggccccccggcacagcctgttagagttggaaaggctcctgggtaaatttggacaggatgcacaaagaatagaagattctgtgctgattggatgctctgagcagcaggaagcatggtttgctctggatctaggtctggatagctccttttccataagtggctcaagctcttctccgctggcatgatgctcatcagttctgcagcagaagtgggcagcccaccaagaagaacgtggctggcagcaagcgtgtgtgcccttccaataatataatctattatccacagatggctcctgtggcgatcacgctggtgtcagatgggacccgatgcctgcttgcccgccaaagctcctttcccaagggaatgtattctgccttggcaggtttttgtgatataggtgaaagtgtggaagagaccatccgccgagaagttgcagaagaggtgggattggaggtggaaagcctgcagtactatgcatcccagcattggcccttccctagtggctcactcatgattgcttgccatgcaactgtgaaaccagggcagacagaaatccaggtgaacttgagagaattagagacagctgcctggttcagtcatgatgaggtagccacagccctgaagagaaagggcccctatactcagcaacagaatgggactttcccattctggctgccccctaagttagccatctcccaccaactgattaaggagtgggtggaaaaacagacctgttcttccctgcctgcttagcccggatcaagtcacttagatcgctccttggtattcctg

SEQ ID NO: 2946 - DNA, 1482 bp, Homo sapiens
gtgctgattcctgaggactaggaaggtgccccgaaaagaattcagagacctgacaatgtccctgtattgtggaatagcttgcaggagaaaatttttttggtgctataggctgctgtcaacctatgttactaagacacgattgaatgagggtcactgaagatacagtgtttactctttgtctgctgtgaaaaagtctgttcccatctctaggtatttatttgaactgaaggaagatgatgatgcatgtaaaaaagcccagcaaacaggagcgttttacctctttcatagtctggctcctctgcttcagacttcagcacatcaatacctggccccccggcacagcctgttagagttggaaaggctcctgggtaaatttggacaggatgcacaaagaatagaagattctgtgctgattggatgctctgagcagcaggaagcatggtttgctctggatctaggtctggatagctccttttccataagtgcctccttacacaaacctgaaatggagacagagctcaaggggtctttcattgagctgagaaaggcactctttcaactcaatgcaagggatgcctccttgctgtccacggctcaagctcttctccgctggcatgatgctcatcagttctgcagcagaagtgggcagcccaccaagaagaacgtggctggcagcaagcgtgtgtgcccttccaataatataatctattatccacagatggctcctgtggcgatcacgctggtgtcagatgggacccgatgcctgcttgcccgccaaagctcctttcccaagggaatgtattctgccttggcaggtttttgtgatataggtgaaagtgtggaagagaccatccgccgagaagttgcagaagaggtgggattggaggtggaaagcctgcagtactatgcatcccagcattggcccttccctagtggctcactcatgattgcttgccatgcaactgtgaaaccagggcagacagaaatccaggtgaacttgagagaattagagacagctgcctggttcagtcatgatgaggtagccacagccctgaagagaaagggcccctatactcagcaacagaatgggactttcccattctggctgccccctaagttagccatctcccaccaactgattaaggagtgggtggaaaaacagacctgttcttccctgcctgcttagcccggatcaagtcacttagatcgctccttggtattcctgagggacaaactagagatcagttgacaaaggagaagtgacaaaagataagctgcagaaggacctcagaagggcagagcaaagggtgagcctacagtaagacacttctatcagcagtgttaatggaagaaattcctaccaatgggcaatcaaaaaagccagtgtgagaagaaaactgatgagctgtcaactgtcaaaaatcagggggaagggggaagcattagtttggatgtaggcccttgttcagtcattttctctaa

SEQ ID NO: 2947 - DNA, 1759 bp, Homo sapiens
gtgcccctcggccccgcccccgcgccccggatatgctgggacagcccgcgcccctagaacgctttgcgtcccgacgcccgcaggtcctcgcggtgcgcaccgtttgcgacttggtacttggaaaaatggacaaggattgtgaaatgaaacgcaccacactggacagccctttggggaagctggagctgtctggttgtgagcagggtctgcacgaaataaagctcctgggcaaggggacgtctgcagctgatgccgtggaggtcccagcccccgctgcggttctcggaggtccggagcccctgatgcagtgcacagcctggctgaatgcctatttccaccagcccgaggctatcgaagagttccccgtgccggctcttcaccatcccgttttccagcaagagtcgttcaccagacaggtgttatggaagctgctgaaggttgtgaaattcggagaagtgatttcttaccagcaattagcagccctggcaggcaaccccaaagccgcgcgagcagtgggaggagcaatgagaggcaatcctgtccccatcctcatcccgtgccacagagtggtctgcagcagcggagccgtgggcaactactccggaggactggccgtgaaggaatggcttctggcccatgaaggccaccggttggggaagccaggcttgggagggagctcaggtctggcaggggcctggctcaagggagcgggagctacctcgggctccccgcctgctggccgaaactgagtatgtgcagtaggatggatgtttgagcgacacacacgtgtaacactgcatcggatgcggggcgtggaggcaccgctgtattaaaggaagtggcagtgtcctgggaacaagcgtgtctgccctttctgtttccatattttacagcaggatgagttcagacgcccgcggtcctgcacacatttgtttccttctctaacgctgcccttgctctatttttcatgtccattaaaacaggccaagtgagtgtggaaggcctggctcatgttgggccacagcccaggatggggcagtctggcaccctcaggccacagacggctgccatagccgctgtccagggccagctaaggcccatcccaggccgtccacactagaaagctggccctgccccatccccaccatgcctcccttcctggctgtgtccatggctgtgatggcattctccactcagcagttcctagcatcccacacccaggtctcactgaaagaaaggggaacaggccatggcagtcagtgcttacagaggttttctagctttgtttcctacctgccaaaaaggctaatgcaagatgcatccacttatggtctgtatcaggtgaatagaaaataaccatttgccaagatttggaaagacagagagctctctggacacgggttcgatggagcttgcacctctctgagagctgaagtcaagtctcaccctctctccatactccctggcctagtgtgctctgggcagcaggtaggaagggacagggacctctcatctcaagggctgccccaaagggccctcagggaccatgggcctgttaggaccccagcaccccagtgtcgatcctggaagtcaaaggtcacgactgtggggggccagctcatgtcactgatggcagcaggcagggtttccagcatgggcggtgcgctgctgtctgatacttcattattgtgttgtcatcctagctgtataattaactatatccaaaagccggaagggaaacctgtagctctgcatatgg

SEQ ID NO: 2948 - DNA, 6438 bp, Homo sapiens
gcctctctccatcagacaccccaaggttccatccgaagcaggcggagcaccgaacgcaccccggggtggtcagggacccccatccgtgctgccccctaggagcccgcgcctctcctctgcgccccgcctctcgggccgcaacgtcgcgcggttcctttaacagcgcgctggcagggtgtgggaagcaggaccgcgtcctcccgccccctcccatccgagtttcaggtgaattggtcaccgagggaggaggccgacacaccacacctacactcccgcgtccacctctccctccctgcttcctctggcggaggcggcaggaaccgagagccaggtccagagcgccgaggagccggtctaggacgcagcagattggtttatcttggaagctaaagggcattgctcatcctgaagatcagctgaccattgacaatcagccatgtcatccaggcctcttgaaagtccacctccttacaggcctgatgaattcaaaccgaatcattatgcaccaagcaatgacatatatggtggagagatgcatgttcgaccaatgctctctcagccagcctactctttttacccagaagatgaaattcttcacttctacaaatggacctctcctccaggagtgattcggatcctgtctatgctcattattgtgatgtgcattgccatctttgcctgtgtggcctccacgcttgcctgggacagaggctatggaacttcccttttaggaggtagtgtaggctacccttatggaggaagtggctttggtagctacggaagtggctatggctatggctatggttatggctatggctacggaggctatacagacccaagagcagcaaagggcttcatgttggccatggctgccttttgtttcattgccgcgttggtgatctttgttaccagtgttataagatctgaaatgtccagaacaagaagatactacttaagtgtgataatagtgagtgctatcctgggcatcatggtgtttattgccacaattgtctatataatgggagtgaacccaactgctcagtcttctggatctctatatggttcacaaatatatgccctctgcaaccaattttatacacctgcagctactggactctacgtggatcagtatttgtatcactactgtgttgtggatccccaggaggccattgccattgtactggggttcatgattattgtggcttttgctttaataattttctttgctgtgaaaactcgaagaaagatggacaggtatgacaagtccaatattttgtgggacaaggaacacatttatgatgagcagccccccaatgtcgaggagtgggttaaaaatgtgtctgcaggcacacaggacgtgccttcacccccatctgactatgtggaaagagttgacagtcccatggcatactcttccaatggcaaagtgaatgacaagcggttttatccagagtcttcctataaatccacgccggttcctgaagtggttcaggagcttccattaacttcgcctgtggatgacttcaggcagcctcgttacagcagcggtggtaactttgagacaccttcaaaaagagcacctgcaaagggaagagcaggaaggtcaaagagaacagagcaagatcactatgagacagactacacaactggcggcgagtcctgtgatgagctggaggaggactggatcagggaatatccacctatcacttcagatcaacaaagacaactgtacaagaggaattttgacactggcctacaggaatacaagagcttacaatcagaacttgatgagatcaataaagaactctcccgtttggataaagaattggatgactatagagaagaaagtgaagagtacatggctgctgctgatgaatacaatagactgaagcaagtgaagggatctgcagattacaaaagtaagaagaatcattgcaagcagttaaagagcaaattgtcacacatcaagaagatggttggagactatgatagacagaaaacatagaaggctgatgccaagttgtttgagaaattaagtatctgacatctctgcaatcttctcagaaggcaaatgactttggaccataaccccggaagccaaacctctgtgagcatcacaaagttttggttgctttaacatcatcagtattgaagcattttataaatcgcttttgataatcaactgggctgaacactccaattaaggattttatgctttaaacattggttcttgtattaagaatgaaatactgtttgaggtttttaagccttaaaggaaggttctggtgtgaactaaactttcacaccccagacgatgtcttcatacctacatgtatttgtttgcataggtgatctcatttaatcctctcaaccacctttcagataactgttatttataatcacttttttccacataaggaaactgggttcctgcaatgaagtctctgaagtgaaactgcttgtttcctagcacacacttttggttaagtctgttttatgacttcattaataataaattccctggcctttcatattttagctactatatatgtgatgatctaccagcctccctattttttttctgttatataaatggttaaaagaggtttttcttaaataataaagatcatgtaaaagtaacaaatgtgtgaaatttaaagattgtaaatatatatttacttttttaagatcaaagtttaaaccccgtggttagaattttgtgtgtttttaaatactttttatctttttgcatgccttttttaaaaaaccaactagaacttttcattatatcagaatatctgattacatttataattcaattgtgacttgaactgtatcttacaggaatgttcaatttctatacatattttataaggtattaaacctggtgttttctttccataataacctgtttgatgttattagtgctgttaacatacagcaatggaaaaccacactcaggagttgtatctgttgttgtttatactcctttggatgctgtgctggttagtcgtttcccattcctttggctgtaagaatgctgatatgtctgggaatagaatgctataccacgaaataccaaataatttcaaatggtgcccttaaattgtatcacttttttaaaaattcagattcttattagtaaaattagttgatagcactgtgctgaccaagttgattgtgatcatcccagcttagacttttctaaaaacttttttttagaataatctataaactgaactttagtatgcatttcagatatttaggtatataatttttttttttttttgagacagagtctcactctcacccaggctggaatgcagtggtgctatcttggctcactgcaacctccacctcccgggttcaagcaattctcctgcctcagcctctcgagtagttgagactacaggtgcccatcaccatgcgtggctaatttttgtatttttaatagagacggggttttaccatagtggccaggttggtcttgaactcctgaccttgtggtctgcctgcctcggcctcccaaagtgctgggattacaggcgtgagccaccatgcctggcctaagtgtgtgtgtgtgtgtgtgtgtgtatttttttttttttttttttgagatggagttttgctcttgttgaacaggctggagtgcaatgtcgcgatctcagctcaccacaacctccgcctcccaggttcaaacaattctcctgcctcggcctcccgagtagctgggattacaggcatgcgccaccacacctggctaattttttttttgtatttttagtagagatggggtttctccatgttggtcaggctggtctcgaactcctgacctcaggtgatccatccacctcggcctcccaaagtgctgggattagaggcgtgagccactgtgcccggcctataatttttgatagatgattttgaattattttccagagataaaattttaaatgtttccattatatcactgatttatttctgcaaattgaataaattcttaattttctgcatgcacataatacaaaaggtattttcatagttttggatttataccaaatgaaaaggattctcttgatgagcacctttaactgatttttctgttaaagttttaacaatttgttcttggaagtcagttcgtgaaggcaagtttgtcagtattttcacaaaactattcagctgaatccagaaagtgaaacagcaagaatttgcattgtaaaattgtgttataaaattggactttgaaatttcaaaaataagaaaaattttcatgtgtatttatactaaataccgttttaggaaactaggatcagggtgtttctgttggcgttggcattaactagctggatgtaaatttgaaaagccactcaagcagcttcctagtctagaaagtcagaggtttagattagatttccgacatcccttccatttctgacctgtagttcttgtctggaattctgctttgttataaactattgttctaaggagtttgttgtgatagcacatagttcattttgtaaagattccctgcgtataaagtgatgccctacatatgtgattttgtattaaaagtatataggatcattattttattttgaaaaatttaaatacagaaaagtataaaatataagtaccatccgcccagaaataacatgtgttaatgttttgtcatatgtgctttatattttttgaaataaagtgaagtcaactagtatttatagtaaataagttacatacacataagtacatatatgatatttaatcctcacaacgatcttttgacatgtgaccatttcttattcttcttttatagacaaggaactaatgatatgatagattaactggctgttgtcacactagcaagtggcaaaacaagggattaggatcttagtctcttcaactgttagattctatacttccatcctgtgttgactttgttaatggattggataatgtgagatcactctgatgtaaataaagtatcctatattaatttcgagtgcattttaagtacttgtaacataaatgcttcctgtgaaatatctgtaaagacctgaatgggtacatgtgtgtaaagaagaatcagggcagaaaagtgcttttatcatggctccggggaccttagcttcagttggtgttgtgagaattcctcacacaaggacattctccttgcttcagcatcaggatggaagtgtttctcatctggactttttcaaagactcagctggaggaatcagaattcataatttcctggcagctcatgattctgctacactacaccatgccatctcttgtgtgaaaggacagatttgatggaggactatgtcatccctcatgcgtttcttattgtctacatttattctaatgggaagaagtgagcaaaaacacctcaataatttgggtagtttttagaaaaccttgttagtaaattagaatagtgccactttggcattatgagaaagaagcatggatacataactagggttttgtgtatgactacaacgaaatgcagaatggtgtctccaaaaggtttccaattgctgccacaagaactgcttggtattgcctacatgtgttgtcctatttttgctttgcccttctgcagttacttgctgtgggaccttggagaaattaacttagcctctctgtacttcagttttttgtatttgtaaaatatatttgtaataatctcatagttaagaaggtagttaatgtgtgactcagtccttgtctaaaagtaaatatgcctagctacccccatcttccaaagccagaaggtgaaactttaacaagttttctaaaagcaaattgtgttttttaaaagtgcatgtgtcatccaatcccatatgattgatctgtgctgggtgcagccttagaatgtaaattcttttgaattctaggcagagaatgcaggattggcattctaaatatttgtacatgataaacaaatgcttctttaggttagagcaaatagtttacttatcaagatcacaattgttagatactgttgtcaattacagaggttttagatgaggctttctggaatgatttagtttccctgtaagggagcctgtctattggaatagacaggttcacttctcccagtctttcaagttgcatgctttttatatctgattccactggctgagctgattgtgaatgtcctaaccctgttgattgtgtctggccactcatgggcaaagaacagattatccattctttatagttgtcttttagttttacaagttgaaaaaacatctgagtaggttagataatttattctaccactttgtaaatgattagaatatgtcagtcataatcatgccaagagattatggatttatgcatattttgttttgctgtagtaccattcctagttgaatcttaacatccatgtctaaaatctatacagaacaaatattacagttgggaaaactg

SEQ ID NO: 2949 - DNA, 2218 bp, Homo sapiens
gtccccggctgagcgctggcggtcggtgcggcgtcaggtgcgcccgccaggtgagcgcgctccctggcaccgttggcccccggagggtcgggcccagttgcggcgagcggattggtttatcttggaagctaaagggcattgctcatcctgaagatcagctgaccattgacaatcagccatgtcatccaggcctcttgaaagtccacctccttacaggcctgatgaattcaaaccgaatcattatgcaccaagcaatgacatatatggtggagagatgcatgttcgaccaatgctctctcagccagcctactctttttacccagaagatgaaattcttcacttctacaaatggacctctcctccaggagtgattcggatcctgtctatgctcattattgtgatgtgcattgccatctttgcctgtgtggcctccacgcttgcctgggacagaggctatggaacttcccttttaggaggtagtgtaggctacccttatggaggaagtggctttggtagctacggaagtggctatggctatggctatggttatggctatggctacggaggctatacagacccaagagcagcaaagggcttcatgttggccatggctgccttttgtttcattgccgcgttggtgatctttgttaccagtgttataagatctgaaatgtccagaacaagaagatactacttaagtgtgataatagtgagtgctatcctgggcatcatggtgtttattgccacaattgtctatataatgggagtgaacccaactgctcagtcttctggatctctatatggttcacaaatatatgccctctgcaaccaattttatacacctgcagctactggactctacgtggatcagtatttgtatcactactgtgttgtggatccccaggaggttaaaaatgtgtctgcaggcacacaggacgtgccttcacccccatctgactatgtggaaagagttgacagtcccatggcatactcttccaatggcaaagtgaatgacaagcggttttatccagagtcttcctataaatccacgccggttcctgaagtggttcaggagcttccattaacttcgcctgtggatgacttcaggcagcctcgttacagcagcggtggtaactttgagacaccttcaaaaagagcacctgcaaagggaagagcaggaaggtcaaagagaacagagcaagatcactatgagacagactacacaactggcggcgagtcctgtgatgagctggaggaggactggatcagggaatatccacctatcacttcagatcaacaaagacaactgtacaagaggaattttgacactggcctacaggaatacaagagcttacaatcagaacttgatgagatcaataaagaactctcccgtttggataaagaattggatgactatagagaagaaagtgaagagtacatggctgctgctgatgaatacaatagactgaagcaagtgaagggatctgcagattacaaaagtaagaagaatcattgcaagcagttaaagagcaaattgtcacacatcaagaagatggttggagactatgatagacagaaaacatagaaggctgatgccaagttgtttgagaaattaagtatctgacatctctgcaatcttctcagaaggcaaatgactttggaccataaccccggaagccaaacctctgtgagcatcacaaagttttggttgctttaacatcatcagtattgaagcattttataaatcgcttttgataatcaactgggctgaacactccaattaaggattttatgctttaaacattggttcttgtattaagaatgaaatactgtttgaggtttttaagccttaaaggaaggttctggtgtgaactaaactttcacaccccagacgatgtcttcatacctacatgtatttgtttgcataggtgatctcatttaatcctctcaaccacctttcagataactgttatttataatcacttttttccacataaggaaactgggttcctgcaatgaagtctctgaagtgaaactgcttgtttcctagcacacacttttggttaagtctgttttatgacttcattaataataaattccctggcctttcatattttagctactatatatgtgatgatctaccagcctccctattttttttctgttatataaatggttaaaagaggtttttcttaaataataaagatcatgtaaaagt

SEQ ID NO: 2950 - DNA, 1748 bp, Homo sapiens
agtccccggctgagcgctggcggtcggtgcggcgtcaggtgcgcccgccaggtgagcgcgctccctggcaccgttggcccccggagggtcgggcccagttgcggcgagcggattggtttatcttggaagctaaagggcattgctcatcctgaagatcagctgaccattgacaatcagccatgtcatccaggcctcttgaaagtccacctccttacaggcctgatgaattcaaaccgaatcattatgcaccaagcaatgacatatatggtggagagatgcatgttcgaccaatgctctctcagccagcctactctttttacccagaagatgaaattcttcacttctacaaatggacctctcctccaggagtgattcggatcctgtctatgctcattattgtgatgtgcattgccatctttgcctgtgtggcctccacgcttgcctgggacagaggctatggaacttcccttttaggaggtagtgtaggctacccttatggaggaagtggctttggtagctacggaagtggctatggctatggctatggttatggctatggctacggaggctatacagacccaagagcagcaaagggcttcatgttggccatggctgccttttgtttcattgccgcgttggtgatctttgttaccagtgttataagatctgaaatgtccagaacaagaagatactacttaagtgtgataatagtgagtgctatcctgggcatcatggtgtttattgccacaattgtctatataatgggagtgaacccaactgctcagtcttctggatctctatatggttcacaaatatatgccctctgcaaccaattttatacacctgcagctactggactctacgtggatcagtatttgtatcactactgtgttgtggatccccaggaggccattgccattgtactggggttcatgattattgtggcttttgctttaataattttctttgctgtgaaaactcgaagaaagatggacaggtatgacaagtccaatattttgtgggacaaggaacacatttatgatgagcagccccccaatgtcgaggagtgggttaaaaatgtgtctgcaggcacacaggacgtgccttcacccccatctgactatgtggaaagagttgacagtcccatggcatactcttccaatggcaaagtgaatgacaagcggttttatccagagtcttcctataaatccacgccggttcctgaagtggttcaggagcttccattaacttcgcctgtggatgacttcaggcagcctcgttacagcagcggtggtaactttgagacaccttcaaaaagagcacctgcaaagggaagagcaggaaggtcaaagagaacagagcaagatcactatgagacagactacacaactggcggcgagtcctgtgatgagctggaggaggactggatcagggaatatccacctatcacttcagatcaacaaagacaactgtacaagaggaattttgacactggcctacaggaatacaagagcttacaatcagaacttgatgagatcaataaagaactctcccgtttggataaagaattggatgactatagagaagaaagtgaagagtacatggctgctgctgatgaatacaatagactgaagcaagtgaagggatctgcagattacaaaagtaagaagaatcattgcaagcagttaaagagcaaattgtcacacatcaagaagatggttggagactatgatagacagaaaacatag

SEQ ID NO: 2951 - DNA, 975 bp, Homo sapiens
ggcattgctcatcctgaagatcagctgaccattgacaatcagccatgtcatccaggcctcttgaaagtccacctccttacaggcctgatgaattgccattgccattgtactggggttcatgattattgtggcttttgctttaataattttctttgctgtgaaaactcgaagaaagatggacaggtatgacaagtccaatattttgtgggacaaggaacacatttatgatgagcagccccccaatgtcgaggagtgggttaaaaatgtgtctgcaggcacacaggacgtgccttcacccccatctgactatgtggaaagagttgacagtcccatggcatactcttccaatggcaaagtgaatgacaagcggttttatccagagtcttcctataaatccacgccggttcctgaagtggttcaggagcttccattaacttcgcctgtggatgacttcaggcagcctcgttacagcagcggtggtaactttgagacaccttcaaaaagagcacctgcaaagggaagagcaggaaggtcaaagagaacagagcaagatcactatgagacagactacacaactggcggcgagtcctgtgatgagctggaggaggactggatcagggaatatccacctatcacttcagatcaacaaagacaactgtacaagaggaattttgacactggcctacaggaatacaagagcttacaatcagaacttgatgagatcaataaagaactctcccgtttggataaagaattggatgactatagagaagaaagtgaagagtacatggctgctgctgatgaatacaatagactgaagcaagtgaagggatctgcagattacaaaagtaagaagaatcattgcaagcagttaaagagcaaattgtcacacatcaagaagatggttggagactatgatagacagaaaacatagaaggctgatgccaagttgtttgagaaattaagtatctgaca

SEQ ID NO: 2952 - DNA, 813 bp, Homo sapiens
ggcattgctcatcctgaagatcagctgaccattgacaatcagccatgtcatccaggcctcttgaaagtccacctccttacaggcctgatgaattgttaaaaatgtgtctgcaggcacacaggacgtgccttcacccccatctgactatgtggaaagagttgacagtcccatggcatactcttccaatggcaaagtgaatgacaagcggttttatccagagtcttcctataaatccacgccggttcctgaagtggttcaggagcttccattaacttcgcctgtggatgacttcaggcagcctcgttacagcagcggtggtaactttgagacaccttcaaaaagagcacctgcaaagggaagagcaggaaggtcaaagagaacagagcaagatcactatgagacagactacacaactggcggcgagtcctgtgatgagctggaggaggactggatcagggaatatccacctatcacttcagatcaacaaagacaactgtacaagaggaattttgacactggcctacaggaatacaagagcttacaatcagaacttgatgagatcaataaagaactctcccgtttggataaagaattggatgactatagagaagaaagtgaagagtacatggctgctgctgatgaatacaatagactgaagcaagtgaagggatctgcagattacaaaagtaagaagaatcattgcaagcagttaaagagcaaattgtcacacatcaagaagatggttggagactatgatagacagaaaacatagaaggctgatgccaagttgtttgagaaattaagtatctgaca

SEQ ID NO: 2953 - DNA, 1417 bp, Homo sapiens
ccaactgctcctgcgccgggcggggtcgtcgccgccagcggctccgagcgccggaagggccaggtctcagggctcctggagctgcaggcggcgggaggggctacaaatgcttgactcagtgatgcagaacctttcagagttagctggaagccacagccctgcctcttgatgcagcctggatccagccggtgtgaagaggagaccccttccctcttgtggggtttggatcctgtgtttctagcctttgcaaaactctacatcagggatatcctggacatgaaggagtcccgccaggtgccaggtgtatttttgtacaatggacatccaataaaacaggtagatgtcttgggaactgtcattggagtgagagaaagagatgctttctacagttatggagtggatgacagcactggagttataaactgcatctgctggaaaaagttgaatactgagtctgtatcagctgctccaagtgcagcaagagagctcagcttaacctcacaacttaagaagctacaagagaccattgagcagaaaacaaagatagagatcggggacacgatccgagtcagaggcagtatccgcacatacagagaagagcgagagattcatgccaccacttactataaagtggacgacccagtgtggaacattcaaattgcaaggatgcttgagctgcccactatctacaggaaagtttatgaccagccttttcacagctcagccctagagaaagaagaggcactaagcaatccaggcgccctggacctccccagtctcacgagtttgctgagtgaaaaagccaaagaattcctcatggagaacagagtgcagagcttttaccagcaggagctggaaatggtggagtctttgctgtcccttgccaatcagcctgtgattcacagtgcctcctccgaccaagtgaattttaagaaggacaccacttccaaggcaattcatagtatatttaagaatgctatacaactgctgcaggaaaaaggacttgttttccagaaagatgatggttttgataacctatactatgtaaccagagaagacaaagacctgcacagaaagatccaccggatcattcagcaggactgccagaaaccaaatcacatggagaagggctgtcacttcctgcacatcttggcctgtgctcgcctgagcatccgcccgggcctgagcgaggctgtgctgcagcaagttctggagctcctggaggaccagagtgacattgtcagcacaatggagcactactacacagcgttctgagcagagacacgcagaccagctgaggaggacaaagataaggtggcattcacccccaggctctgactttcagcatcatgcaggggcttatctgtctggaggcagttacctcataataaactataaaatatagtcatcttgggaa

SEQ ID NO: 2954 - DNA, 1311 bp, Homo sapiens
gtgtcccatctagatgcttgactcagtgatgcagaacctttcagagttagctggaagccacagccctgcctcttgatgcagcctggatccagccggtgtgaagaggagaccccttccctcttgtggggtttggatcctgtgtttctagcctttgcaaaactctacatcagggatatcctggacatgaaggagtcccgccaggtgccaggtgtatttttgtacaatggacatccaataaaacaggtagatgtcttgggaactgtcattggagtgagagaaagagatgctttctacagttatggagtggatgacagcactggagttataaactgcatctgctggaaaaagttgaatactgagtctgtatcagctgctccaagtgcagcaagagagctcagcttaacctcacaacttaagaagctacaagagaccattgagcagaaaacaaagatagagatcggggacacgatccgagtcagaggcagtatccgcacatacagagaagagcgagagattcatgccaccacttactataaagtggacgacccagtgtggaacattcaaattgcaaggatgcttgagctgcccactatctacaggaaagtttatgaccagccttttcacagctcagccctagagaaagaagaggcactaagcaatccaggcgccctggacctccccagtctcacgagtttgctgagtgaaaaagccaaagaattcctcatggagaacagagtgcagagcttttaccagcaggagctggaaatggtggagtctttgctgtcccttgccaatcagcctgtgattcacagtgcctcctccgaccaagtgaattttaagaaggacaccacttccaaggcaattcatagtatatttaagaatgctatacaactgctgcaggaaaaaggacttgttttccagaaagatgatggttttgataacctatactatgtaaccagagaagacaaagacctgcacagaaagatccaccggatcattcagcaggactgccagaaaccaaatcacatggagaagggctgtcacttcctgcacatcttggcctgtgctcgcctgagcatccgcccgggcctgagcgaggctgtgctgcagcaagttctggagctcctggaggaccagagtgacattgtcagcacaatggagcactactacacagcgttctgagcagagacacgcagaccagctgaggaggacaaagataaggtggcattcacccccaggctctgactttcagcatcatgcaggggcttatctgtctggaggcagttacctcataataaactataaaatata

SEQ ID NO: 2955 - DNA, 6833 bp, Homo sapiens
cccgccttggaactttttgccgccttggggttccagatgcgagacctggggctgggggacacgtacatctgtccatgtgtgtgatctaataaaccatttcctcctctccttgaagccgcagctttttatgacagctcctgtatgtcagagacacttgccttcttctttgggttataaacttttgatgccagagctctgcagaacgtgcccaactgaatcttaaagtagcgtctcgaagagagaggcagagaaagcgcaatctgtgaccttcatccccgcaccttgcttcttcctctcccctcctggccgcctccctcctccccaggggagcgtcaagaaagctctttttggatgcaggagggggcatctggttctgctaggctggaaagctgaggcaggatctgaggaagaattctcagactccggagagcccggactcctctcttctccttccccctgctcctggcgaactctgccccttccctcctccccgcaccgcttcccgagcccgctggtgcgcggggcgggggaccaggactgtgcggctgccggagtcctgggaagttgtggctgtcgagaatgggggtctgtgggtacctgttcctgccctggaagtgcctcgtggtcgtgtctctcaggctgctgttccttgtacccacaggagtgcccgtgcgcagcggagatgccaccttccccaaagctatggacaacgtgacggtccggcagggggagagcgccaccctcaggtgtaccatagatgaccgggtaacccgggtggcctggctaaaccgcagcaccatcctctacgctgggaatgacaagtggtccatagaccctcgtgtgatcatcctggtcaatacaccaacccagtacagcatcatgatccaaaatgtggatgtgtatgacgaaggtccgtacacctgctctgtgcagacagacaatcatcccaaaacgtcccgggttcacctaatagtgcaagttcctcctcagatcatgaatatctcctcagacatcactgtgaatgagggaagcagtgtgaccctgctgtgtcttgctattggcagaccagagccaactgtgacatggagacacctgtcagtcaaggaaggccagggctttgtaagtgaggatgagtacctggagatctctgacatcaagcgagaccagtccggggagtacgaatgcagcgcgttgaacgatgtcgctgcgcccgatgtgcggaaagtaaaaatcactgtaaactatcctccctatatctcaaaagccaagaacactggtgtttcagtcggtcagaagggcatcctgagctgtgaagcctctgcagtccccatggctgaattccagtggttcaaggaagaaaccaggttagccactggtctggatggaatgaggattgaaaacaaaggccgcatgtccactctgactttcttcaatgtttcagaaaaggattatgggaactatacttgtgtggccacgaacaagcttgggaacaccaatgccagcatcacattgtatgggcctggagcagtcattgatggtgtaaactcggcctccagagcactggcttgtctctggctatcagggaccctcttagcccacttcttcatcaagttttgataagaaatcctaggtcctctgagcaacgcctgcttctccatatcacagactttaatctacactgcggagagcaaaccagcttgggcttctttttgtttttttctgttattctagatttgttttctttttgtttttgtttatttgtttgtttgcttttatttccagcttgaatgagtggggttgggggcggggtgggcagggttctaccacgtgtaggataatcattcattggtgtgtccaaaaatggggtctgctcctgctaccttgacccttccctttcctctgcttctctcctcatcatcattcccaacaacatcctctgccacacacaacaaaacgtaagtttcatttgggcaaaaattgagcctcacaataaacaccctgaagacacaacttgacttataacatagtgcacagcaagagctacatccaagtgtcctattatctgtgattattttcttaatgacaatgtacatatgcccccatccatgttaattattatctaattccattagggttcacgtcttttctttctgggacactatcctactatatccatatctatagatttcaatatagatgattgtgccatcttctgtagcccctccgctctactcattccttccaccatctgcagagatttgaagtttggggctatgcatgaaacccaacactaaattttgcaagtcaagtaaccaaaaaagggggaggcattttgaagatagaacctctattttaaaaagagaagttcaactcataaacgtgattgataggtggctgatttatttaggttttgtcaagctatctatcaaagtaatggtacagttacccatctactcaaatatctgatttatctcaccatccaattatctacccacctgtcttcctctctagcaatctatttactgtttatcaatctatcaatgtaattgtctaacactcctttctattctctccctactactcactatcaattcatccccatatgaatctctaaccatattgtatctctcccactgtattcatttatacaccatcagcagacattggcatcttcaaaattatctttcaacttctgtgaaagccaacgatctcacaggttaacaaaatacaaaagcaataccctgtgttgtggactctttaaaatctggtatcctatccacccaagggagacactaacagataggccaaagtagcaagctaatgatcagtcactcactattcccagaagagcctgtgttttctaaaacactttcttgggaagcagatcagcctagaaaagttttgattagcactgtggttttccttttgcacttgaaggacaaaggtgccagcctttatgcttctctcaacccttcaagaaagtacatgtcaggaacctatggctggctttccttagcagcaagaacttgagagaaaaacacatctgtctctgcaatgcaaagtgaagagtccacccgcctgagtgggatgacttcagctagagtctcctttctgctccagttctggtttaatctgtttgaaaactatccagtaaaaagctgatggaggccaattacatggcgggtgtattgacaactctggtatttgtttcaggaagctcttctaagctgagggcacttgagcaactgacttaattttcaagcacttgattaacacaacactgcaaacagaagggagaaagtgtcagtgacacagtttcctctgatgcagctgcttctccaatggctttggggaagaacttcaccagctcttcaggttcaaagcagacccagcatacaaacaagagctgagccacctttgctgtcttgtctcctgggacgagaaggactcatccagcaaagttgcctgggattcaaaataaaggcattgcagaccgcacaggtgtgctgcagggactgatccacagagaggatgagaatgcagcatcaatcgcagacctgccctgcctcagttggaaaaccttttcaggccctcagtctaaaaaataaaaaatatgagcaccattgaattctgtgcccttaatgcttaactggtcttcttcctctggtatcagtgtcctctttgtttttgtccatcaaggcacatgagtgtgacctctgccatggggaaacacacacagagatatctatacatatatacatacatacaaacataggctatcttggcacactaaatgctaagcactgtcttaagaggtagagctggtgtgagtgaaattaatgttacattttccagctgtaaacagacatctgcatttcctagtgagctgccaggagccagattcgggaaccgtaactgatgtgccaggaatggtgcattgattcccagttccagggatgatcatgagcaggcgcaaaatcagaattaaaggtcgcacatagacgtttcagatctgtcaccaccttcagcatctggagttgagttggtgtcagatagtgtatgagaattaaatgtgtcatctgagcatgctactgatgataaatttgttactttggagttgaataaatgtgaaggctgtgaagagtggacagtcttggagaacacagtgcttgaaatggacaagctggacctattcctcactccaagacttgttctacaggaaagggtccatgctcctttggccaagatcatcagaacctctcaacccaacaaggctggcttcagggccactatggaaccctgctgttcccccttccaaaggatactaagatgcccctctggtgggtacctatcccagccacgtttcagagggagagaaatgctacagttgatcctcatctgtctggggtaaagacaacaaagtaaatacaacccaaggcaactggggtactcactgggagtgaaaatgacttcttcacaacagacatatttctgcttctgtgtttttgtgtttctttggtggggatggcttcatgggagagtggctgtcacccatcattttgaagcatatagaacaacaaatgcttacacaagacaatatccacacttttccaacttcacacacggagagtacatggagaatgcctacaggctagatttgttcagggtgccagtagtgggcatggggtgggggcaaggcaggacaaaacatacaagtctgagcaagtacatctcttgcaggttttccacatgaaaaggaagccaaataagtcctgttaggagattaggtgagaggaattagcaatgtagggactctgaaacccttccccttcccaaaacagagttcatatgcacttccaccaaagtaatgccaatgaaagtgctcgtgttaaggctgcagccaagcttgtttttcagtagtttaatgtcaagtgcctgatacagtcgactgcaagtctaaacaagcatgtttagtttttctcattcttgctttaattcagggagggggagatgtagagaagtggttgtgaaaacatgtacaggctttatgcagagcactgcgcatggctgttctgctgcaactgtgctccacgaaacagaagaaaaggtaaggtgttgtgtcacaaagaggccccagtctctttcttcttacatccatgcctcttactagatgatacatttacagattgggcagtttgttctcaaaacctgggtgagaagactattcctggactctagcaacttcaaaactgaggctgggtttcagaatctttttctgcatcaattcagtcaatttgccttcaacaaagagaagtcagcaagttctatttatgctgaaagaactattccatgagaaaagcagagaaccccaaagtgggcaggcaaccccgacgagagcttatccctgtggcggcatcaggagtggctgtacattgaattttcaagtgctggttggctgtcgccagcccatggtaggaggggaggaatggcttaagatgaggtaagatctggtggtggggcatctttcctcaattccatactgactttgatcttgagaaagaaaaactggctatgcattacctaaaaccagtccaaaatgaaacagaccaacacacacacaaaagcaaattgtcaatccctttggaattaagggaagcagcataaggtttttctttttggaaaaaatgcatttattttctttttctccaacagcaagaatcttttgttttcattttgcacgtgaccttatcttggaaactcttatacccaattgcctcccctcctattattcagagcttccctgtctttttacttgaagacaaataagtttgagcacttgagtaaaacttcacaggtgtgtaagtaggaaggcaacattttcaaaaagagaccatatgatgagaacgcctaatgatcaccacatgcaaacaaacaaaactgccagtctcatttcccacatttcttacttaagagaagagaagtaaatgaaaggaagaagaaatagatttgtaattaaagatgtggcaaaaaagatagggctgagccagttcaatttagccttcaggtgcagaatacttagagtccaaagaaatgtggagtggacttaattagatgcagttgtctttatcctgaaagtagtgagctaagcctaatttccagcattttgaaagagattcctttttgtttctttccatggtgccctctttaaggcacagagttgctccacaccactgggtggagaaagaaagattgcgaaccctcgaccatccttttgaggctacattctatgttatttggcagatttataaagctatcagtaataacaatgctatgtactgcaagctgcccttgtgttagttaaagggagcatttttaatcgttcggaaattttcgtgacatgtcaagtgcagttgtgaggactgtgtgggtgaacgaaaatgtgtctgtcaagttcagagtcctttagatttaaaaaaaaattatgacttatcaatggtgccgttatagctgtgtcagacaatgggtgtgcccattctcacaattatccttcaaaaaaaatctatgttcaaatgctttaaaaatttatcacacgatacaagagtatgactttgtcagccttctagagttctttttttcttttattttctttcgtattttttccttcaaaaaatcaatgaagacttgatttctgtcaataattgtatcaagggtgaatatactacctgaattttgtgcatgttacattgtagttgtaaccttttctaattcaggatgaatacgagatggttgtgattgtgcagtgtaccaataaagttcgagaaatttgtaacttt

SEQ ID NO: 2956 - DNA, 939 bp, Homo sapiens
atgtaccatcctgcctactgggtcgtcttctcggcgacaactgccctgctcttcatcccaggagtgcccgtgcgcagcggagatgccaccttccccaaagctatggacaacgtgacggtccggcagggggagagcgccaccctcaggtgtaccatagatgaccgggtaacccgggtggcctggctaaaccgcagcaccatcatgatccaaaatgtggatgtgtatgacgaaggtccgtacacctgctctgtgcagacagacaatcatcccaaaacgtcccgggttcacctaatagtgcaagttcctcctcagatcatgaatatctcctcagacatcactgtgaatgagggaagcagtgtgaccctgctgtgtcttgctattggcagaccagagccaactgtgacatggagacacctgtcagtcaaggaaggccagggctttgtaagtgaggatgagtacctggagatctctgacatcaagcgagaccagtccggggagtacgaatgcagcgcgttgaacgatgtcgctgcgcccgatgtgcggaaagtaaaaatcactgtaaactatcctccctatatctcaaaagccaagaacactggtgtttcagtcggtcagaagggcatcctgagctgtgaagcctctgcagtccccatggctgaattccagtggttcaaggaagaaaccaggttagccactggtctggatggaatgaggattgaaaacaaaggccgcatgtccactctgactttcttcaatgtttcagaaaaggattatgggaactatacttgtgtggccacgaacaagcttgggaacaccaatgccagcatcacattgtatgggcctggagcagtcattgatggtgtaaactcggcctccagagcactggcttgtctctggctatcagggaccctcttagcccacttcttcatcaagttttga

SEQ ID NO: 2957 - DNA, 6424 bp, Homo sapiens
tgtgcaagaaaagaaatcagagacgctgcctgcctgctcccatctctcgcgcgctctctctctcttctgctctctccctccctttgcaaacattggatttaaacctgctcagaattcagcacagaggaaggcagcagcggtagcagcagcagaagcagtagcaagcccggcagctgagagcaccgcagcgtcgagatgtaccatcctgcctactgggtcgtcttctcggcgacaactgccctgctcttcatcccaggagtgcccgtgcgcagcggagatgccaccttccccaaagctatggacaacgtgacggtccggcagggggagagcgccaccctcaggtgtaccatagatgaccgggtaacccgggtggcctggctaaaccgcagcaccatcctctacgctgggaatgacaagtggtccatagaccctcgtgtgatcatcctggtcaatacaccaacccagtacagcatcatgatccaaaatgtggatgtgtatgacgaaggtccgtacacctgctctgtgcagacagacaatcatcccaaaacgtcccgggttcacctaatagtgcaagttcctcctcagatcatgaatatctcctcagacatcactgtgaatgagggaagcagtgtgaccctgctgtgtcttgctattggcagaccagagccaactgtgacatggagacacctgtcagtcaaggaaggccagggctttgtaagtgaggatgagtacctggagatctctgacatcaagcgagaccagtccggggagtacgaatgcagcgcgttgaacgatgtcgctgcgcccgatgtgcggaaagtaaaaatcactgtaaactatcctccctatatctcaaaagccaagaacactggtgtttcagtcggtcagaagggcatcctgagctgtgaagcctctgcagtccccatggctgaattccagtggttcaaggaagaaaccaggttagccactggtctggatggaatgaggattgaaaacaaaggccgcatgtccactctgactttcttcaatgtttcagaaaaggattatgggaactatacttgtgtggccacgaacaagcttgggaacaccaatgccagcatcacattgtatgggcctggagcagtcattgatggtgtaaactcggcctccagagcactggcttgtctctggctatcagggaccctcttagcccacttcttcatcaagttttgataagaaatcctaggtcctctgagcaacgcctgcttctccatatcacagactttaatctacactgcggagagcaaaccagcttgggcttctttttgtttttttctgttattctagatttgttttctttttgtttttgtttatttgtttgtttgcttttatttccagcttgaatgagtggggttgggggcggggtgggcagggttctaccacgtgtaggataatcattcattggtgtgtccaaaaatggggtctgctcctgctaccttgacccttccctttcctctgcttctctcctcatcatcattcccaacaacatcctctgccacacacaacaaaacgtaagtttcatttgggcaaaaattgagcctcacaataaacaccctgaagacacaacttgacttataacatagtgcacagcaagagctacatccaagtgtcctattatctgtgattattttcttaatgacaatgtacatatgcccccatccatgttaattattatctaattccattagggttcacgtcttttctttctgggacactatcctactatatccatatctatagatttcaatatagatgattgtgccatcttctgtagcccctccgctctactcattccttccaccatctgcagagatttgaagtttggggctatgcatgaaacccaacactaaattttgcaagtcaagtaaccaaaaaagggggaggcattttgaagatagaacctctattttaaaaagagaagttcaactcataaacgtgattgataggtggctgatttatttaggttttgtcaagctatctatcaaagtaatggtacagttacccatctactcaaatatctgatttatctcaccatccaattatctacccacctgtcttcctctctagcaatctatttactgtttatcaatctatcaatgtaattgtctaacactcctttctattctctccctactactcactatcaattcatccccatatgaatctctaaccatattgtatctctcccactgtattcatttatacaccatcagcagacattggcatcttcaaaattatctttcaacttctgtgaaagccaacgatctcacaggttaacaaaatacaaaagcaataccctgtgttgtggactctttaaaatctggtatcctatccacccaagggagacactaacagataggccaaagtagcaagctaatgatcagtcactcactattcccagaagagcctgtgttttctaaaacactttcttgggaagcagatcagcctagaaaagttttgattagcactgtggttttccttttgcacttgaaggacaaaggtgccagcctttatgcttctctcaacccttcaagaaagtacatgtcaggaacctatggctggctttccttagcagcaagaacttgagagaaaaacacatctgtctctgcaatgcaaagtgaagagtccacccgcctgagtgggatgacttcagctagagtctcctttctgctccagttctggtttaatctgtttgaaaactatccagtaaaaagctgatggaggccaattacatggcgggtgtattgacaactctggtatttgtttcaggaagctcttctaagctgagggcacttgagcaactgacttaattttcaagcacttgattaacacaacactgcaaacagaagggagaaagtgtcagtgacacagtttcctctgatgcagctgcttctccaatggctttggggaagaacttcaccagctcttcaggttcaaagcagacccagcatacaaacaagagctgagccacctttgctgtcttgtctcctgggacgagaaggactcatccagcaaagttgcctgggattcaaaataaaggcattgcagaccgcacaggtgtgctgcagggactgatccacagagaggatgagaatgcagcatcaatcgcagacctgccctgcctcagttggaaaaccttttcaggccctcagtctaaaaaataaaaaatatgagcaccattgaattctgtgcccttaatgcttaactggtcttcttcctctggtatcagtgtcctctttgtttttgtccatcaaggcacatgagtgtgacctctgccatggggaaacacacacagagatatctatacatatatacatacatacaaacataggctatcttggcacactaaatgctaagcactgtcttaagaggtagagctggtgtgagtgaaattaatgttacattttccagctgtaaacagacatctgcatttcctagtgagctgccaggagccagattcgggaaccgtaactgatgtgccaggaatggtgcattgattcccagttccagggatgatcatgagcaggcgcaaaatcagaattaaaggtcgcacatagacgtttcagatctgtcaccaccttcagcatctggagttgagttggtgtcagatagtgtatgagaattaaatgtgtcatctgagcatgctactgatgataaatttgttactttggagttgaataaatgtgaaggctgtgaagagtggacagtcttggagaacacagtgcttgaaatggacaagctggacctattcctcactccaagacttgttctacaggaaagggtccatgctcctttggccaagatcatcagaacctctcaacccaacaaggctggcttcagggccactatggaaccctgctgttcccccttccaaaggatactaagatgcccctctggtgggtacctatcccagccacgtttcagagggagagaaatgctacagttgatcctcatctgtctggggtaaagacaacaaagtaaatacaacccaaggcaactggggtactcactgggagtgaaaatgacttcttcacaacagacatatttctgcttctgtgtttttgtgtttctttggtggggatggcttcatgggagagtggctgtcacccatcattttgaagcatatagaacaacaaatgcttacacaagacaatatccacacttttccaacttcacacacggagagtacatggagaatgcctacaggctagatttgttcagggtgccagtagtgggcatggggtgggggcaaggcaggacaaaacatacaagtctgagcaagtacatctcttgcaggttttccacatgaaaaggaagccaaataagtcctgttaggagattaggtgagaggaattagcaatgtagggactctgaaacccttccccttcccaaaacagagttcatatgcacttccaccaaagtaatgccaatgaaagtgctcgtgttaaggctgcagccaagcttgtttttcagtagtttaatgtcaagtgcctgatacagtcgactgcaagtctaaacaagcatgtttagtttttctcattcttgctttaattcagggagggggagatgtagagaagtggttgtgaaaacatgtacaggctttatgcagagcactgcgcatggctgttctgctgcaactgtgctccacgaaacagaagaaaaggtaaggtgttgtgtcacaaagaggccccagtctctttcttcttacatccatgcctcttactagatgatacatttacagattgggcagtttgttctcaaaacctgggtgagaagactattcctggactctagcaacttcaaaactgaggctgggtttcagaatctttttctgcatcaattcagtcaatttgccttcaacaaagagaagtcagcaagttctatttatgctgaaagaactattccatgagaaaagcagagaaccccaaagtgggcaggcaaccccgacgagagcttatccctgtggcggcatcaggagtggctgtacattgaattttcaagtgctggttggctgtcgccagcccatggtaggaggggaggaatggcttaagatgaggtaagatctggtggtggggcatctttcctcaattccatactgactttgatcttgagaaagaaaaactggctatgcattacctaaaaccagtccaaaatgaaacagaccaacacacacacaaaagcaaattgtcaatccctttggaattaagggaagcagcataaggtttttctttttggaaaaaatgcatttattttctttttctccaacagcaagaatcttttgttttcattttgcacgtgaccttatcttggaaactcttatacccaattgcctcccctcctattattcagagcttccctgtctttttacttgaagacaaataagtttgagcacttgagtaaaacttcacaggtgtgtaagtaggaaggcaacattttcaaaaagagaccatatgatgagaacgcctaatgatcaccacatgcaaacaaacaaaactgccagtctcatttcccacatttcttacttaagagaagagaagtaaatgaaaggaagaagaaatagatttgtaattaaagatgtggcaaaaaagatagggctgagccagttcaatttagccttcaggtgcagaatacttagagtccaaagaaatgtggagtggacttaattagatgcagttgtctttatcctgaaagtagtgagctaagcctaatttccagcattttgaaagagattcctttttgtttctttccatggtgccctctttaaggcacagagttgctccacaccactgggtggagaaagaaagattgcgaaccctcgaccatccttttgaggctacattctatgttatttggcagatttataaagctatcagtaataacaatgctatgtactgcaagctgcccttgtgttagttaaagggagcatttttaatcgttcggaaattttcgtgacatgtcaagtgcagttgtgaggactgtgtgggtgaacgaaaatgtgtctgtcaagttcagagtcctttagatttaaaaaaaaattatgacttatcaatggtgccgttatagctgtgtcagacaatgggtgtgcccattctcacaattatccttcaaaaaaaatctatgttcaaatgctttaaaaatttatcacacgatacaagagtatgactttgtcagccttctagagttctttttttcttttattttctttcgtattttttccttcaaaaaatcaatgaagacttgatttctgtcaataattgtatcaagggtgaatatactacctgaattttgtgcatgttacattgtagttgtaaccttttctaattcaggatgaatacgagatggttgtgattgtgcagtgtaccaataaagttcgagaaatttgtaa

SEQ ID NO: 2958 - DNA, 1065 bp, Homo sapiens
atgggggtctgtgggtacctgttcctgccctggaagtgcctcgtggtcgtgtctctcaggctgctgttccttgtacccacaggagtgcccgtgcgcagcggagatgccaccttccccaaagctatggacaacgtgacggtccggcagggggagagcgccaccctcaggtgtaccatagatgaccgggtaacccgggtggcctggctaaaccgcagcaccatcctctacgctgggaatgacaagtggtccatagaccctcgtgtgatcatcctggtcaatacaccaacccagtacagcatcatgatccaaaatgtggatgtgtatgacgaaggtccgtacacctgctctgtgcagacagacaatcatcccaaaacgtcccgggttcacctaatagtgcaagttcctcctcagatcatgaatatctcctcagacatcactgtgaatgagggaagcagtgtgaccctgctgtgtcttgctattggcagaccagagccaactgtgacatggagacacctgtcagtcaaggaaggccagggctttgtaagtgaggatgagtacctggagatctctgacatcaagcgagaccagtccggggagtacgaatgcagcgcgttgaacgatgtcgctgcgcccgatgtgcggaaagtaaaaatcactgtaaactatcctccctatatctcaaaagccaagaacactggtgtttcagtcggtcagaagggcatcctgagctgtgaagcctctgcagtccccatggctgaattccagtggttcaaggaagaaaccaggttagccactggtctggatggaatgaggattgaaaacaaaggccgcatgtccactctgactttcttcaatgtttcagaaaaggattatgggaactatacttgtgtggccacgaacaagcttgggaacaccaatgccagcatcacattgtatgaaataagcccctcatcagcagtggcagggcctggagcagtcattgatggtgtaaactcggcctccagagcactggcttgtctctggctatcagggaccctcttagcccacttcttcatcaagttttga

SEQ ID NO: 2959 - DNA, 2543 bp, Homo sapiens
cctcccgcggctgcagccggagccgaaggtggtggctgcacagtagacgccccctcacggcttcccccacacgctcccgccccctcgctcgcccatcgcgcttccctcacaggctctgcagtcctcccccacagacgccttcccccttggactctcattcccttttccacggagccccgcgctttcgtgagccccctcgaggaacctggtctccgcatccagttaccacctcctgcctcagaggccatctgagcccttcgcacctcgcccctcagtccccccttccccccccgcccgcgtcgcctcgctccctcccgcccccccatcatcccttccctcgcagttcccctgtcctgaggggagccccgccacgggcagcgcggcggcggcggcaggagggagaaagtgaagcggtagctcgcgcacactcgcgccctcactcccggctaggcggcacccaccgccgggaggaggaggaggagccgagaggagctgagcgagcgcggaagtagctgctgctggtggtgacaatgtcaaataacggcctagacattcaagacaaacccccagcccctccgatgagaaataccagcactatgattggagccggcagcaaagatgctggaaccctaaaccatggttctaaacctctgcctccaaacccagaggagaagaaaaagaaggaccgattttaccgatccattttacctggagataaaacaaataaaaagaaagagaaagagcggccagagatttctctcccttcagattttgaacacacaattcatgtcggttttgatgctgtcacaggggagtttacgggaatgccagagcagtgggcccgcttgcttcagacatcaaatatcactaagtcggagcagaagaaaaacccgcaggctgttctggatgtgttggagttttacaactcgaagaagacatccaacagccagaaatacatgagctttacagataagtcagctgaggattacaattcttctaatgccttgaatgtgaaggctgtgtctgagactcctgcagtgccaccagtttcagaagatgaggatgatgatgatgatgatgctaccccaccaccagtgattgctccacgcccagagcacacaaaatctgtatacacacggtctgtgattgaaccacttcctgtcactccaactcgggacgtggctacatctcccatttcacctactgaaaataacaccactccaccagatgctttgacccggaatactgagaagcagaagaagaagcctaaaatgtctgatgaggagatcttggagaaattacgaagcatagtgagtgtgggcgatcctaagaagaaatatacacggtttgagaagattggacaaggtgcttcaggcaccgtgtacacagcaatggatgtggccacaggacaggaggtggccattaagcagatgaatcttcagcagcagcccaagaaagagctgattattaatgagatcctggtcatgagggaaaacaagaacccaaacattgtgaattacttggacagttacctcgtgggagatgagctgtgggttgttatggaatacttggctggaggctccttgacagatgtggtgacagaaacttgcatggatgaaggccaaattgcagctgtgtgccgtgagtgtctgcaggctctggagttcttgcattcgaaccaggtcattcacagagacatcaagagtgacaatattctgttgggaatggatggctctgtcaagctaactgactttggattctgtgcacagataaccccagagcagagcaaacggagcaccatggtaggaaccccatactggatggcaccagaggttgtgacacgaaaggcctatgggcccaaggttgacatctggtccctgggcatcatggccatcgaaatgattgaaggggagcctccatacctcaatgaaaaccctctgagagccttgtacctcattgccaccaatgggaccccagaacttcagaacccagagaagctgtcagctatcttccgggactttctgaaccgctgtctcgagatggatgtggagaagagaggttcagctaaagagctgctacaggtgagaaaactgaggtttcaagtgtttagtaacttttccatgatagctgcatcaattcctgaagattgccaagcccctctccagcctcactccactgattgctgcagctaaggaggcaacaaagaacaatcactaaaaccacactcaccccagcctcattgtgccaagccttctgtgagataaatgcacatttcagaaattccaactcctgatgccctcttctccttgccttgcttctcccatttcctgatctagcactcctcaagactttgatccttggaaaccgtgtgtccagcattgaagagaactgcaactgaatgactaatcagatgatggccatttctaaataaggaatttcctcccaattcatggatatgagggtggtttatgattaagggtttatataaataaatgtttctagtcttccgtgtgtcaaaatcctcacctccttcataaccatct

SEQ ID NO: 2960 - DNA, 3737 bp, Homo sapiens
gccctcccgcggctgcagccggagccgaaggtggtggctgcacagtagacgccccctcacggcttcccccacacgctcccgccccctcgctcgcccatcgcgcttccctcacaggctctgcagtcctcccccacagacgccttcccccttggactctcattcccttttccacggagccccgcgctttcgtgagccccctcgaggaacctggtctccgcatccagttaccacctcctgcctcagaggccatctgagcccttcgcacctcgcccctcagtccccccttccccccccgcccgcgtcgcctcgctccctcccgcccccccatcatcccttccctcgcagttcccctgtcctgaggggagccccgccacgggcagcgcggcggcggcggcaggagggagaaagtgaagcggtagctcgcgcacactcgcgccctcactcccggctaggcggcacccaccgccgggaggaggaggaggagccgagaggagctgagcgagcgcggaagtagctgctgctggtggtgacaatgtcaaataacggcctagacattcaagacaaacccccagcccctccgatgagaaataccagcactatgattggagccggcagcaaagatgctggaaccctaaaccatggttctaaacctctgcctccaaacccagaggagaagaaaaagaaggaccgattttaccgatccattttacctggagataaaacaaataaaaagaaagagaaagagcggccagagatttctctcccttcagattttgaacacacaattcatgtcggttttgatgctgtcacaggggagtttacgggaatgccagagcagtgggcccgcttgcttcagacatcaaatatcactaagtcggagcagaagaaaaacccgcaggctgttctggatgtgttggagttttacaactcgaagaagacatccaacagccagaaatacatgagctttacagataagtcagctgaggattacaattcttctaatgccttgaatgtgaaggctgtgtctgagactcctgcagtgccaccagtttcagaagatgaggatgatgatgatgatgatgctaccccaccaccagtgattgctccacgcccagagcacacaaaatctgtatacacacggtctgtgattgaaccacttcctgtcactccaactcgggacgtggctacatctcccatttcacctactgaaaataacaccactccaccagatgctttgacccggaatactgagaagcagaagaagaagcctaaaatgtctgatgaggagatcttggagaaattacgaagcatagtgagtgtgggcgatcctaagaagaaatatacacggtttgagaagattggacaaggtgcttcaggcaccgtgtacacagcaatggatgtggccacaggacaggaggtggccattaagcagatgaatcttcagcagcagcccaagaaagagctgattattaatgagatcctggtcatgagggaaaacaagaacccaaacattgtgaattacttggacagttacctcgtgggagatgagctgtgggttgttatggaatacttggctggaggctccttgacagatgtggtgacagaaacttgcatggatgaaggccaaattgcagctgtgtgccgtgagtgtctgcaggctctggagttcttgcattcgaaccaggtcattcacagagacatcaagagtgacaatattctgttgggaatggatggctctgtcaagctaactgactttggattctgtgcacagataaccccagagcagagcaaacggagcaccatggtaggaaccccatactggatggcaccagaggttgtgacacgaaaggcctatgggcccaaggttgacatctggtccctgggcatcatggccatcgaaatgattgaaggggagcctccatacctcaatgaaaaccctctgagagccttgtacctcattgccaccaatgggaccccagaacttcagaacccagagaagctgtcagctatcttccgggactttctgaaccgctgtctcgagatggatgtggagaagagaggttcagctaaagagctgctacagcatcaattcctgaagattgccaagcccctctccagcctcactccactgattgctgcagctaaggaggcaacaaagaacaatcactaaaaccacactcaccccagcctcattgtgccaagccttctgtgagataaatgcacatttcagaaattccaactcctgatgccctcttctccttgccttgcttctcccatttcctgatctagcactcctcaagactttgatccttggaaaccgtgtgtccagcattgaagagaactgcaactgaatgactaatcagatgatggccatttctaaataaggaatttcctcccaattcatggatatgagggtggtttatgattaagggtttatataaataaatgtttctagtcttccgtgtgtcaaaatcctcacctccttcataaccatctcccacaattaattcttgactatataaatttatggtttgataatattatcaatttgtaatcaattgagatttctttagtgcttgcttttctgtgactcaactgcccagacacctcattgtacttgaaaactggaacagcttgggaatgccatggggtttgataatctgccagggacatgaagaggctcagcttcctggaccatgactttggctcagctgatcctgacatgggagaacaaccacatttttctttgtgtgtgcttctagcagctgttcgggaggaccttgacccaatagtgttcccatgctgtttcttgtgaaatgctctcggctatgtagcagcttttgattccctgcataccctaggctgctgcccctatcctgtcccttgtttataacattgagaggttttctagggcacatactgagtgagagcagtgttgagaagtcggggaaaatggtgactacttttagagcaaggctgggcatcagcacctgtccagctctacttgtgtgatgtttcaggaactcagcccctttttctgcctaggataaggagctgaaagattaacttggatcttctaatggtccaaatcttttggtcacaataaagagtctccaaattagagactgcatgttagttctggatggatttggtggcctgacatgataccctgccagctgtgaggggaccccgtttttaagatgcatggccaagctctctgcaaatggaaatgcttacactgggtgttggggatgtttgctacctcctgctatttttgtggttttggttctcccactatggtaggacccctggccagcattgtggcttgtcatgtcagccccattgactaccttctcatgctctgaggtactactgcctctgcagcacaaatttctatttctgtcaataaaaggagatgaaaatattctattggagtatgcctttcttttttctcttcgttttttctttccttttctaattttttatatgaaataatgagtagtttcttcctgaaccatttgagagtggtaagttgcagatagaatgcccctttaccactatatacctgaatgtgtattctttctttttaacacttttattttaaatataaattaagagaaatgggccaaaaccatttgtattgtttaaagaataattataaacacacttgtatccaccaaatcaagaaatggaacactgacagtaagaaccttctctatcttgtccttcctttctca

SEQ ID NO: 2961 - DNA, 559 bp, Homo sapiens
tcatcccttccctcgcagttcccctgtcctgaggggagccccgccacgggcagcgcggcggcggcggcaggagggagaaagtgaagcggtagctcgcgcacactcgcgccctcactcccggctaggcggcacccaccgccgggaggaggaggaggagccgagaggagctgagcgagcgcggaagatgacatacccctcattcttcagagctcagtctcctgtcaagtctttcttcctttattagctgctgctggtggtgacaatgtcaaataacggcctagacattcaagacaaacccccagcccctccgatgagaaataccagcactatgattggagccggcagcaaagatgctggaaccctaaaccatggttctaaacctctgcctccaaacccagaggagaagaaaaagaaggaccgattttaccgatccattttacctggagataaaacaaataaaaagaaagagaaagagcggccagagatttctctcccttcagattttgaacacacaattcatgtcggttttgatgctgtcacaggggagtttacgggaatg

SEQ ID NO: 2962 - DNA, 502 bp, Homo sapiens
acacgacatcggatagttttcaaattcagcccttgacaacgagctcatagatgcggtggtgctttgttaacctgaaaaggaccctcagcgccggaagttagccgtctttctccatcctgactactacagtagccctcccagaaatcgtcccaaaattgtctgatagaaaggctgcacggaaacaacccgccacggacagcggaccgagaacagtgacgcgacgcgatgacgtcacgcagcaagcgggtgattccccagcctctggcgtcacgcgccgatgacgtaatcccaggcgttcgccctcatgcgggccagggtttggcctcgctcccacggcacgtctgaggcattggtttttcatccttccaaacttttggtctacagagactattagaagattaagtagctgctgctggtggtgacaatgtcaaataacggcctagacattcaagacaaacccccagcccctccgatgagaaataccagcactatgattggagcc

SEQ ID NO: 2963 - DNA, 581 bp, Homo sapiens
acctcgggagctggcggctgagctgccaggagcccagcccagctgaatcgagcggagccggtggagcaggggccttgtgggtacccggttgggcagggagaggtgcggctctgcgacggaaacaatcgccagagatgccggggctagccttccccaccaggatggatagaatggtgctatctgagctgttataatgttggcctcatgcctagctttatattgcagcacgtctgaggcattggtttttcatccttccaaacttttggtctacagagactattagaagattaagtagctgctgctggtggtgacaatgtcaaataacggcctagacattcaagacaaacccccagcccctccgatgagaaataccagcactatgattggagccggcagcaaagatgctggaaccctaaaccatggttctaaacctctgcctccaaacccagaggagaagaaaaagaaggaccgattttaccgatccattttacctggagataaaacaaataaaaagaaagagaaagagcggccagagatttctctcccttcagattttgaacacacaattcatgtcggttttg

SEQ ID NO: 2964 - DNA, 450 bp, Homo sapiens
acctcgggagctggcggctgagctgccaggagcccagcccagctgaatcgagcggagccggtggagcaggggccttgtgggtacccggttgggcagggagaggtgcggctctgcgacggaaacaatcgccagagatgccggggctagccttccccaccaggttggtggcgatacaaaaattgaaactggcctcagttgttgctctcaaatgcagatcaaggaatgtggacgctcatgtgtagctgctgctggtggtgacaatgtcaaataacggcctagacattcaagacaaacccccagcccctccgatgagaaataccagcactatgattggagccggcagcaaagatgctggaaccctaaaccatggttctaaacctctgcctccaaacccagaggagaagaaaaagaaggaccgattttaccgatccattttacctggagataaaa

SEQ ID NO: 2965 - DNA, 576 bp, Homo sapiens
gagcgtgctgcacctcgggagctggcggctgagctgccaggagcccagcccagctgaatcgagcggagccggtggagcaggggccttgtgggtacccggttgggcagggagaggtgcggctctgcgacggaaacaatcgccagagatgccggggctagccttccccaccagcacgtctgaggcattggtttttcatccttccaaacttttggtctacagagactattagaagattaagctgctgctggtggtgacaatgtcaaataacggcctagacattcaagacaaacccccagcccctccgatgagaaataccagcactatgattggagccggcagcaaagatgctggaaccctaaaccatggttctaaacctctgcctccaaacccagaggagaagaaaaagaaggaccgattttaccgatccattttacctggagataaaacaaataaaaagaaagagaaagagcggccagagatttctctcccttcagattttgaacacacaattcatgtcggttttgatgctgtcacaggggagtttacgggaatgccagagcagtgggcccgcttgct

SEQ ID NO: 2966 - DNA, 3001 bp, Homo sapiens
tgctttgcagaaaaggagaagcgcgcggcttcctcccgcctccttccctcctttcttcccccgccccttctgtttcgccaaccccgacgcggcgccttcgctgccgccctgcgagagcgcgagcgtgctgcacctcgggagctggcggctgagctgccaggagcccagcccagctgaatcgagcggagccggtggagcaggggccttgtgggtacccggttgggcagggagaggtgcggctctgcgacggaaacaatcgccagagatgccggggctagccttccccaccagtagctgctgctggtggtgacaatgtcaaataacggcctagacattcaagacaaacccccagcccctccgatgagaaataccagcactatgattggagccggcagcaaagatgctggaaccctaaaccatggttctaaacctctgcctccaaacccagaggagaagaaaaagaaggaccgattttaccgatccattttacctggagataaaacaaataaaaagaaagagaaagagcggccagagatttctctcccttcagattttgaacacacaattcatgtcggttttgatgctgtcacaggggagtttacgggaatgccagagcagtgggcccgcttgcttcagacatcaaatatcactaagtcggagcagaagaaaaacccgcaggctgttctggatgtgttggagttttacaactcgaagaagacatccaacagccagaaatacatgagctttacagataagtcagctgaggattacaattcttctaatgccttgaatgtgaaggctgtgtctgagactcctgcagtgccaccagtttcagaagatgaggatgatgatgatgatgatgctaccccaccaccagtgattgctccacgcccagagcacacaaaatctgtatacacacggtctgtgattgaaccacttcctgtcactccaactcgggacgtggctacatctcccatttcacctactgaaaataacaccactccaccagatgctttgacccggaatactgagaagcagaagaagaagcctaaaatgtctgatgaggagatcttggagaaattacgaagcatagtgagtgtgggcgatcctaagaagaaatatacacggtttgagaagattggacaaggtgcttcaggcaccgtgtacacagcaatggatgtggccacaggacaggaggtggccattaagcagatgaatcttcagcagcagcccaagaaagagctgattattaatgagatcctggtcatgagggaaaacaagaacccaaacattgtgaattacttggacagttacctcgtgggagatgagctgtgggttgttatggaatacttggctggaggctccttgacagatgtggtgacagaaacttgcatggatgaaggccaaattgcagctgtgtgccgtgagtgtctgcaggctctggagttcttgcattcgaaccaggtcattcacagagacatcaagagtgacaatattctgttgggaatggatggctctgtcaagctaactgactttggattctgtgcacagataaccccagagcagagcaaacggagcaccatggtaggaaccccatactggatggcaccagaggttgtgacacgaaaggcctatgggcccaaggttgacatctggtccctgggcatcatggccatcgaaatgattgaaggggagcctccatacctcaatgaaaaccctctgagagccttgtacctcattgccaccaatgggaccccagaacttcagaacccagagaagctgtcagctatcttccgggactttctgaaccgctgtctcgagatggatgtggagaagagaggttcagctaaagagctgctacagcactcctcaagactttgatccttggaaaccgtgtgtccagcattgaagagaactgcaactgaatgactaatcagatgatggccatttctaaataaggaatttcctcccaattcatggatatgagggtggtttatgattaagggtttatataaataaatgtttctagtcttccgtgtgtcaaaatcctcacctccttcataaccatctcccacaattaattcttgactatataaatttatggtttgataatattatcaatttgtaatcaattgagatttctttagtgcttgcttttctgtgactcaactgcccagacacctcattgtacttgaaaactggaacagcttgggaatgccatggggtttgataatctgccagggacatgaagaggctcagcttcctggaccatgactttggctcagctgatcctgacatgggagaacaaccacatttttctttgtgtgtgcttctagcagctgttcgggaggaccttgacccaatagtgttcccatgctgtttcttgtgaaatgctctcggctatgtagcagcttttgattccctgcataccctaggctgctgcccctatcctgtcccttgtttataacattgagaggttttctagggcacatactgagtgagagcagtgttgagaagtcggggaaaatggtgactacttttagagcaaggctgggcatcagcacctgtccagctctacttgtgtgatgtttcaggaactcagcccctttttctgcctaggataaggagctgaaagattaacttggatcttctaatggtccaaatcttttggtcacaataaagagtctccaaattagagactgcatgttagttctggatggatttggtggcctgacatgataccctgccagctgtgaggggaccccgtttttaagatgcatggccaagctctctgcaaatggaaatgcttacactgggtgttggggatgtttgctacctcctgctatttttgtggttttggttctcccactatggtaggacccctggccagcattgtggcttgtcatgtcagccccattgactaccttctcatgctctgaggtactactgcctctgcagcacaaatttctatttctgtcaataaaaggagatgaaaatattc

SEQ ID NO: 2967 - DNA, 2306 bp, Homo sapiens
agccccggatgttcgttggggattcaacatggcggcgggagtgtccgcggtggtggcggtgcaagagagctgagggaggcgcgagggcgcggagttccaggtcgagcagttaggccgcgagcgactgcggcgccgagccggccgcaccgagtccccggcaccatgtttgggaagaggaagaagcgggtggagatctccgcgccgtccaacttcgagcaccgcgtgcacacgggcttcgaccagcacgagcagaagttcacggggctgccccgccagtggcagagcctgatcgaggagtcggctcgccggcccaagcccctcgtcgaccccgcctgcatcacctccatccagcccggggcccccaagggggagcctcatgacgtggcccctaacgggccatcagcggggggcctggccatcccccagtcctcctcctcctcctcccggcctcccacccgagcccgaggtgcccccagccctggagtgctgggaccccacgcctcagagccccagctggcccctccagcctgcacccccgccgcccctgctgttcctgggccccctggcccccgctcaccacagcgggagccacagcgagtatcccatgagcagttccgggctgccctgcagctggtggtggacccaggcgacccccgctcctacctggacaacttcatcaagattggcgagggctccacgggcatcgtgtgcatcgccaccgtgcgcagctcgggcaagctggtggccgtcaagaagatggacctgcgcaagcagcagaggcgcgagctgctcttcaacgaggtggtaatcatgagggactaccagcacgagaatgtggtggagatgtacaacagctacctggtgggggacgagctctgggtggtcatggagttcctggaaggaggcgccctcaccgacatcgtcacccacaccaggatgaacgaggagcagatcgcggccgtgtgccttgcagtgctgcaggccctgtcggtgctccacgcccagggcgtcatccaccgggacatcaagagcgactcgatcctgctgacccatgatggcagggtgaagctgtcagactttgggttctgcgcccaggtgagcaaggaagtgccccgaaggaagtcgctggtcggcacgccctactggatggccccagagctcatctcccgccttccctacgggccagaggtagacatctggtcgctggggataatggtgattgagatggtggacggagagcccccctacttcaacgagccacccctcaaagccatgaagatgattcgggacaacctgccaccccgactgaagaacctgcacaaggtgtcgccatccctgaagggcttcctggaccgcctgctggtgcgagaccctgcccagcgggccacggcagccgagctgctgaagcacccattcctggccaaggcagggccgcctgccagcatcgtgcccctcatgcgccagaaccgcaccagatgaggcccagcgcccttcccctcaaccaaagagccccccgggtcacccccgccccactgaggccagtagggggccaggcctcccactcctcccagcccgggagatgctccgcgtggcaccaccctccttgctgggggtagatgagaccctactactgaactccagttttgatctcgtgacttttagaaaaacacagggactcgtgggagcaagcgaggctcccaggacccccaccctctgggacaggccctcccccatgttcttctgtctccaggaagggcagcggccctcccatcactggaagtctgcagtgggggtcgctgggggtggagagaacactaagaggtgaacatgtatgagtgtgtgcacgcgtgtgagtgtgcatgtgtgtgtgtgcaaaggtccagccaccccgtcctccagcctgcaaggggtgtctggcgccttgcctgacacccagccccctctccccctgagccattgtgggggtcgatcatgaatgtccgaagagtggccttttcccgtagccctgcgccccctttctgtggctggatggggagacaggtcagggccccccaccctctccagcccctgcagcaaatgactactgcacctggacagcctcctcttttctagaagtctatttatattgtcattttataacactctagcccctgcccttattgggggacagatggtccctgtcctgcggggtggccctggcagaaccactgcctgaagaaccaggttcctgcccggtcagcgcagccccagcccgcccacccctgcctcgagttagttttacaattaaaacattgtcttgttttgtg

SEQ ID NO: 2968 - DNA, 2765 bp, Homo sapiens
agccccggatgttcgttggggattcaacatggcggcgggagtgtccgcggtggtggcggtgcaagagagctgagggaggcgcgagggcgcggagttccaggtcgagcagttaggccgcgagcgactgcggcgccgagccggccgcaccgagtccccggcaccatgtttgggaagaggaagaagcgggtggagatctccgcgccgtccaacttcgagcaccgcgtgcacacgggcttcgaccagcacgagcagaagttcacggggctgccccgccagtggcagagcctgatcgaggagtcggctcgccggcccaagcccctcgtcgaccccgcctgcatcacctccatccagcccggggcccccaagaccatcgtgcggggcagcaaaggtgccaaagatggggccctcacgctgctgctggacgagtttgagaacatgtcggtgacacgctccaactccctgcggagagacagcccgccgccgcccgcccgtgcccgccaggaaaatgggatgccagaggagccggccaccacggccagagggggcccagggaaggcaggcagccgaggccggttcgccggtcacagcgaggcgggtggcggcagtggtgacaggcgacgggcggggccagagaagaggcccaagtcttccagggagggctcagggggtccccaggagtcctcccgggacaaacgccccctctccgggcctgatgtcggcaccccccagcctgctggtctggccagtggggcgaaactggcagctggccggccctttaacacctacccgagggctgacacggaccacccatcccggggtgcccagggggagcctcatgacgtggcccctaacgggccatcagcggggggcctggccatcccccagtcctcctcctcctcctcccggcctcccacccgagcccgaggtgcccccagccctggagtgctgggaccccacgcctcagagccccagctggcccctccagcctgcacccccgccgcccctgctgttcctgggccccctggcccccgctcaccacagcgggagccacagcgagtatcccatgagcagttccgggctgccctgcagctggtggtggacccaggcgacccccgctcctacctggacaacttcatcaagattggcgagggctccacgggcatcgtgtgcatcgccaccgtgcgcagctcgggcaagctggtggccgtcaagaagatggacctgcgcaagcagcagaggcgcgagctgctcttcaacgaggtggtaatcatgagggactaccagcacgagaatgtggtggagatgtacaacagctacctggtgggggacgagctctgggtggtcatggagttcctggaaggaggcgccctcaccgacatcgtcacccacaccaggatgaacgaggagcagatcgcggccgtgtgccttgcagtgctgcaggccctgtcggtgctccacgcccagggcgtcatccaccgggacatcaagagcgactcgatcctgctgacccatgatggcagggtgaagctgtcagactttgggttctgcgcccaggtgagcaaggaagtgccccgaaggaagtcgctggtcggcacgccctactggatggccccagagctcatctcccgccttccctacgggccagaggtagacatctggtcgctggggataatggtgattgagatggtggacggagagcccccctacttcaacgagccacccctcaaagccatgaagatgattcgggacaacctgccaccccgactgaagaacctgcacaaggtgtcgccatccctgaagggcttcctggaccgcctgctggtgcgagaccctgcccagcgggccacggcagccgagctgctgaagcacccattcctggccaaggcagggccgcctgccagcatcgtgcccctcatgcgccagaaccgcaccagatgaggcccagcgcccttcccctcaaccaaagagccccccgggtcacccccgccccactgaggccagtagggggccaggcctcccactcctcccagcccgggagatgctccgcgtggcaccaccctccttgctgggggtagatgagaccctactactgaactccagttttgatctcgtgacttttagaaaaacacagggactcgtgggagcaagcgaggctcccaggacccccaccctctgggacaggccctcccccatgttcttctgtctccaggaagggcagcggccctcccatcactggaagtctgcagtgggggtcgctgggggtggagagaacactaagaggtgaacatgtatgagtgtgtgcacgcgtgtgagtgtgcatgtgtgtgtgtgcaaaggtccagccaccccgtcctccagcctgcaaggggtgtctggcgccttgcctgacacccagccccctctccccctgagccattgtgggggtcgatcatgaatgtccgaagagtggccttttcccgtagccctgcgccccctttctgtggctggatggggagacaggtcagggccccccaccctctccagcccctgcagcaaatgactactgcacctggacagcctcctcttttctagaagtctatttatattgtcattttataacactctagcccctgcccttattgggggacagatggtccctgtcctgcggggtggccctggcagaaccactgcctgaagaaccaggttcctgcccggtcagcgcagccccagcccgcccacccctgcctcgagttagttttacaattaaaacattgtcttgttttgtg

SEQ ID NO: 2969 - DNA, 1814 bp, Homo sapiens
atgttcgttggggattcaacatggcggcgggagtgtccgcggtggtggcggtgcaagagagctgagggaggcgcgagggcgcggagttccaggtcgagcagttaggccgcgagcgactgcggcgccgagccggccgcaccgagtccccggcaccatgtttgggaagaggaagaagcgggtggagatctccgcgccgtccaacttcgagcaccgcgtgcacacgggcttcgaccagcacgagcagaagttcacggggctgccccgccagtggcagagcctgatcgaggagtcggctcgccggcccaagcccctcgtcgaccccgcctgcatcacctccatccagcccggggcccccaagaccatcgtgcggggcagcaaaggtgccaaagatggggccctcacgctgctgctggacgagtttgagaacatgtcggtgacacgctccaactccctgcggagagacagcccgccgccgcccgcccgtgcccgccaggaaaatgggatgccagaggagccggccctttaacacctacccgagggctgacacggaccacccatcccggggtgcccagggggagcctcatgacgtggcccctaacgggccatcagcggggggcctggccatcccccagtcctcctcctcctcctcccggcctcccacccgagcccgaggtgcccccagccctggagtgctgggaccccacgcctcagagccccagctggcccctccagcctgcacccccgccgcccctgctgttcctgggccccctggcccccgctcaccacagcgggagccacagcgagtatcccatgagcagttccgggctgccctgcagctggtggtggacccaggcgacccccgctcctacctggacaacttcatcaagattggcgagggctccacgggcatcgtgtgcatcgccaccgtgcgcagctcgggcaagctggtggccgtcaagaagatggacctgcgcaagcagcagaggcgcgagctgctcttcaacgaggtggtaatcatgagggactaccagcacgagaatgtggtggagatgtacaacagctacctggtgggggacgagctctgggtggtcatggagttcctggaaggaggcgccctcaccgacatcgtcacccacaccaggatgaacgaggagcagatcgcggccgtgtgccttgcagtgctgcaggccctgtcggtgctccacgcccagggcgtcatccaccgggacatcaagagcgactcgatcctgctgacccatgatggcagggtgaagctgtcagactttgggttctgcgcccaggtgagcaaggaagtgccccgaaggaagtcgctggtcggcacgccctactggatggccccagagctcatctcccgccttccctacgggccagaggtagacatctggtcgctggggataatggtgattgagatggtggacggagagcccccctacttcaacgagccacccctcaaagccatgaagatgattcgggacaacctgccaccccgactgaagaacctgcacaaggtgtcgccatccctgaagggcttcctggaccgcctgctggtgcgagaccctgcccagcgggccacggcagccgagctgctgaagcacccattcctggccaaggcagggccgcctgccagcatcgtgcccctcatgcgccagaaccgcaccagatgaggcccagcgcccttcccctcaaccaaagagccccccgggtcacccccgccccactgaggccagtagggggccaggcctcccactcctcccagcccgggagatgctccgcgtggcaccaccctccttgct

SEQ ID NO: 2970 - DNA, 2855 bp, Homo sapiens
ccatctttctccaggctctctatgggatgccgccatcagaatgtctcttcctcagcccctttgttttttaaagtggctttggtcgaccatttgctctgtgcttggtactgtgtcaagggcccgattgaagaccacagatcctaaagataggggagtgtcgcgacaaggctgcctggggtgccctcttaacccaggggatcagtaaccctgtgctgagtcaatatccaaaggccgcaccgagtccccggcaccatgtttgggaagaggaagaagcgggtggagatctccgcgccgtccaacttcgagcaccgcgtgcacacgggcttcgaccagcacgagcagaagttcacggggctgccccgccagtggcagagcctgatcgaggagtcggctcgccggcccaagcccctcgtcgaccccgcctgcatcacctccatccagcccggggcccccaagaccatcgtgcggggcagcaaaggtgccaaagatggggccctcacgctgctgctggacgagtttgagaacatgtcggtgacacgctccaactccctgcggagagacagcccgccgccgcccgcccgtgcccgccaggaaaatgggatgccagaggagccggccaccacggccagagggggcccagggaaggcaggcagccgaggccggttcgccggtcacagcgaggcgggtggcggcagtggtgacaggcgacgggcggggccagagaagaggcccaagtcttccagggagggctcagggggtccccaggagtcctcccgggacaaacgccccctctccgggcctgatgtcggcaccccccagcctgctggtctggccagtggggcgaaactggcagctggccggccctttaacacctacccgagggctgacacggaccacccatcccggggtgcccagggggagcctcatgacgtggcccctaacgggccatcagcggggggcctggccatcccccagtcctcctcctcctcctcccggcctcccacccgagcccgaggtgcccccagccctggagtgctgggaccccacgcctcagagccccagctggcccctccagcctgcacccccgccgcccctgctgttcctgggccccctggcccccgctcaccacagcgggagccacagcgagtatcccatgagcagttccgggctgccctgcagctggtggtggacccaggcgacccccgctcctacctggacaacttcatcaagattggcgagggctccacgggcatcgtgtgcatcgccaccgtgcgcagctcgggcaagctggtggccgtcaagaagatggacctgcgcaagcagcagaggcgcgagctgctcttcaacgaggtggtaatcatgagggactaccagcacgagaatgtggtggagatgtacaacagctacctggtgggggacgagctctgggtggtcatggagttcctggaaggaggcgccctcaccgacatcgtcacccacaccaggatgaacgaggagcagatcgcggccgtgtgccttgcagtgctgcaggccctgtcggtgctccacgcccagggcgtcatccaccgggacatcaagagcgactcgatcctgctgacccatgatggcagggtgaagctgtcagactttgggttctgcgcccaggtgagcaaggaagtgccccgaaggaagtcgctggtcggcacgccctactggatggccccagagctcatctcccgccttccctacgggccagaggtagacatctggtcgctggggataatggtgattgagatggtggacggagagcccccctacttcaacgagccacccctcaaagccatgaagatgattcgggacaacctgccaccccgactgaagaacctgcacaaggtgtcgccatccctgaagggcttcctggaccgcctgctggtgcgagaccctgcccagcgggccacggcagccgagctgctgaagcacccattcctggccaaggcagggccgcctgccagcatcgtgcccctcatgcgccagaaccgcaccagatgaggcccagcgcccttcccctcaaccaaagagccccccgggtcacccccgccccactgaggccagtagggggccaggcctcccactcctcccagcccgggagatgctccgcgtggcaccaccctccttgctgggggtagatgagaccctactactgaactccagttttgatctcgtgacttttagaaaaacacagggactcgtgggagcaagcgaggctcccaggacccccaccctctgggacaggccctcccccatgttcttctgtctccaggaagggcagcggccctcccatcactggaagtctgcagtgggggtcgctgggggtggagagaacactaagaggtgaacatgtatgagtgtgtgcacgcgtgtgagtgtgcatgtgtgtgtgtgcaaaggtccagccaccccgtcctccagcctgcaaggggtgtctggcgccttgcctgacacccagccccctctccccctgagccattgtgggggtcgatcatgaatgtccgaagagtggccttttcccgtagccctgcgccccctttctgtggctggatggggagacaggtcagggccccccaccctctccagcccctgcagcaaatgactactgcacctggacagcctcctcttttctagaagtctatttatattgtcattttataacactctagcccctgcccttattgggggacagatggtccctgtcctgcggggtggccctggcagaaccactgcctgaagaaccaggttcctgcccggtcagcgcagccccagcccgcccacccctgcctcgagttagttttacaattaaaacattgtcttgttttgtg

SEQ ID NO: 2971 - DNA, 2701 bp, Homo sapiens
cagatgagtaacccgaagcccctagaggagtggtcacctgcctgagggcacttctgtcccaccagcatcagaccaggccgcaccgagtccccggcaccatgtttgggaagaggaagaagcgggtggagatctccgcgccgtccaacttcgagcaccgcgtgcacacgggcttcgaccagcacgagcagaagttcacggggctgccccgccagtggcagagcctgatcgaggagtcggctcgccggcccaagcccctcgtcgaccccgcctgcatcacctccatccagcccggggcccccaagaccatcgtgcggggcagcaaaggtgccaaagatggggccctcacgctgctgctggacgagtttgagaacatgtcggtgacacgctccaactccctgcggagagacagcccgccgccgcccgcccgtgcccgccaggaaaatgggatgccagaggagccggccaccacggccagagggggcccagggaaggcaggcagccgaggccggttcgccggtcacagcgaggcgggtggcggcagtggtgacaggcgacgggcggggccagagaagaggcccaagtcttccagggagggctcagggggtccccaggagtcctcccgggacaaacgccccctctccgggcctgatgtcggcaccccccagcctgctggtctggccagtggggcgaaactggcagctggccggccctttaacacctacccgagggctgacacggaccacccatcccggggtgcccagggggagcctcatgacgtggcccctaacgggccatcagcggggggcctggccatcccccagtcctcctcctcctcctcccggcctcccacccgagcccgaggtgcccccagccctggagtgctgggaccccacgcctcagagccccagctggcccctccagcctgcacccccgccgcccctgctgttcctgggccccctggcccccgctcaccacagcgggagccacagcgagtatcccatgagcagttccgggctgccctgcagctggtggtggacccaggcgacccccgctcctacctggacaacttcatcaagattggcgagggctccacgggcatcgtgtgcatcgccaccgtgcgcagctcgggcaagctggtggccgtcaagaagatggacctgcgcaagcagcagaggcgcgagctgctcttcaacgaggtggtaatcatgagggactaccagcacgagaatgtggtggagatgtacaacagctacctggtgggggacgagctctgggtggtcatggagttcctggaaggaggcgccctcaccgacatcgtcacccacaccaggatgaacgaggagcagatcgcggccgtgtgccttgcagtgctgcaggccctgtcggtgctccacgcccagggcgtcatccaccgggacatcaagagcgactcgatcctgctgacccatgatggcagggtgaagctgtcagactttgggttctgcgcccaggtgagcaaggaagtgccccgaaggaagtcgctggtcggcacgccctactggatggccccagagctcatctcccgccttccctacgggccagaggtagacatctggtcgctggggataatggtgattgagatggtggacggagagcccccctacttcaacgagccacccctcaaagccatgaagatgattcgggacaacctgccaccccgactgaagaacctgcacaaggtgtcgccatccctgaagggcttcctggaccgcctgctggtgcgagaccctgcccagcgggccacggcagccgagctgctgaagcacccattcctggccaaggcagggccgcctgccagcatcgtgcccctcatgcgccagaaccgcaccagatgaggcccagcgcccttcccctcaaccaaagagccccccgggtcacccccgccccactgaggccagtagggggccaggcctcccactcctcccagcccgggagatgctccgcgtggcaccaccctccttgctgggggtagatgagaccctactactgaactccagttttgatctcgtgacttttagaaaaacacagggactcgtgggagcaagcgaggctcccaggacccccaccctctgggacaggccctcccccatgttcttctgtctccaggaagggcagcggccctcccatcactggaagtctgcagtgggggtcgctgggggtggagagaacactaagaggtgaacatgtatgagtgtgtgcacgcgtgtgagtgtgcatgtgtgtgtgtgcaaaggtccagccaccccgtcctccagcctgcaaggggtgtctggcgccttgcctgacacccagccccctctccccctgagccattgtgggggtcgatcatgaatgtccgaagagtggccttttcccgtagccctgcgccccctttctgtggctggatggggagacaggtcagggccccccaccctctccagcccctgcagcaaatgactactgcacctggacagcctcctcttttctagaagtctatttatattgtcattttataacactctagcccctgcccttattgggggacagatggtccctgtcctgcggggtggccctggcagaaccactgcctgaagaaccaggttcctgcccggtcagcgcagccccagcccgcccacccctgcctcgagttagttttacaattaaaacattgtcttgttttgtg

SEQ ID NO: 2972 - DNA, 1827 bp, Homo sapiens
gattcaacatggcggcgggagtgtccgcggtggtggcggtgcaagagagctgagggaggcgcgagggcgcggagttccaggtcgagcagttaggccgcgagcgactgcggcgccgagccggccgcaccgagtccccggcaccatgtttgggaagaggaagaagcgggtggagatctccgcgccgtccaacttcgagcaccgcgtgcacacgggcttcgaccagcacgagcagaagttcacggggctgccccgccagtggcagagcctgatcgaggagtcggctcgccggcccaagcccctcgtcgaccccgcctgcatcacctccatccagcccggggcccccaagggggagcctcatgacgtggcccctaacgggccatcagcggggggcctggccatcccccagtcctcctcctcctcctcccggcctcccacccgagcccgaggtgcccccagccctggagtgctgggaccccacgcctcagagcccccgctcaccacagcgggagccacagcgagtatcccatgagcagttccgggctgccctgcagctggtggtggacccaggcgacccccgctcctacctggacaacttcatcaagattggcgagggctccacgggcatcgtgtgcatcgccaccgtgcgcagctcgggcaagctggtggccgtcaagaagatggacctgcgcaagcagcagaggcgcgagctgctcttcaacgaggtggtaatcatgagggactaccagcacgagaatgtggtggagatgtacaacagctacctggtgggggacgagctctgggtggtcatggagttcctggaaggaggcgccctcaccgacatcgtcacccacaccaggatgaacgaggagcagatcgcggccgtgtgccttgcagtgctgcaggccctgtcggtgctccacgcccagggcgtcatccaccgggacatcaagagcgactcgatcctgctgacccatgatggcagggtgaagctgtcagactttgggttctgcgcccaggtgagcaaggaagtgccccgaaggaagtcgctggtcggcacgccctactggatggccccagagctcatctcccgccttccctacgggccagaggtagacatctggtcgctggggataatggtgattgagatggtggacggagagcccccctacttcaacgagccacccctcaaagccatgaagatgattcgggacaacctgccaccccgactgaagaacctgcacaaggtgtcgccatccctgaagggcttcctggaccgcctgctggtgcgagaccctgcccagcgggccacggcagccgagctgctgaagcacccattcctggccaaggcagggccgcctgccagcatcgtgcccctcatgcgccagaaccgcaccagatgaggcccagcgcccttcccctcaaccaaagagccccccgggtcacccccgccccactgaggccagtagggggccaggcctcccactcctcccagcccgggagatgctccgcgtggcaccaccctccttgctgggggtagatgagaccctactactgaactccagttttgatctcgtgacttttagaaaaacacagggactcgtgggagcaagcgaggctcccaggacccccaccctctgggacaggccctcccccatgttcttctgtctccaggaagggcagcggccctcccatcactggaagtctgcagtgggggtcgctgggggtggagagaacactaagaggtgaacatgtatgagtgtgtgcacgcgtgtgagtgtgcatgtgtgtgtgtgcaaaggtccagccaccccgtcctccagcctgcaa

SEQ ID NO: 2973 - DNA, 3025 bp, Homo sapiens
gcgggagtgtccgcggtggtggcggtgcaagagagctgagggaggcgcgagggcgcggagttccaggtcgagcagttaggccgcgagcgactgcggcgccgagccgatgagtaacccgaagcccctagaggagtggtcacctgcctgagggcacttctgtcccaccagcatcagaccaggtgtgtgcaggctctctatgggatgccgccatcagaatgtctcttcctcagcccctttgttttttaaagtggctttggtcgaccatttgctctgtgcttggtactgtgtcaagggcccgattgaagaccacagatcctaaagataggggagtgtcgcgacaaggctgcctggggtgccctcttaacccaggggatcagtaaccctgtgctgagtcaatatccaaaggccgcaccgagtccccggcaccatgtttgggaagaggaagaagcgggtggagatctccgcgccgtccaacttcgagcaccgcgtgcacacgggcttcgaccagcacgagcagaagttcacggggctgccccgccagtggcagagcctgatcgaggagtcggctcgccggcccaagcccctcgtcgaccccgcctgcatcacctccatccagcccggggcccccaagaccatcgtgcggggcagcaaaggtgccaaagatggggccctcacgctgctgctggacgagtttgagaacatgtcggtgacacgctccaactccctgcggagagacagcccgccgccgcccgcccgtgcccgccaggaaaatgggatgccagaggagccggccaccacggccagagggggcccagggaaggcaggcagccgaggccggttcgccggtcacagcgaggcgggtggcggcagtggtgacaggcgacgggcggggccagagaagaggcccaagtcttccagggagggctcagggggtccccaggagtcctcccgggacaaacgccccctctccgggcctgatgtcggcaccccccagcctgctggtctggccagtggggcgaaactggcagctggccggccctttaacacctacccgagggctgacacggaccacccatcccggggtgcccagggggagcctcatgacgtggcccctaacgggccatcagcggggggcctggccatcccccagtcctcctcctcctcctcccggcctcccacccgagcccgaggtgcccccagccctggagtgctgggaccccacgcctcagagccccagctggcccctccagcctgcacccccgccgcccctgctgttcctgggccccctggcccccgctcaccacagcgggagccacagcgagtatcccatgagcagttccgggctgccctgcagctggtggtggacccaggcgacccccgctcctacctggacaacttcatcaagattggcgagggctccacgggcatcgtgtgcatcgccaccgtgcgcagctcgggcaagctggtggccgtcaagaagatggacctgcgcaagcagcagaggcgcgagctgctcttcaacgaggtggtaatcatgagggactaccagcacgagaatgtggtggagatgtacaacagctacctggtgggggacgagctctgggtggtcatggagttcctggaaggaggcgccctcaccgacatcgtcacccacaccaggatgaacgaggagcagatcgcggccgtgtgccttgcagtgctgcaggccctgtcggtgctccacgcccagggcgtcatccaccgggacatcaagagcgactcgatcctgctgacccatgatggcagggtgaagctgtcagactttgggttctgcgcccaggtgagcaaggaagtgccccgaaggaagtcgctggtcggcacgccctactggatggccccagagctcatctcccgccttccctacgggccagaggtagacatctggtcgctggggataatggtgattgagatggtggacggagagcccccctacttcaacgagccacccctcaaagccatgaagatgattcgggacaacctgccaccccgactgaagaacctgcacaaggtgtcgccatccctgaagggcttcctggaccgcctgctggtgcgagaccctgcccagcgggccacggcagccgagctgctgaagcacccattcctggccaaggcagggccgcctgccagcatcgtgcccctcatgcgccagaaccgcaccagatgaggcccagcgcccttcccctcaaccaaagagccccccgggtcacccccgccccactgaggccagtagggggccaggcctcccactcctcccagcccgggagatgctccgcgtggcaccaccctccttgctgggggtagatgagaccctactactgaactccagttttgatctcgtgacttttagaaaaacacagggactcgtgggagcaagcgaggctcccaggacccccaccctctgggacaggccctcccccatgttcttctgtctccaggaagggcagcggccctcccatcactggaagtctgcagtgggggtcgctgggggtggagagaacactaagaggtgaacatgtatgagtgtgtgcacgcgtgtgagtgtgcatgtgtgtgtgtgcaaaggtccagccaccccgtcctccagcctgcaaggggtgtctggcgccttgcctgacacccagccccctctccccctgagccattgtgggggtcgatcatgaatgtccgaagagtggccttttcccgtagccctgcgccccctttctgtggctggatggggagacaggtcagggccccccaccctctccagcccctgcagcaaatgactactgcacctggacagcctcctcttttctagaagtctatttatattgtcattttataacactctagcccctgcccttattgggggacagatggtccctgtcctgcggggtggccctggcagaaccactgcctgaagaaccaggttcctgcccggtcagcgcagccccagcccgcccacccctgcctcgagttagttttacaattaaaacattgtcttgtt

SEQ ID NO: 2974 - DNA, 5735 bp, Homo sapiens
ggcggtgcaagagagctgagggaggcgcgagggcgcggagttccaggtcgagcagttaggccgcgagcgactgcggcgccgagccgatgagtaacccgaagcccctagaggagtggtcacctgcctgagggcacttctgtcccaccagcatcagaccaggccgcaccgagtccccggcaccatgtttgggaagaggaagaagcgggtggagatctccgcgccgtccaacttcgagcaccgcgtgcacacgggcttcgaccagcacgagcagaagttcacggggctgccccgccagtggcagagcctgatcgaggagtcggctcgccggcccaagcccctcgtcgaccccgcctgcatcacctccatccagcccggggcccccaagggggagcctcatgacgtggcccctaacgggccatcagcggggggcctggccatcccccagtcctcctcctcctcctcccggcctcccacccgagcccgaggtgcccccagccctggagtgctgggaccccacgcctcagagccccagctggcccctccagcctgcacccccgccgcccctgctgttcctgggccccctggcccccgctcaccacagcgggagccacagcgagtatcccatgagcagttccgggctgccctgcagctggtggtggacccaggcgacccccgctcctacctggacaacttcatcaagattggcgagggctccacgggcatcgtgtgcatcgccaccgtgcgcagctcgggcaagctggtggccgtcaagaagatggacctgcgcaagcagcagaggcgcgagctgctcttcaacgaggtggtaatcatgagggactaccagcacgagaatgtggtggagatgtacaacagctacctggtgggggacgagctctgggtggtcatggagttcctggaaggaggcgccctcaccgacatcgtcacccacaccaggatgaacgaggagcagatcgcggccgtgtgccttgcagtgctgcaggccctgtcggtgctccacgcccagggcgtcatccaccgggacatcaagagcgactcgatcctgctgacccatgatggcagggtgaagctgtcagactttgggttctgcgcccaggtgagcaaggaagtgccccgaaggaagtcgctggtcggcacgccctactggatggccccagagctcatctcccgccttccctacgggccagaggtagacatctggtcgctggggataatggtgattgagatggtggacggagagcccccctacttcaacgagccacccctcaaagccatgaagatgattcgggacaacctgccaccccgactgaagaacctgcacaaggtgtcgccatccctgaagggcttcctggaccgcctgctggtgcgagaccctgcccagcgggccacggcagccgagctgctgaagcacccattcctggccaaggcagggccgcctgccagcatcgtgcccctcatgcgccagaaccgcaccagatgaggcccagcgcccttcccctcaaccaaagagccccccgggtcacccccgccccactgaggccagtagggggccaggcctcccactcctcccagcccgggagatgctccgcgtggcaccaccctccttgctgggggtagatgagaccctactactgaactccagttttgatctcgtgacttttagaaaaacacagggactcgtgggagcaagcgaggctcccaggacccccaccctctgggacaggccctcccccatgttcttctgtctccaggaagggcagcggccctcccatcactggaagtctgcagtgggggtcgctgggggtggagagaacactaagaggtgaacatgtatgagtgtgtgcacgcgtgtgagtgtgcatgtgtgtgtgtgcaaaggtccagccaccccgtcctccagcctgcaaggggtgtctggcgccttgcctgacacccagccccctctccccctgagccattgtgggggtcgatcatgaatgtccgaagagtggccttttcccgtagccctgcgccccctttctgtggctggatggggagacaggtcagggccccccaccctctccagcccctgcagcaaatgactactgcacctggacagcctcctcttttctagaagtctatttatattgtcattttataacactctagcccctgcccttattgggggacagatggtccctgtcctgcggggtggccctggcagaaccactgcctgaagaaccaggttcctgcccggtcagcgcagccccagcccgcccacccctgcctcgagttagttttacaattaaaacattgtcttgttttgtgtctgtgtgcgatgtgtggggggcagggggccctgcccggctgtcttgggtgggaatttgcagggagagggtctggatctgggagcaaaccacgattccagccaaggcagggcaagggtggggtggggagtggggagttcaggtcatagcagccagtaagctcccccagcctgccactccccagaatggggcaggattgtccccacccctggaagcagccagtttgccacagtccatgtgcagactgatcccagtttgccaaatctgcaatttcctggaaccttttaaaggctgtcttgagcgcgtttggtgagtaggagctaacccaagttagtaaattgaaggccatttggcaaattggtcagtgggcagatgggcttttggggattgactgaggctgactggcctggagctgctggcttcggagagacaccctgtgaagtgtgtccttccacgcaggagcccagagccgagcccacgctggggggaatctgactggcatggaggtggccatgccaccatcgctgctgcagctgcatcctggcactttgcgcctcaggccctgttgggctccactttctgcatcctccccagcccccagggaggcagtggagtggggagagagccaggagtgagcctccgtccccaaagccagccaggcgtcatcagcaccagagacctcagcctggtcctctcgggaagtgagtggccagggcagagattccaggttagtccacgcctcccacccttcacaggtcctgaccccaagaatcagagcactgtgtgtgtggcagggcctatgccaagtgcaaacacagcctagatggatcatcacagagtgaaacccagcggtgcaagcagctgtgctctctgcgatgtattggaggcttaggtgaggtggatgcctttctggaaaaaaaaaaaatgctaacattggcaaaagaagaaatagaaaacaagaccaaaataactgtctcctcactgcacacacactccagaataaataaaaggtttcaggcttgaatgcactttcaaatgagattttttttttttttttgagacggagtatcgctctgtcgcccaggctggagtgcagtggcacgatcttggctcactgcaacttctgcctcctgggttcaagcgattctcctgcctcagcctcccaagtagctgggattacaggcgcttgccaccacgccaggctaattttttgtattttgagtagagactggatttcgccatcttggccagactggtcttgaactcctgacctcgtgatccacccacctcagcctcccaaagtgctgggattacaggcatgagccaccatgcctggcctcaaatgaggtttaccagactttgaaggagcaggtaattccttctaccttgtgaacaagttgttccagaaagatagcagctcaggaggcctctgtgaccatggttccagacccagataaggacggcaaagaacagagcatctcagaaacgcaaggctcacagccagggtgcccggcgaccccacgggcactgagaacagctagctctaggagctccactctcctgctgaagaaaccacgggctcagagacggggagctccctcgcccagccacatctgtgaccccacggtaactctgctggttttggtgccttcagtcactcactgcaggtttgttttgttttgttttgttttgagtttttttgttttttgttttttgtttttagagacaagatgttgctatgttgcctaggctggtttcgaactcctggcctcaagggatcctccctccttggccccgcaaagtgctgggattacaggcgtgagccaccgtgcccagcccgctcactgcagtttgaaggcatggctttgggtggcgtggggtgaaagctgcccgaggccccgttcctccccacgtggctgcctcctgccagagccagtcaggaaaacagaccccaactagagttgtttcaaatggcagggatttggtaccggtggttggatcatgacaaagctctgagaaggctggaggagccacagagtgccaagtgcccagcaatcattagaggaaggaggctgctgccacctgtgtggctagaggaacagaggggccaatggcattccccaaaccccactctcgcctctgtctggccagagcagaatggcttcttccagcttcccaccctggactcccacccaggagcctcctcctggcagacccttcctgaccccaccggcccggggggtctacagatccatgtttcaggcgtccgcctggagcggaacaggggagtgcttaggacaagggtggtgccagaggatccactctgcccacatttagttgaccagctgaggcactccacgggaatgaatgactctcgacaggtgccggaggtgaggaggggcccggaggcccaggaggggcacagggatggattcgtccgcctgggggctggaggtgtgtttacagagccccaaaataaacaatgcaaccaggtcagaccagcggttctcacagtgtggttcccagaccagcagcatcactgggagcttactggacacgcaaataaatccctgtgtgccaccccagctgcatcagatgctggtggggcccagtgatctgtatttaacacaccctccgggggatgccggtgcccactcacgtttgagaacccctgcgatccacgactgccctcccgtgtaaaaggcccacctctgtgggactccaagtcatcagcaccctagggtccttccgtctttttccttcctcctgggacacctgcctctcccatgtcgtattagagaattccttatgctcccaagtgggcacggggagaggaaggcactcctctttaaggaccgacccagaggttttgccattgcttcactggccagagcttagtcacgcagcctcacccagaggcaagggaggttggaaaatgtagtgtttgtgtgtgtctaacacaaattctattaccatgcagtcaggattctccactcttgctctttcattagatttgctgggcttcaccctggactttctgatttagtgacagaacagagaacccagaggcagacccagatgtgtacaagggcttcatatacaatcaggagatttaataatcatgctaggggccgggtgcagtggctcacgcctgtaatcccaagcactttggggagccgaggcaggcagatcacttgaggtcaggagtttgagaccagcctgggcaacaaagtgagaccctgtctctactaaaaataacaaaaattagccgggcgtggtggtgggcgcctgtaatcccagctcctcgggtggctgaggcatgagaatcacttgaacccaggaggcagaggtttcagtgagctgagatcacatcactgcactccagcctgggtgacagagtgagattctgtc

SEQ ID NO: 2975 - DNA, 1810 bp, Homo sapiens
ttcatttccccgaaggcgtcgcggcctgaggagacccgttgggtcctcagcgtcttggcggcagttggtggaaccggagcttcgagtccgtccccggtgctgcctgcgcgttcacctgagtctcgctggagctcttctcgcccgcccacctcatctcaacccactttccgcggggagcggcgccaagctgggccttcctcggatcaggcgtcccctgaagtcggcacgcccctctgcgtcccccttcggtcccgctaggaccccgtccgggctgccgtcgcctcgtcgctatggcgcccaccatccagacccaggcccagcgggaggatggccacaggtctggagtggtctgccgagtcaagtactgcaatagcctccctgatatccccttcgaccccaagttcatcacctaccccttcgaccagaacaggttcgtccagtacaaagccacttccttggagaaacagcacaaacatgacctcctgactgagccagacctgggggtcaccatcgatctcatcaatcctgacacctaccgcatcgaccccaatgttcttctagatccagctgatgagaaacttttggaagaggagattcaggcccccaccagctccaagagatcccagcagcacgcgaaggtggtgccatggatgcgaaagacagagtacatctccactgagttcaaccgttatggcatctccaatgagaagcctgaggtcaagattggggtttctgtgaagcagcagtttaccgaggaagaaatatacaaagacagggatagccagatcacagccattgagaagacttttgaggatgcccagaaatcaatctcacagcattacagcaaaccccgagtcacaccggtggaggtcatgcctgtcttcccagactttaagatgtggatcaatccatgtgctcaggtgatctttgactcagacccagcccccaaggacacgagtggtgcagctgcgttggagatgatgtctcaggccatgattaggggcatgatggatgaggaagggaaccagtttgtggcctatttcctgcctgtagaagagacgttgaagaaacgaaagcgggaccaggaggaggagatggactatgcaccagatgatgtgtatgactacaaaattgctcgggagtacaactggaacgtgaagaacaaagctagcaagggctatgaggaaaactacttcttcatcttccgagagggtgacggggtttactacaatgagttggaaaccagggtccgccttagtaagcgccgggccaaggctggggttcagtcaggcaccaacgccctgcttgtggtcaaacatcgggacatgaatgagaaggaactggaagctcaggaggcacggaaggcccagctagaaaaccacgaaccggaggaggaagaggaagaggagatggagacagaagagaaagaagctgggggctcagtgatgctgattctgaggacgatgccgactctgatgatgaggacagaggacaggcccaaggtggcagtgacaatgattcagacagcggcagcaatgggggtggccagcggagccggagccacagccgcagcgccagtcccttccccagtggcagcgagcactcggcccaggaggatggcagtgaagctgcagcttctgattccagtgaagctgatagtgacagtgactgagtcccagggcattcagggctggttcagacaccattattgtgagcagcaaagcacttttctagtggtctgtttgtgagcctttcacttgtttgttccccacccccaaacctttgctgttaataaagtcaacttctcttt

SEQ ID NO: 2976 - DNA, 2127 bp, Homo sapiens
ctgagtctcgctggagctcttctcgcccgcccacctcatctcaacccactttccgcggggagcggcgccaagctgggccttcctcggatcaggcgtcccctgaagtcggcacgcccctctgcgtcccccttcggtcccgctaggaccccgtccgggctgccgtcgcctcgtcgctatggcgcccaccatccagacccaggcccagcgggaggatggccacaggcccaattcccaccggactctgcctgagaggtctggagtggtctgccgagtcaagtactgcaatagcctccctgatatccccttcgaccccaagttcatcacctaccccttcgaccagaacaggttcgtccagtacaaagccacttccttggagaaacagcacaaacatgacctcctgactgagccagacctgggggtcaccatcgatctcatcaatcctgacacctaccgcatcgaccccaatgttcttctagatccagctgatgagaaacttttggaagaggagattcaggcccccaccagctccaagagatcccagcagcacgcgaaggtggtgccatggatgcgaaagacagagtacatctccactgagttcaaccgttatggcatctccaatgagaagcctgaggtcaagattggggtttctgtgaagcagcagtttaccgaggaagaaatatacaaagacagggatagccagatcacagccattgagaagacttttgaggatgcccagaaatcaatctcacagcattacagcaaaccccgagtcacaccggtggaggtcatgcctgtcttcccagactttaagatgtggatcaatccatgtgctcaggtgatctttgactcagacccagcccccaaggacacgagtggtgcagctgcgttggagatgatgtctcaggccatgattaggggcatgatggatgaggaagggaaccagtttgtggcctatttcctgcctgtagaagagacgttgaagaaacgaaagcgggaccaggaggaggagatggactatgcaccagatgatgtgtatgactacaaaattgctcgggagtacaactggaacgtgaagaacaaagctagcaagggctatgaggaaaactacttcttcatcttccgagagggtgacggggtttactacaatgagttggaaaccagggtccgccttagtaagcgccgggccaaggctggggttcagtcaggcaccaacgccctgcttgtggtcaaacatcgggacatgaatgagaaggaactggaagctcaggaggcacggaaggcccagctagaaaaccacgaaccggaggaggaagaggaagaggagatggagacagaagagaaagaagctgggggctcagatgaggagcaggagaagggcagcagcagtgagaaggagggcagtgaagatgagcactcgggcagcgagagtgaacgggaggaaggtgacagggacgaggccagtgacaagagtggcagtggtgaggacgagagcagcgaggatgaggcccgggctgcccgtgacaaagaggagatctttggcagtgatgctgattctgaggacgatgccgactctgatgatgaggacagaggacaggcccaaggtggcagtgacaatgattcagacagcggcagcaatgggggtggccagcggagccggagccacagccgcagcgccagtcccttccccagtggcagcgagcactcggcccaggaggatggcagtgaagctgcagcttctgattccagtgaagctgatagtgacagtgactgagtcccagggcattcagggctggttcagacaccattattgtgagcagcaaagcacttttctagtggtctgtttgtgagcctttcacttgtttgttccccacccccaaacctttgctgttaataaagtcaacttctctttacttcccctcccagcccctatgatgtcattcagcccagcacatacctcccgcaacccccaggtgctcaaggatcttggcttgaggcttagaaacacaggccagaggcagggccaatggtttcccacaaaatgtagcacaacgaaggtcagaattcgttttttttgtttgttttttttttttccaaaataagcccagaccattaaacaagtgaaactcc

SEQ ID NO: 2977 - DNA, 1631 bp, Homo sapiens
agcgtcttggcggcagttggtggaaccggagcttcgagtccgtccccggtgctgcctgcgcgttcacctgagtctcgctggagctcttctcgcccgcccacctcatctcaacccactttccgcggggagcggcgccaagctgggccttcctcggatcaggcgtcccctgaagtcggcacgcccctctgcgtcccccttcggtcccgctaggaccccgtccgggctgccgtcgcctcgtcgctatggcgcccaccatccagacccaggcccagcgggaggatggccacaggtctggagtggtctgccgagtcaagtactgcaatagcctccctgatatccccttcgaccccaagttcatcacctaccccttcgaccagaacaggttcgtccagtacaaagccacttccttggagaaacagcacaaacatgacctcctgactgagccagacctgggggtcaccatcgatctcatcaatcctgacacctaccgcatcgaccccaatgttcttctagatccagctgatgagaaacttttggaagaggagattcaggcccccaccagctccaagagatcccagcagcacgcgaaggtggtgccatggatgcgaaagacagagtacatctccactgagttcaaccgttatggcatctccaatgagaagcctgaggtcaagattggggtttctgtgaagcagcagtttaccgaggaagaaatatacaaagacagggatagccagatcacagccattgagaagacttttgaggatgcccagaaatcaatgtggatcaatccatgtgctcaggtgatctttgactcagacccagcccccaaggacacgagtggtgcagctgcgttggagatgatgtctcaggccatgattaggggcatgatggatgaggaagggaaccagtttgtggcctatttcctgcctgtagaagagacgttgaagaaacgaaagcgggaccaggaggaggagatggactatgcaccagatgatgtgtatgactacaaaattgctcgggagtacaactggaacgtgaagaacaaagctagcaagggctatgaggaaaactacttcttcatcttccgagagggtgacggggtttactacaatgagttggaaaccagggtccgccttagtaagcgccgggccaaggctggggttcagtcaggcaccaacgccctgcttgtggtcaaacatcgggacatgaatgagaaggaactggaagctcaggaggcacggaaggcccagctagaaaaccacgaaccggaggaggaagaggaagaggagatggagacagaagagaaagaagctgggggctcagtgatgctgattctgaggacgatgccgactctgatgatgaggacagaggacaggcccaaggtggcagtgacaatgattcagacagcggcagcaatgggggtggccagcggagccggagccacagccgcagcgccagtcccttccccagtggcagcgagcactcggcccaggaggatggcagtgaagctgcagcttctgattccagtgaagctgatagtgacagtgactgagtcccagggcattcagggctggttcagacaccattattgtgagcagcaaagcacttttctagtggtctgtttgtga

SEQ ID NO: 2978 - DNA, 1387 bp, Homo sapiens
gttgggtcctcagcgtcttggcggcagttggtggaaccggagcttcgagtccgtccccggtgctgcctgcgcgttcacctgagtctcgctggagctcttctcgcccgcccacctcatctcaacccactttccgcggggagcggcgccaagctgggccttcctcggatcaggcgtcccctgaagtcggcacgcccctctgcgtcccccttcggtcccgctaggaccccgtccgggctgccgtcgcctcgtcgctatggcgcccaccatccagacccaggcccagcgggaggatggccacaggcccaattcccaccggactctgcctgagaggtctggagtggtctgccgagtcaagtactgcaatagcctccctgatatccccttcgaccccaagttcatcacctaccccttcgaccagaacagttcttctagatccagctgatgagaaacttttggaagaggagattcaggcccccaccagctccaagagatcccagcagcacgcgaaggtggtgccatggatgcgaaagacagagtacatctccactgagttcaaccgttatggcatctccaatgagaagcctgaggtcaagattggggtttctgtgaagcagcagtttaccgaggaagaaatatacaaagacagggatagccagatcacagccattgagaagacttttgaggatgcccagaaatcaatctcacagcattacagcaaaccccgagtcacaccggtggaggtcatgcctgtcttcccagactttaagatgtggatcaatccatgtgctcaggtgatctttgactcagacccagcccccaaggacacgagtggtgcagctgcgttggagatgatgtctcaggccatgattaggggcatgatggatgaggaagggaaccagtttgtggcctatttcctgcctgtagaagagacgttgaagaaacgaaagcgggaccaggaggaggagatggactatgcaccagatgatgtgtatgactacaaaattgctcgggagtacaactggaacgtgaagaacaaagctagcaagggctatgaggaaaactacttcttcatcttccgagagggtgacggggtttactacaatgagttggaaaccagtattcagtacagtcacatgctgtacaaccttgtagcctaggagcaataggctacaccattacagcctagggtccgccttagtaagcgccgggccaaggctggggttcagtcaggcaccaacgccctgcttgtggtcaaacatcgggacatgaatgagaaggaactggaagctcaggaggcacggaaggcccagctagaaaaccacgaaccggaggaggaagaggaagaggagatggagacagaagagaaagaagctgggggctcaggtaa

SEQ ID NO: 2979 - DNA, 8536 bp, Homo sapiens
aaaaaaaagaaaaaaaaaggcacaaaaaagtggaaacttttccctgtccattccatcaagtcctgaaaaatcaaaatggatttagagaaaaattatccgactcctcggaccagcaggacaggacatggaggagtgaatcagcttgggggggtttttgtgaatggacggccactcccggatgtagtccgccagaggatagtggaacttgctcatcaaggtgtcaggccctgcgacatctccaggcagcttcgggtcagccatggttgtgtcagcaaaattcttggcaggtattatgagacaggaagcatcaagcctggggtaattggaggatccaaaccaaaggtcgccacacccaaagtggtggaaaaaatcgctgaatataaacgccaaaatcccaccatgtttgcctgggagatcagggaccggctgctggcagagcgggtgtgtgacaatgacaccgtgcctagcgtcagttccatcaacaggatcatccggacaaaagtacagcagccacccaaccaaccagtcccagcttccagtcacagcatagtgtccactggctccgtgacgcaggtgtcctcggtgagcacggattcggccggctcgtcgtactccatcagcggcatcctgggcatcacgtcccccagcgccgacaccaacaagcgcaagagagacgaaggtattcaggagtctccggtgccgaacggccactcgcttccgggcagagacttcctccggaagcagatgcggggagacttgttcacacagcagcagctggaggtgctggaccgcgtgtttgagaggcagcactactcagacatcttcaccaccacagagcccatcaagcccgagcagaccacagagtattcagccatggcctcgctggctggtgggctggacgacatgaaggccaatctggccagccccacccctgctgacatcgggagcagtgtgccaggcccgcagtcctaccccattgtgacaggccgtgacttggcgagcacgaccctccccgggtaccctccacacgtcccccccgctggacagggcagctactcagcaccgacgctgacagggatggtgcctgggagtgagttttccgggagtccctacagccaccctcagtattcctcgtacaacgactcctggaggttccccaacccggggctgcttggctccccctactattatagcgctgccgcccgaggagccgccccacctgcagccgccactgcctatgaccgtcactgacccttggagccaggcgggcaccaaacactgatggcacctattgagggtgacagccacccagccctcctgaagatagccagagagcccatgagaccgtcccccagcatcccccacttgcctgaagctcccctcttcctctcttcctccagggactctggggccctttggtggggccgttggacttctggatgcttgtctatttctaaaagccaatctatgagcttctcccgatggccactgggtctctgcaaaccaatagactgtcctgcaaataaccgcagccccagcccagcctgcctgtcctccagctgtctgactatccatccatcataaccaccccagcctgggaaggagagcttgcttttgttgcttcagcagcacccatgtaaataccttcttgcttttctgtgggcctgaaggtccgactgagaagactgctccacccatgatgcatctcgcactcttggtgcatcaccggacatcttagacctatggcagagcatcctctctgccctgggtgaccctggcaggtgcgctcagagctgtcctcaagatggaggatgctgcccttgggccccagcctcctgctcatccctccttctttagtatctttacgaggagtctcactgggctggttgtgctgcaggctccccctgaggcccctctccaagaggagcacactttggggagatgtcctggtttcctgcctccatttctctgggaccgatgcagtatcagcagctcttttccagatcaaagaactcaaagaaaactgtctgggagattcctcagctacttttccgaagcagaatgtcatccgaggtattgattacattgtggactttgaatgtgagggctggatgggacgcaggagatcatctgatcccagccaaggaggggcctgaggctctccctactccctcagcccctggaacggtgttttctgaggcatgcccaggttcaggtcacttcggacacctgccatggacacttcacccaccctccaggaccccagcaagtggattctgggcaagcctgttccggtgatgtagacaataattaacacagaggactttcccccacacccagatcacaaacagcctacagccagaacttctgagcatcctctcggggcagaccctccccgtcctcgtggagcttagcaggcagctgggcatggaggtgctggggctggggcagatgcctaatttcgcacaatgcatgcccacctgttgatctaaggggccgcgatggtcagggccacggccaagggccacgggaacttggagagggagcttggagaactcactgtgggctagggtggtcagaggaagccagcagggaagatctgggggacagaggaaggcctcctgagggaggggcaggagagcagtgaggagctgctgtgtgacctgggagtgattttgacatgggggtgccaggtgccatcatctctttacctggggccttaattccttgcatagtctctcttgtcaagtcagaacagccaggtagagcccttgtccaaacctgggctgaatgacagtgatgagagggggcttggccttcttaggtgacaatgtcccccatatctgtatgtcaccaggatggcagagagccagggcagagagagactggacttgggatcagcaggccaggcaggtcttgtcctggtcctggccacatgtctttgctgtgggacctcagacaaaaccctgcacctctttgagccttggctgccttggtgcagcagggtcatctgtagggccaccccacagctctttccttcccctcctctctccagggagccggggctgtgagaggatcatctggggcaggccctccacttccaagcaagcagatgggggtgggcacctgaggcccaataatatttggaccaagtgggaaacaagaacactcggaggggcgggaatcagaagagcctggaaaaagacctagcccaacttcccttgtgggaaactgaggcccagcttggggaaggccaggaccatgcagggagaaaaagcagacttcctctggccaccgctaagtattttgttccctaagtcccccacagggtggtggaacagaagagaaaactaaggctcagcaaggtggagtcctcaagcagtgactggtgggggtggggctgggactcgggctcctgacccccaacccatggtgttccctgtcaccctggtctatccacatctcctattcctgaggagagttgacagtaagagcagtgagagatggttctgggccccatgccctagacaatcagtctgtaagaactgccaaggaagcctggtcacccaggccagggatggagcccagcgagctcacagcaggcacatgcacccccgcccccacccagaacctgcggggcaaagaagggaggtagttggggccagagtccacctccaggagccagggtgagctggctgcagcttccacctgtcaggtaaggtaggagaaggtatgttacctggcatctctctccctgcctccctccatttagcaggaagtggtggggtcaggggtcttcagcacagacttcttgagcctctgccccctgtcacccttcttttggaatgatgtgtacccacatctttggatcctgccctccttgtggttccaggctgttgggaggaggtcagcctcccctgaaccagctgcctgaggcatgcagcatccttcctcggcaaagcccacctggctcacagcggccccctctccccatcctgttcctcttcttgccctgtaatgagctccccccatacctttcctccctcacctgaggctttgctggtcctcagattggttttgtatttgtgagacaaccacttgactcctgggctgccaggcggaagcacaagcgcacatggatgcacacggatgttctcacacacacacgcccgctctcaccaattcacagcacctcgtggtccagcggagctgcctgggagcttggtgaggatggctccaaaggacacaagccgttgagtagatgccagagaattctgaatggaaaacacaagtccggggcctcaccagcatcgtggcagaaggcctggggcatttctccatgggccttcttccctgtgttcgagctctgacttttggaaaaggacattgtggattttatgaaaatttctcataccatcagtctagctccaacctagaaaaattggatgatatatcaaacccaacatccctttcccaaggcaccttagttaaggctagcccttccataactgacattgtacggtgctttgcaatcctcaaccactctgtggagcaaagagcatgatgcctactttatagacggggaaattgacatttggggctctcacggcaacatagaggcgaagtgaattctcagatctccaggccccattctctctccaccgagttgtgctcctgtcatgggagtgtatggcttaaagacactcccccacccccattccctagaaatcccccagacccacaatcaggcaagaaagaacagggacccagaggctggcctgacctaggggcctgcaggttggcggctttgtttcctaagaacattgaaacctgcggagtctttgaccaaatccacaacagtgcttctgaggtttcatccagactctttcccagctgtccctgaggttcagagggtatcagagtcaattcaaggccatgccataatccctgaccaggcctggacatgggtccagccctgactccaggggtccaggtgccaaggtcatgtgctgtcccccacttccctttctttgccttcgcactttggaacaggctccaggcctggctgtgacagtatgcaggagtgcccaagccagggccaccagggtgtccacagcccctggaaacacagatcacaatctcaagtcccctgaatgaactgcttcctgggtgaacggggtggtgtagccttgccactcgggcagcgcaccagacagtacggtgcagcagtgcccgagatgcccagaagtgtgcctgcccccctgagtggcattcaagtatgaaaacttgtaaaattttctgtcggcctaaagaaaaatgtccatgggccaaacttgacccactgggcaccagcctgtgagccccaatgcctgtcaattgccccctttctcattcacctcctgtcctttgttgcagatttggaggagatgggagcccagagaggtgagagatgtgcttcagggtgtccagcaaggcaggggtagaaacgggcacgcccagagcctgccactctcccaggcctcatcttgggctcttgcaagtcttgcgctttgaagatggagttgggtggaaggtcagaggcgctggggacgggattggggagctgctgggttttcaggggaggtcagtgctgcttgggcacctttcacatgtgcagggaagagactcagatgtggccacagggcactgaggggtgaaatccatttaccagaagtcacgctccagaacgactgcccagccttggcagccagtggctccagccaccccctcctcatgacattcagccagaattgagctccaagccagggaagcaaatcttaaaaaccaaccaagcaccctgacacagccctagaaacacgatgagtctgaaatacagcttcccaggaggggagtctaagatacagcttcccgggagggtggaaaccaactcctgccccacggccaggccaggcccaggcaggcatgggtggatcccacagggctctgagctagaccggctccacggtggccccactacgaggccagttctgcagtcttggccttgtcacccatcgagaggctgctctgatggttcccagccacacaccagctctcctggggaaactatttctttcgttcttttggcctcggagaggtccgaggcaagtacatttcttaaaaggtaataaaatgcattattggaaagttggacagtcaggccacgactcctagcccacggcgtgccccacctcccagcagccccttcagccccttgcccctgttgccccaaacctcagggttccctcttgcatattcatgggggaaccacagtgctgatgtgtacttccccactgtcagctcggctgcacctcgtgtggcgccaggtcccaagggcctctgcagaggccaggctgtgagccccttgcctgcctgctcccctgatgaggcaacagcttctctgaaatgagctgccggccaggagcaggcaggcaccagcctgtctttccttttctggtaattcctcagcactgaggctccgttcctgggcaccccaggattgaagggaacctcagaatcatgtcactgccattctagagtttcaatccaaggggtcccctttagctcatctccaagatgggtaaacgtagccaccattcagaaagcccagaaattcttgttcccacatcttagacccctgagcaacacaaggagaaaatgcagctgcttacctattaatatctactgagggacaatcagcaaagcctcaaaggagtcgtctcaggtagggtacttggcctgtggcaggagagacagaggcacaaacccacccacccatcagcttccggtggctgatcggggcccagggagggaagcaggtgaaacagcagggtgggggtgacttggcagtcgtgcatctcctccccgactctgaggcctggcaggaggaggccacaccagcctcacctgccctgacccccgccccccaccctgtgaccctgtggctatggccgctggtcgcccttgtccccaaaatcaccatgcctgtggccacgtccctcatcttctccaaaagcatcattaagaacaagtgattttggatgatggatttttgatttacaaacggcgcatttcccttggagtggaacagaaaggaaaccatttaatggcgcccttcttttcaagcatgaatacattttaatgaaactattttattgtatttgaggaaatggagagttgaacattccaaccaatcaatagccaattaattgctataaagctaaaaagaaaataaataaatcctgagtctattttaaacactgcaaaaagttcagagcctcagaatctggccttcccctccataaggtgcacgagcatgtaaacacacacacacacacacacacacacacacacacactcactcactcccctacacctcagacatacttgaaactcagaaacagcactgagtctccccatgccaattcttgcctgctgtcttcgacttgggtcagagaaggtgagcagacccggcagcagcctgtcccggggctcaggaagaggcaggcccatcccctggccccaagcacccagcacaacagagggtggcgggcagtgagggcctggcgttgcctgggccccacttctcagccccagctgctgggcctccaaggttgggctgaggatggagttttggctctgggtttgccctgactcctgctggaagacgctgccctggtttttcaccctctagtggccttggacattgagtatttgtagaaatgcagattacattgcaaatggaaacctttgccaggaagacacatgcattttgcttttaattctttgagacatttgattttgtcttagggactgacctttcagcatcaaagaaatacatatctactgtatccgccaaagtttgtgatgcctgcatagacgcttacttgtaaaaaaaaaaaaatacaaaaaaatacaaaaaaaccaacaacaaaaaccacaattgaattgcctttgaaagtgggagatgatctgtctccaacggattgaaaaaaaaaaatgcttcttaaaaaatgtgtatgttttgtattctttttttctagtagaaaataactgacttgaaatattggtggtttttttcttagtgacgtgtgttgcttttgtgtgtaataatatttgaatgtaattacagcagtgccaatttgccaaagatgttggacatatttttcttttttggggaggagggcagggctaggggtgggacttgggagaaaacaggggtggggttttggtttaattttttttttacttttttttccttgtcaaacctgaaatttgtggcttccttttaagttaaatggttgactgcaacacctttattttagattagttggagaaacatgcaataagattggcgtagtttcaatatctgtgtgtcttttcatgagtggctgttacttgtgaagaattgattttatgtaacctttatgtgagataattatttgtaaatatttgccataattttattggttcctaaaataaaagtaattttttaagttca

SEQ ID NO: 2980 - DNA, 1444 bp, Homo sapiens
aaaaatcaaaatggatttagagaaaaattatccgactcctcggaccagcaggacaggacatggaggagtgaatcagcttgggggggtttttgtgaatggacggccactcccggatgtagtccgccagaggatagtggaacttgctcatcaaggtgtcaggccctgcgacatctccaggcagcttcgggtcagccatggttgtgtcagcaaaattcttggcaggtattatgagacaggaagcatcaagcctggggtaattggaggatccaaaccaaaggtcgccacacccaaagtggtggaaaaaatcgctgaatataaacgccaaaatcccaccatgtttgcctgggagatcagggaccggctgctggcagagcgggtgtgtgacaatgacaccgtgcctagcgtcagttccatcaacaggatcatccggacaaaagtacagcagccacccaaccaaccagtcccagcttccagtcacagcatagtgtccactggctccgtgacgcaggtgtcctcggtgagcacggattcggccggctcgtcgtactccatcagcggcatcctgggcatcacgtcccccagcgccgacaccaacaagcgcaagagagacgaaggtattcaggagtctccggtgccgaacggccactcgcttccgggcagagacttcctccggaagcagatgcggggagacttgttcacacagcagcagctggaggtgctggaccgcgtgtttgagaggcagcactactcagacatcttcaccaccacagagcccatcaagcccgagcaggccgtgacttggcgagcacgaccctccccgggtaccctccacacgtcccccccgctggacagggcagctactcagcaccgacgctgacagggatggtgcctgggagtgagttttccgggagtccctacagccaccctcagtattcctcgtacaacgactcctggaggttccccaacccggggctgcttggctccccctactattatagcgctgccgcccgaggagccgccccacctgcagccgccactgcctatgaccgtcactgacccttggagccaggcgggcaccaaacactgatggcacctattgagggtgacagccacccagccctcctgaagatagccagagagcccatgagaccgtcccccagcatcccccacttgcctgaagctcccctcttcctctcttcctccagggactctggggccctttggtggggccgttggacttctggatgcttgtctatttctaaaagccaatctatgagcttctcccgatggccactgggtctctgcaaaccaatagactgtcctgcaaataaccgcagccccagcccagcctgcctgtcctccagctgtctgactatccatccatcataaccaccccagcctgggaaggagagcttgcttttgttgcttcagcagcacccatgta

SEQ ID NO: 2981 - DNA, 996 bp, Homo sapiens
atggatttagagaaaaattatccgactcctcggaccagcaggacaggacatggaggagtgaatcagcttgggggggtttttgtgaatggacggccactcccggatgtagtccgccagaggatagtggaacttgctcatcaaggtgtcaggccctgcgacatctccaggcagcttcgggtcagccatggttgtgtcagcaaaattcttggcaggtattatgagacaggaagcatcaagcctggggtaattggaggatccaaaccaaaggtcgccacacccaaagtggtggaaaaaatcgctgaatataaacgccaaaatcccaccatgtttgcctgggagatcagggaccggctgctggcagagcgggtgtgtgacaatgacaccgtgcctagcgtcagttccatcaacaggatcatccggacaaaagtacagcagccacccaaccaaccagtcccagcttccagtcacagcatagtgtccactggctccgtgacgcaggtgtcctcggtgagcacggattcggccggctcgtcgtactccatcagcggcatcctgggcatcacgtcccccagcgccgacaccaacaagcgcaagagagacgaaggtattcaggagtctccggtgccgaacggccactcgcttccgggcagagacttcctccggaagcagatgcggggagacttgttcacacagcagcagctggaggtgctggaccgcgtgtttgagaggcagcactactcagacatcttcaccaccacagagcccatcaagcccgagcagaccacagagtattcagccatggcctcgctggctggtgggctggacgacatgaaggccaatctggccagccccacccctgctgacatcgggagcagtgtgccaggcccgcagtcctaccccattgtgacaggctccccctactattatagcgctgccgcccgaggagccgccccacctgcagccgccactgcctatgaccgtcactgacccttggag

SEQ ID NO: 2982 - DNA, 3699 bp, Homo sapiens
agcactgctgctctcccggcttcccgctctactccggccgggccgggtccgccacgtctggcgcgctgagcaggcccggccgcgcagcgcctaccctttcctcgctccgggccggcagtgtggggcggcgcgctgggggcgcggcgtgtctggggacatcttgtgatgttggcgagaacaggacatgatctcacatggcgagaagctctttagttccttaatcatttcacggtgccttcggacgctttttttccacctaaaacgtttagtttcagctcagtgatcagctaccccagctcggcgggggagcggaaggcttgaattattccgacctgtgagcggcccctggcaccaaaaaaaaaaaaaaaaaaaaaaaaaaaagaaaaaaaaaggcacaaaaaagtggaaacttttccctgtccattccatcaagtcctgaaaaatcaaaatggatttagagaaaaattatccgactcctcggaccagcaggacaggacatggaggagtgaatcagcttgggggggtttttgtgaatggacggccactcccggatgtagtccgccagaggatagtggaacttgctcatcaaggtgtcaggccctgcgacatctccaggcagcttcgggtcagccatggttgtgtcagcaaaattcttggcaggtattatgagacaggaagcatcaagcctggggtaattggaggatccaaaccaaaggtcgccacacccaaagtggtggaaaaaatcgctgaatataaacgccaaaatcccaccatgtttgcctgggagatcagggaccggctgctggcagagcgggtgtgtgacaatgacaccgtgcctagcgtcagttccatcaacaggatcatccggacaaaagtacagcagccacccaaccaaccagtcccagcttccagtcacagcatagtgtccactggctccgtgacgcaggtgtcctcggtgagcacggattcggccggctcgtcgtactccatcagcggcatcctgggcatcacgtcccccagcgccgacaccaacaagcgcaagagagacgaaggtattcaggagtctccggtgccgaacggccactcgcttccgggcagagacttcctccggaagcagatgcggggagacttgttcacacagcagcagctggaggtgctggaccgcgtgtttgagaggcagcactactcagacatcttcaccaccacagagcccatcaagcccgagcagtggtgccccgtgctgatgagacaatacttggtgcagccccaggcagtccttttccagaccacagagtattcagccatggcctcgctggctggtgggctggacgacatgaaggccaatctggccagccccacccctgctgacatcgggagcagtgtgccaggcccgcagtcctaccccattgtgacaggccgtgacttggcgagcacgaccctccccgggtaccctccacacgtcccccccgctggacagggcagctactcagcaccgacgctgacagggatggtgcctgggagtgagttttccgggagtccctacagccaccctcagtattcctcgtacaacgactcctggaggttccccaacccggggctgcttggctccccctactattatagcgctgccgcccgaggagccgccccacctgcagccgccactgcctatgaccgtcactgacccttggagccaggcgggcaccaaacactgatggcacctattgagggtgacagccacccagccctcctgaagatagccagagagcccatgagaccgtcccccagcatcccccacttgcctgaagctcccctcttcctctcttcctccagggactctggggccctttggtggggccgttggacttctggatgcttgtctatttctaaaagccaatctatgagcttctcccgatggccactgggtctctgcaaaccaatagactgtcctgcaaataaccgcagccccagcccagcctgcctgtcctccagctgtctgactatccatccatcataaccaccccagcctgggaaggagagcttgcttttgttgcttcagcagcacccatgtaaataccttcttgcttttctgtgggcctgaaggtccgactgagaagactgctccacccatgatgcatctcgcactcttggtgcatcaccggacatcttagacctatggcagagcatcctctctgccctgggtgaccctggcaggtgcgctcagagctgtcctcaagatggaggatgctgcccttgggccccagcctcctgctcatccctccttctttagtatctttacgaggagtctcactgggctggttgtgctgcaggctccccctgaggcccctctccaagaggagcacactttggggagatgtcctggtttcctgcctccatttctctgggaccgatgcagtatcagcagctcttttccagatcaaagaactcaaagaaaactgtctgggagattcctcagctacttttccgaagcagaatgtcatccgaggtattgattacattgtggactttgaatgtgagggctggatgggacgcaggagatcatctgatcccagccaaggaggggcctgaggctctccctactccctcagcccctggaacggtgttttctgaggcatgcccaggttcaggtcacttcggacacctgccatggacacttcacccaccctccaggaccccagcaagtggattctgggcaagcctgttccggtgatgtagacaataattaacacagaggactttcccccacacccagatcacaaacagcctacagccagaacttctgagcatcctctcggggcagaccctccccgtcctcgtggagcttagcaggcagctgggcatggaggtgctggggctggggcagatgcctaatttcgcacaatgcatgcccacctgttgatctaaggggccgcgatggtcagggccacggccaagggccacgggaacttggagagggagcttggagaactcactgtgggctagggtggtcagaggaagccagcagggaagatctgggggacagaggaaggcctcctgagggaggggcaggagagcagtgaggagctgctgtgtgacctgggagtgattttgacatgggggtgccaggtgccatcatctctttacctggggccttaattccttgcatagtctctcttgtcaagtcagaacagccaggtagagcccttgtccaaacctgggctgaatgacagtgatgagagggggcttggccttcttaggtgacaatgtcccccatatctgtatgtcaccaggatggcagagagccagggcagagagagactggacttgggatcagcaggccaggcaggtcttgtcctggtcctggccacatgtctttgctgtgggacctcagacaaaaccctgcacctctttgagccttggctgccttggtgcagcagggtcatctgtagggccaccccacagctctttccttcccctcctctctccagggagccggggctgtgagaggatcatctggggcaggccctccacttccaagcaagcagatgggggtgggcacctgaggcccaataatatttggaccaagtgggaaacaagaacactcggaggggcgggaatcagaagagcctggaaaaagacctagcccaacttcccttgtgggaaactgaggcccagcttggggaaggccaggaccatgcaggg

SEQ ID NO: 2983 - DNA, 1472 bp, Homo sapiens
aaaaatcaaaatggatttagagaaaaattatccgactcctcggaccagcaggacaggacatggaggagtgaatcagcttgggggggtttttgtgaatggacggccactcccggatgtagtccgccagaggatagtggaacttgctcatcaaggtgtcaggccctgcgacatctccaggcagcttcgggtcagccatggttgtgtcagcaaaattcttggcaggtattatgagacaggaagcatcaagcctggggtaattggaggatccaaaccaaaggtcgccacacccaaagtggtggaaaaaatcgctgaatataaacgccaaaatcccaccatgtttgcctgggagatcagggaccggctgctggcagagcgggtgtgtgacaatgacaccgtgcctagcgtcagttccatcaacaggatcatccggacaaaagtacagcagccacccaaccaaccagtcccagcttccagtcacagcatagtgtccactggctccgtgacgcaggtgtcctcggtgagcacggattcggccggctcgtcgtactccatcagcggcatcctgggcatcacgtcccccagcgccgacaccaacaagcgcaagagagacgaaggtattcaggagtctccggtgccgaacggccactcgcttccgggcagagacttcctccggaagcagatgcggggagacttgttcacacagcagcagctggaggtgctggaccgcgtgtttgagaggcagcactactcagacatcttcaccaccacagagcccatcaagcccgagcagaccacagagtattcagccatggcctcgctggctggtgggctggacgacatgaaggccaatctggccagccccacccctgctgacatcgggagcagtgtgccaggcccgcagtcctaccccattgtgacagggagtgagttttccgggagtccctacagccaccctcagtattcctcgtacaacgactcctggaggttccccaacccggggctgcttggctccccctactattatagcgctgccgcccgaggagccgccccacctgcagccgccactgcctatgaccgtcactgacccttggagccaggcgggcaccaaacactgatggcacctattgagggtgacagccacccagccctcctgaagatagccagagagcccatgagaccgtcccccagcatcccccacttgcctgaagctcccctcttcctctcttcctccagggactctggggccctttggtggggccgttggacttctggatgcttgtctatttctaaaagccaatctatgagcttctcccgatggccactgggtctctgcaaaccaatagactgtcctgcaaataaccgcagccccagcccagcctgcctgtcctccagctgtctgactatccatccatcataaccaccccagcctgggaaggagagcttgcttttgttgcttcagcagcacccatgta

SEQ ID NO: 2984 - DNA, 1487 bp, Homo sapiens
aaaaatcaaaatggatttagagaaaaattatccgactcctcggaccagcaggacaggacatggaggagtgaatcagcttgggggggtttttgtgaatggacggccactcccggatgtagtccgccagaggatagtggaacttgctcatcaaggtgtcaggccctgcgacatctccaggcagcttcgggtcagccatggttgtgtcagcaaaattcttggcaggtattatgagacaggaagcatcaagcctggggtaattggaggatccaaaccaaaggtcgccacacccaaagtggtggaaaaaatcgctgaatataaacgccaaaatcccaccatgtttgcctgggagatcagggaccggctgctggcagagcgggtgtgtgacaatgacaccgtgcctagcgtcagttccatcaacaggatcatccggacaaaagtacagcagccacccaaccaaccagtcccagcttccagtcacagcatagtgtccactggctccgtgacgcaggtgtcctcggtgagcacggattcggccggctcgtcgtactccatcagcggcatcctgggcatcacgtcccccagcgccgacaccaacaagcgcaagagagacgaaggtattcaggagtctccggtgccgaacggccactcgcttccgggcagagacttcctccggaagcagatgcggggagacttgttcacacagcagcagctggaggtgctggaccgcgtgtttgagaggcagcactactcagacatcttcaccaccacagagcccatcaagcccgagcagaccacagagtattcagccatggcctcgctggctggtgggctggacgacatgaaggccaatctggccagccccacccctgctgacatcgggagcagtgtgccaggcccgcagtcctaccccattgtgacaggccgtgacttggcgagcacgaccctccccgggtaccctccacacgtcccccccgctggacagggcagctactcagcaccgacgctgacagggatggtgcctggctccccctactattatagcgctgccgcccgaggagccgccccacctgcagccgccactgcctatgaccgtcactgacccttggagccaggcgggcaccaaacactgatggcacctattgagggtgacagccacccagccctcctgaagatagccagagagcccatgagaccgtcccccagcatcccccacttgcctgaagctcccctcttcctctcttcctccagggactctggggccctttggtggggccgttggacttctggatgcttgtctatttctaaaagccaatctatgagcttctcccgatggccactgggtctctgcaaaccaatagactgtcctgcaaataaccgcagccccagcccagcctgcctgtcctccagctgtctgactatccatccatcataaccaccccagcctgggaaggagagcttgcttttgttgcttcagcagcacccatgta

SEQ ID NO: 2985 - DNA, 1056 bp, Homo sapiens
atggatttagagaaaaattatccgactcctcggaccagcaggacaggacatggaggagtgaatcagcttgggggggtttttgtgaatggacggccactcccggatgtagtccgccagaggatagtggaacttgctcatcaaggtgtcaggccctgcgacatctccaggcagcttcgggtcagccatggttgtgtcagcaaaattcttggcaggtattatgagacaggaagcatcaagcctggggtaattggaggatccaaaccaaaggtcgccacacccaaagtggtggaaaaaatcgctgaatataaacgccaaaatcccaccatgtttgcctgggagatcagggaccggctgctggcagagcgggtgtgtgacaatgacaccgtgcctagcgtcagttccatcaacaggatcatccggacaaaagtacagcagccacccaaccaaccagtcccagcttccagtcacagcataggtattcaggagtctccggtgccgaacggccactcgcttccgggcagagacttcctccggaagcagatgcggggagacttgttcacacagcagcagctggaggtgctggaccgcgtgtttgagaggcagcactactcagacatcttcaccaccacagagcccatcaagcccgagcagaccacagagtattcagccatggcctcgctggctggtgggctggacgacatgaaggccaatctggccagccccacccctgctgacatcgggagcagtgtgccaggcccgcagtcctaccccattgtgacaggccgtgacttggcgagcacgaccctccccgggtaccctccacacgtcccccccgctggacagggcagctactcagcaccgacgctgacagggatggtgcctgggagtgagttttccgggagtccctacagccaccctcagtattcctcgtacaacgactcctggaggttccccaacccggggctgcttggctccccctactattatagcgctgccgcccgaggagccgccccacctgcagccgccactgcctatgaccgtcactgacccttggag

SEQ ID NO: 2986 - DNA, 885 bp, Homo sapiens
atggatttagagaaaaattatccgactcctcggaccagcaggacaggacatggaggagtgaatcagcttgggggggtttttgtgaatggacggccactcccggatgtagtccgccagaggatagtggaacttgctcatcaaggtgtcaggccctgcgacatctccaggcagcttcgggtcagccatggttgtgtcagcaaaattcttggcaggatcatccggacaaaagtacagcagccacccaaccaaccagtcccagcttccagtcacagcatagtgtccactggctccgtgacgcaggtgtcctcggtgagcacggattcggccggctcgtcgtactccatcagcggcatcctgggcatcacgtcccccagcgccgacaccaacaagcgcaagagagacgaaggtattcaggagtctccggtgccgaacggccactcgcttccgggcagagacttcctccggaagcagatgcggggagacttgttcacacagcagcagctggaggtgctggaccgcgtgtttgagaggcagcactactcagacatcttcaccaccacagagcccatcaagcccgagcagaccacagagtattcagccatggcctcgctggctggtgggctggacgacatgaaggccaatctggccagccccacccctgctgacatcgggagcagtgtgccaggcccgcagtcctaccccattgtgacagggagtgagttttccgggagtccctacagccaccctcagtattcctcgtacaacgactcctggaggttccccaacccggggctgcttggctccccctactattatagcgctgccgcccgaggagccgccccacctgcagccgccactgcctatgaccgtcactgacccttggag

SEQ ID NO: 2987 - DNA, 969 bp, Homo sapiens
atggatttagagaaaaattatccgactcctcggaccagcaggacaggacatggaggagtgaatcagcttgggggggtttttgtgaatggacggccactcccggatgtagtccgccagaggatagtggaacttgctcatcaaggtgtcaggccctgcgacatctccaggcagcttcgggtcagccatggttgtgtcagcaaaattcttggcaggtattatgagacaggaagcatcaagcctggggtaattggaggatccaaaccaaaggtcgccacacccaaagtggtggaaaaaatcgctgaatataaacgccaaaatcccaccatgtttgcctgggagatcagggaccggctgctggcagagcgggtgtgtgacaatgacaccgtgcctagcgtcagttccatcaacaggatcatccggacaaaagtacagcagccacccaaccaaccagtcccagcttccagtcacagcataggtattcaggagtctccggtgccgaacggccactcgcttccgggcagagacttcctccggaagcagatgcggggagacttgttcacacagcagcagctggaggtgctggaccgcgtgtttgagaggcagcactactcagacatcttcaccaccacagagcccatcaagcccgagcagaccacagagtattcagccatggcctcgctggctggtgggctggacgacatgaaggccaatctggccagccccacccctgctgacatcgggagcagtgtgccaggcccgcagtcctaccccattgtgacaggccgtgacttggcgagcacgaccctccccgggtaccctccacacgtcccccccgctggacagggcagctactcagcaccgacgctgacagggatggtgcctggctccccctactattatagcgctgccgcccgaggagccgccccacctgcagccgccactgcctatgaccgtcactgacccttggag

SEQ ID NO: 2988 - DNA, 1019 bp, Homo sapiens
atggatttagagaaaaattatccgactcctcggaccagcaggacaggtattatgagacaggaagcatcaagcctggggtaattggaggatccaaaccaaaggtcgccacacccaaagtggtggaaaaaatcgctgaatataaacgccaaaatcccaccatgtttgcctgggagatcagggaccggctgctggcagagcgggtgtgtgacaatgacaccgtgcctagcgtcagttccatcaacaggatcatccggacaaaagtacagcagccacccaaccaaccagtcccagcttccagtcacagcatagtgtccactggctccgtgacgcaggtgtcctcggtgagcacggattcggccggctcgtcgtactccatcagcggcatcctgggcatcacgtcccccagcgccgacaccaacaagcgcaagagagacgaaggtattcaggagtctccggtgccgaacggccactcgcttccgggcagagacttcctccggaagcagatgcggggagacttgttcacacagcagcagctggaggtgctggaccgcgtgtttgagaggcagcactactcagacatcttcaccaccacagagcccatcaagcccgagcagaccacagagtattcagccatggcctcgctggctggtgggctggacgacatgaaggccaatctggccagccccacccctgctgacatcgggagcagtgtgccaggcccgcagtcctaccccattgtgacaggccgtgacttggcgagcacgaccctccccgggtaccctccacacgtcccccccgctggacagggcagctactcagcaccgacgctgacagggatggtgcctgggagtgagttttccgggagtccctacagccaccctcagtattcctcgtacaacgactcctggaggttccccaacccggggctgcttggctccccctactattatagcgctgccgcccgaggagccgccccacctgcagccgccactgcctatgaccgtcactgacccttggag

SEQ ID NO: 2989 - DNA, 1112 bp, Homo sapiens
atggatttagagaaaaattatccgactcctcggaccagcaggacaggacatggaggagtgaatcagcttgggggggtttttgtgaatggacggccactcccggatgtagtccgccagaggatagtggaacttgctcatcaaggtgtcaggccctgcgacatctccaggcagcttcgggtcagccatggttgtgtcagcaaaattcttggcaggtattatgagacaggaagcatcaagcctggggtaattggaggatccaaaccaaaggtcgccacacccaaagtggtggaaaaaatcgctgaatataaacgccaaaatcccaccatgtttgcctgggagatcagggaccggctgctggcagagcgggtgtgtgacaatgacaccgtgcctagcgtcagttccatcaacaggatcatccggacaaaagtacagcagccacccaaccaaccagtcccagcttccagtcacagcatagtgtccactggctccgtgacgcaggtgtcctcggtgagcacggattcggccggctcgtcgtactccatcagcggcatcctgggcatcacgtcccccagcgccgacaccaacaagcgcaagagagacgaaggtattcaggagtctccggtgccgaacggccactcgcttccgggcagagacttcctccggaagcagatgcggggagacttgttcacacagcagcagctggaggtgctggaccgcgtgtttgagaggcagcactactcagacatcttcaccaccacagagcccatcaagcccgagcagtggtgccccgtgctgatgagacaatacttggtgcagccccaggcagtccttttccaggccgtgacttggcgagcacgaccctccccgggtaccctccacacgtcccccccgctggacagggcagctactcagcaccgacgctgacagggatggtgcctgggagtgagttttccgggagtccctacagccaccctcagtattcctcgtacaacgactcctggaggttccccaacccggggctgcttggctccccctactattatagcgctgccgcccgaggagccgccccacctgcagccgccactgcctatgaccgtcactgacccttggag

SEQ ID NO: 2990 - DNA, 1197 bp, Homo sapiens
atgcctcacaactccatcagatctggccatggagggctgaaccagctgggaggggcctttgtgaatggcagacctctgccggaagtggtccgccagcgcatcgtagacctggcccaccagggtgtaaggccctgcgacatctctcgccagctccgcgtcagccatggctgcgtcagcaagatccttggcaggtactacgagactggcagcatccggcctggagtgatagggggctccaagcccaaggtggccacccccaaggtggtggagaagattggggactacaaacgccagaaccctaccatgtttgcctgggagatccgagaccggctcctggctgagggcgtctgtgacaatgacactgtgcccagtgtcagctccattaatagaatcatccggaccaaagtgcagcaaccattcaacctccctatggacagctgcgtggccaccaagtccctgagtcccggacacacgctgatccccagctcagctgtaactcccccggagtcaccccagtcggattccctgggctccacctactccatcaatgggctcctgggcatcgctcagcctggcagcgacaagaggaaaatggatgacagtgatcaggatagctgccgactaagcattgactcacagagcagcagcagcggaccccgaaagcaccttcgcacggatgccttcagccagcaccacctcgagccgctcgagtgcccatttgagcggcagcactacccagaggcctatgcctcccccagccacaccaaaggcgagcagggcctctacccgctgcccttgctcaacagcaccctggacgacgggaaggccaccctgaccccttccaacacgccactggggcgcaacctctcgactcaccagacctaccccgtggtggcagctccgcctttttggatctgcagcaagtcggctccggggtcccgcccttcaatgcctttccccatgctgcctccgtgtacgggcagttcacgggccaggccctcctctcagggcgagagatggtggggcccacgctgcccggatacccaccccacatccccaccagcggacagggcagctatgcctcctctgccatcgcaggcatggtggcaggaagtgaatactctggcaatgcctatggccacaccccctactcctcctacagcgaggcctggcgcttccccaactccagcttgctga

SEQ ID NO: 2991 - DNA, 3735 bp, Homo sapiens
ttcagaaggaggagagacaccgggcccagggcaccctcgcgggcggacccaaccagtgagggcctgcagccggccggccagggcagcggcaggcgcggcccggacctacgggaggaagccccgagccctcggcgggctgcgagcgactccccggcgatgcctcacaactccatcagatctggccatggagggctgaaccagctgggaggggcctttgtgaatggcagacctctgccggaagtggtccgccagcgcatcgtagacctggcccaccagggtgtaaggccctgcgacatctctcgccagctccgcgtcagccatggctgcgtcagcaagatccttggcaggtactacgagactggcagcatccggcctggagtgatagggggctccaagcccaaggtggccacccccaaggtggtggagaagattggggactacaaacgccagaaccctaccatgtttgcctgggagatccgagaccggctcctggctgagggcgtctgtgacaatgacactgtgcccagtgtcagctccattaatagaatcatccggaccaaagtgcagcaaccattcaacctccctatggacagctgcgtggccaccaagtccctgagtcccggacacacgctgatccccagctcagctgtaactcccccggagtcaccccagtcggattccctgggctccacctactccatcaatgggctcctgggcatcgctcagcctggcagcgacaagaggaaaatggatgacagtgatcaggatagctgccgactaagcattgactcacagagcagcagcagcggaccccgaaagcaccttcgcacggatgccttcagccagcaccacctcgagccgctcgagtgcccatttgagcggcagcactacccagaggcctatgcctcccccagccacaccaaaggcgagcagggcgagagatggtggggcccacgctgcccggatacccaccccacatccccaccagcggacagggcagctatgcctcctctgccatcgcaggcatggtggcaggaagtgaatactctggcaatgcctatggccacaccccctactcctcctacagcgaggcctggcgcttccccaactccagcttgctgagttccccatattattacagttccacatcaaggccgagtgcaccgcccaccactgccacggcctttgaccatctgtagttgccatggggacagtgggagcgactgagcaacaggaggactcagcctgggacaggccccagagagtcacacaaaggaatctttatttattacatgaaaaataaccacaagtccagcattgcggcacactccctgtgtggttaatttaatgaaccatgaaagacaggatgaccttggacaaggccaaactgtcctccaagactccttaatgaggggcaggagtcccagggaaagagaaccatgccatgctgaaaaagacaaaattgaagaagaaatgtagcccccagccggtacccaccaaaggagagaagaagcaatagccgaggaacttggggggatggcgaatggttcctgcccgggcccaaggggtgcacagggcacctccatggctccattattaacacaactctagcaattatggaccataagcacttccctccagcccacaagtcacagcctggtgccgaggctctcctcaccagccacccagggagtcacctccctcagcctcccgcctgccccacacggaggctctggctgtcctctttctccactccatttgcttggctctttctacacctccctcttgggcatgggctgagggctggagcgagtccctcagaaattccaccaggctgtcagctgacctcttttgcctgctgctgtgaaggtatagcaccaccccaggtcctcctgcagtgcggcatccccttggcagctgccgtcagccaggccagccccagggagcttaaaacagacattccacagggcctgggcccctgggaggtgaggtgtggtgtgcggcttcacccagggcagaacaaggcagaatcgcaggaaacccgcttccccttcctgacagctcctgccaagccaaatgtgcttcctgcagctcacgcccaccagctactgaagggacccaaggcaccccctgaagccagcgatagagggtccctctctgctccccagcagctcctgcccccaaggcctgactgtatatactgtaaatgaaactttgtttgggtcaagcttccttctttctaacccccagactttggcctctgagtgaaatgtctctctttgccctgtggggcttctctccttgatgcttctttctttttttaaagacaacctgccattaccacatgactcaataaaccattgctcttcatctcaggctttggggttggctggggaaggaggcatcccggggctgggctttctcccaagaacatcagagctgagtagccgacaaactcactttggggccgtgggctggaagggaccatctgatgccccagagctctggcttggccttctccctctgcctttaattcacgttgaacgctgggtacctcactcatcccaagttcttcaacactgagcaaatgcaaggatagcacagtactgagccaaccatagactccccacaaggagttgctgttgttattaacaggaagccagagaatcagcagggtgggttagtgagggatccgggaatagctgtgactggagcctgcataaacagctctgaagggagagagaagactgggctctcttgtgtgccaggcacagtatggaaggcttcatataagttaagctgaaattagccctgttttacatacagcttcattttacatatgaggaaactgaggctttgaaaaaaatgagatgtcttgtccaagatgaaaagtagtagattcaaccaagtcctcttactctaagcccaacgcttttacccaaaaccccagagtcctcatcagggatgccaaatggttctagacccagtggaggttctggagctgccactggggatttaatttcttttgatttgctaaagatttgacctgactgaatggagaggtagagtgtagtgtggccaggacaaggtgagggaggctgtagagacttagcactttaggccaaccacctccaggaaatctgggaaatgcaatgtgacagctcgggctctgcactccagggggctgtctggtgtccacatggaccttctccatgtgggacacagctggaacaagggggcaggggcctgcagctgggatgcccaggtgaatatgggcagctggacaaacaacactgggattgagtcagatagaaggggcccaaggactccagggctgggaggacagaggctgggagagagggctcttacctccttaggcctcccaaagagcggttagggatgctgccatggatggcatggcagggggaaccctcctggaagaaaatccatctcttctgaagggatctgagatgcggctggtttttcaatggcagaacttccctctgcagcgcgactccgaatccatgacatctgagagtcttcctgaccacaaacctctgggatcccgagggctccctacccaagaatcactttgagcacagcatcccaaggagcccatagagcgatcccttgcattcacagccacagcccctctggggacactctgtacccccggcagaccctttccaactcacaaccaataaaggggcttgggctgtgctttgactaaggtga

SEQ ID NO: 2992 - DNA, 3966 bp, Homo sapiens
ttcagaaggaggagagacaccgggcccagggcaccctcgcgggcggacccaaccagtgagggcctgcagccggccggccagggcagcggcaggcgcggcccggacctacgggaggaagccccgagccctcggcgggctgcgagcgactccccggcgatgcctcacaactccatcagatctggccatggagggctgaaccagctgggaggggcctttgtgaatggcagacctctgccggaagtggtccgccagcgcatcgtagacctggcccaccagggtgtaaggccctgcgacatctctcgccagctccgcgtcagccatggctgcgtcagcaagatccttggcaggtactacgagactggcagcatccggcctggagtgatagggggctccaagcccaaggtggccacccccaaggtggtggagaagattggggactacaaacgccagaaccctaccatgtttgcctgggagatccgagaccggctcctggctgagggcgtctgtgacaatgacactgtgcccagtgtcagctccattaatagaatcatccggaccaaagtgcagcaaccattcaacctccctatggacagctgcgtggccaccaagtccctgagtcccggacacacgctgatccccagctcagctgtaactcccccggagtcaccccagtcggattccctgggctccacctactccatcaatgggctcctgggcatcgctcagcctggcagcgacaagaggaaaatggatgacagtgatcaggatagctgccgactaagcattgactcacagagcagcagcagcggaccccgaaagcaccttcgcacggatgccttcagccagcaccacctcgagccgctcgagtgcccatttgagcggcagcactacccagaggcctatgcctcccccagccacaccaaaggcgagcagggcctctacccgctgcccttgctcaacagcaccctggacgacgggaaggccaccctgaccccttccaacacgccactggggcgcaacctctcgactcaccagacctaccccgtggtggcagctccgcctttttggatctgcagcaagtcggctccggggtcccgcccttcaatgcctttccccatgctgcctccgtgtacgggcagttcacgggccaggccctcctctcagggcgagagatggtggggcccacgctgcccggatacccaccccacatccccaccagcggacagggcagctatgcctcctctgccatcgcaggcatggtggcaggaagtgaatactctggcaatgcctatggccacaccccctactcctcctacagcgaggcctggcgcttccccaactccagcttgctgagttccccatattattacagttccacatcaaggccgagtgcaccgcccaccactgccacggcctttgaccatctgtagttgccatggggacagtgggagcgactgagcaacaggaggactcagcctgggacaggccccagagagtcacacaaaggaatctttatttattacatgaaaaataaccacaagtccagcattgcggcacactccctgtgtggttaatttaatgaaccatgaaagacaggatgaccttggacaaggccaaactgtcctccaagactccttaatgaggggcaggagtcccagggaaagagaaccatgccatgctgaaaaagacaaaattgaagaagaaatgtagcccccagccggtacccaccaaaggagagaagaagcaatagccgaggaacttggggggatggcgaatggttcctgcccgggcccaaggggtgcacagggcacctccatggctccattattaacacaactctagcaattatggaccataagcacttccctccagcccacaagtcacagcctggtgccgaggctctcctcaccagccacccagggagtcacctccctcagcctcccgcctgccccacacggaggctctggctgtcctctttctccactccatttgcttggctctttctacacctccctcttgggcatgggctgagggctggagcgagtccctcagaaattccaccaggctgtcagctgacctcttttgcctgctgctgtgaaggtatagcaccaccccaggtcctcctgcagtgcggcatccccttggcagctgccgtcagccaggccagccccagggagcttaaaacagacattccacagggcctgggcccctgggaggtgaggtgtggtgtgcggcttcacccagggcagaacaaggcagaatcgcaggaaacccgcttccccttcctgacagctcctgccaagccaaatgtgcttcctgcagctcacgcccaccagctactgaagggacccaaggcaccccctgaagccagcgatagagggtccctctctgctccccagcagctcctgcccccaaggcctgactgtatatactgtaaatgaaactttgtttgggtcaagcttccttctttctaacccccagactttggcctctgagtgaaatgtctctctttgccctgtggggcttctctccttgatgcttctttctttttttaaagacaacctgccattaccacatgactcaataaaccattgctcttcatctcaggctttggggttggctggggaaggaggcatcccggggctgggctttctcccaagaacatcagagctgagtagccgacaaactcactttggggccgtgggctggaagggaccatctgatgccccagagctctggcttggccttctccctctgcctttaattcacgttgaacgctgggtacctcactcatcccaagttcttcaacactgagcaaatgcaaggatagcacagtactgagccaaccatagactccccacaaggagttgctgttgttattaacaggaagccagagaatcagcagggtgggttagtgagggatccgggaatagctgtgactggagcctgcataaacagctctgaagggagagagaagactgggctctcttgtgtgccaggcacagtatggaaggcttcatataagttaagctgaaattagccctgttttacatacagcttcattttacatatgaggaaactgaggctttgaaaaaaatgagatgtcttgtccaagatgaaaagtagtagattcaaccaagtcctcttactctaagcccaacgcttttacccaaaaccccagagtcctcatcagggatgccaaatggttctagacccagtggaggttctggagctgccactggggatttaatttcttttgatttgctaaagatttgacctgactgaatggagaggtagagtgtagtgtggccaggacaaggtgagggaggctgtagagacttagcactttaggccaaccacctccaggaaatctgggaaatgcaatgtgacagctcgggctctgcactccagggggctgtctggtgtccacatggaccttctccatgtgggacacagctggaacaagggggcaggggcctgcagctgggatgcccaggtgaatatgggcagctggacaaacaacactgggattgagtcagatagaaggggcccaaggactccagggctgggaggacagaggctgggagagagggctcttacctccttaggcctcccaaagagcggttagggatgctgccatggatggcatggcagggggaaccctcctggaagaaaatccatctcttctgaagggatctgagatgcggctggtttttcaatggcagaacttccctctgcagcgcgactccgaatccatgacatctgagagtcttcctgaccacaaacctctgggatcccgagggctccctacccaagaatcactttgagcacagcatcccaaggagcccatagagcgatcccttgcattcacagccacagcccctctggggacactctgtacccccggcagaccctttccaactcacaaccaataaaggggcttgggctgtgctttgactaaggtga

SEQ ID NO: 2993 - DNA, 3633 bp, Homo sapiens
ttcagaaggaggagagacaccgggcccagggcaccctcgcgggcggacccaaccagtgagggcctgcagccggccggccagggcagcggcaggcgcggcccggacctacgggaggaagccccgagccctcggcgggctgcgagcgactccccggcgatgcctcacaactccatcagatctggccatggagggctgaaccagctgggaggggcctttgtgaatggcagacctctgccggaagtggtccgccagcgcatcgtagacctggcccaccagggtgtaaggccctgcgacatctctcgccagctccgcgtcagccatggctgcgtcagcaagatccttggcaggtactacgagactggcagcatccggcctggagtgatagggggctccaagcccaaggtggccacccccaaggtggtggagaagattggggactacaaacgccagaaccctaccatgtttgcctgggagatccgagaccggctcctggctgagggcgtctgtgacaatgacactgtgcccagtgtcagctccattaatagaatcatccggaccaaagtgcagcaaccattcaacctccctatggacagctgcgtggccaccaagtccctgagtcccggacacacgctgatccccagctcagctgtaactcccccggagtcaccccagtcggattccctgggctccacctactccatcaatgggctcctgggcatcgctcagcctggcagcgacaagaggaaaatggatgacagtgatcaggatagctgccgactaagcattgactcacagagcagcagcagcggaccccgaaagcaccttcgcacggatgccttcagccagcaccacctcgagccgctcgagtgcccatttgagcggcagcactacccagaggcctatgcctcccccagccacaccaaaggcgagcaggaagtgaatactctggcaatgcctatggccacaccccctactcctcctacagcgaggcctggcgcttccccaactccagcttgctgagttccccatattattacagttccacatcaaggccgagtgcaccgcccaccactgccacggcctttgaccatctgtagttgccatggggacagtgggagcgactgagcaacaggaggactcagcctgggacaggccccagagagtcacacaaaggaatctttatttattacatgaaaaataaccacaagtccagcattgcggcacactccctgtgtggttaatttaatgaaccatgaaagacaggatgaccttggacaaggccaaactgtcctccaagactccttaatgaggggcaggagtcccagggaaagagaaccatgccatgctgaaaaagacaaaattgaagaagaaatgtagcccccagccggtacccaccaaaggagagaagaagcaatagccgaggaacttggggggatggcgaatggttcctgcccgggcccaaggggtgcacagggcacctccatggctccattattaacacaactctagcaattatggaccataagcacttccctccagcccacaagtcacagcctggtgccgaggctctcctcaccagccacccagggagtcacctccctcagcctcccgcctgccccacacggaggctctggctgtcctctttctccactccatttgcttggctctttctacacctccctcttgggcatgggctgagggctggagcgagtccctcagaaattccaccaggctgtcagctgacctcttttgcctgctgctgtgaaggtatagcaccaccccaggtcctcctgcagtgcggcatccccttggcagctgccgtcagccaggccagccccagggagcttaaaacagacattccacagggcctgggcccctgggaggtgaggtgtggtgtgcggcttcacccagggcagaacaaggcagaatcgcaggaaacccgcttccccttcctgacagctcctgccaagccaaatgtgcttcctgcagctcacgcccaccagctactgaagggacccaaggcaccccctgaagccagcgatagagggtccctctctgctccccagcagctcctgcccccaaggcctgactgtatatactgtaaatgaaactttgtttgggtcaagcttccttctttctaacccccagactttggcctctgagtgaaatgtctctctttgccctgtggggcttctctccttgatgcttctttctttttttaaagacaacctgccattaccacatgactcaataaaccattgctcttcatctcaggctttggggttggctggggaaggaggcatcccggggctgggctttctcccaagaacatcagagctgagtagccgacaaactcactttggggccgtgggctggaagggaccatctgatgccccagagctctggcttggccttctccctctgcctttaattcacgttgaacgctgggtacctcactcatcccaagttcttcaacactgagcaaatgcaaggatagcacagtactgagccaaccatagactccccacaaggagttgctgttgttattaacaggaagccagagaatcagcagggtgggttagtgagggatccgggaatagctgtgactggagcctgcataaacagctctgaagggagagagaagactgggctctcttgtgtgccaggcacagtatggaaggcttcatataagttaagctgaaattagccctgttttacatacagcttcattttacatatgaggaaactgaggctttgaaaaaaatgagatgtcttgtccaagatgaaaagtagtagattcaaccaagtcctcttactctaagcccaacgcttttacccaaaaccccagagtcctcatcagggatgccaaatggttctagacccagtggaggttctggagctgccactggggatttaatttcttttgatttgctaaagatttgacctgactgaatggagaggtagagtgtagtgtggccaggacaaggtgagggaggctgtagagacttagcactttaggccaaccacctccaggaaatctgggaaatgcaatgtgacagctcgggctctgcactccagggggctgtctggtgtccacatggaccttctccatgtgggacacagctggaacaagggggcaggggcctgcagctgggatgcccaggtgaatatgggcagctggacaaacaacactgggattgagtcagatagaaggggcccaaggactccagggctgggaggacagaggctgggagagagggctcttacctccttaggcctcccaaagagcggttagggatgctgccatggatggcatggcagggggaaccctcctggaagaaaatccatctcttctgaagggatctgagatgcggctggtttttcaatggcagaacttccctctgcagcgcgactccgaatccatgacatctgagagtcttcctgaccacaaacctctgggatcccgagggctccctacccaagaatcactttgagcacagcatcccaaggagcccatagagcgatcccttgcattcacagccacagcccctctggggacactctgtacccccggcagaccctttccaactcacaaccaataaaggggcttgggctgtgctttgactaaggtga

SEQ ID NO: 2994 - DNA, 4084 bp, Homo sapiens
ataaaaccggtcggtgatgccgggtggatgggaacaaacttcagaaggaggagagacaccgggcccagggcaccctcgcgggcggacccaaccagtgagggcctgcagccggccggccagggcagcggcaggcgcggcccggacctacgggaggaagccccgagccctcggcgggctgcgagcgactccccggcgatgcctcacaactccatcagatctggccatggagggctgaaccagctgggaggggcctttgtgaatggcagacctctgccggaagtggtccgccagcgcatcgtagacctggcccaccagggtgtaaggccctgcgacatctctcgccagctccgcgtcagccatggctgcgtcagcaagatccttggcaggtactacgagactggcagcatccggcctggagtgatagggggctccaagcccaaggtggccacccccaaggtggtggagaagattggggactacaaacgccagaaccctaccatgtttgcctgggagatccgagaccggctcctggctgagggcgtctgtgacaatgacactgtgcccagtgtcagctccattaatagaatcatccggaccaaagtgcagcaaccattcaacctccctatggacagctgcgtggccaccaagtccctgagtcccggacacacgctgatccccagctcagctgtaactcccccggagtcaccccagtcggattccctgggctccacctactccatcaatgggctcctgggcatcgctcagcctggcagcgacaagaggaaaatggatgacagtgatcaggatagctgccgactaagcattgactcacagagcagcagcagcggaccccgaaagcaccttcgcacggatgccttcagccagcaccacctcgagccgctcgagtgcccatttgagcggcagcactacccagaggcctatgcctcccccagccacaccaaaggcgagcagggcctctacccgctgcccttgctcaacagcaccctggacgacgggaaggccaccctgaccccttccaacacgccactggggcgcaacctctcgactcaccagacctaccccgtggtggcagatcctcactcacccttcgccataaagcaggaaacccccgaggtgtccagttctagctccaccccttcctctttatctagctccgcctttttggatctgcagcaagtcggctccggggtcccgcccttcaatgcctttccccatgctgcctccgtgtacgggcagttcacgggccaggccctcctctcagggcgagagatggtggggcccacgctgcccggatacccaccccacatccccaccagcggacagggcagctatgcctcctctgccatcgcaggcatggtggcaggaagtgaatactctggcaatgcctatggccacaccccctactcctcctacagcgaggcctggcgcttccccaactccagcttgctgagttccccatattattacagttccacatcaaggccgagtgcaccgcccaccactgccacggcctttgaccatctgtagttgccatggggacagtgggagcgactgagcaacaggaggactcagcctgggacaggccccagagagtcacacaaaggaatctttatttattacatgaaaaataaccacaagtccagcattgcggcacactccctgtgtggttaatttaatgaaccatgaaagacaggatgaccttggacaaggccaaactgtcctccaagactccttaatgaggggcaggagtcccagggaaagagaaccatgccatgctgaaaaagacaaaattgaagaagaaatgtagcccccagccggtacccaccaaaggagagaagaagcaatagccgaggaacttggggggatggcgaatggttcctgcccgggcccaaggggtgcacagggcacctccatggctccattattaacacaactctagcaattatggaccataagcacttccctccagcccacaagtcacagcctggtgccgaggctctcctcaccagccacccagggagtcacctccctcagcctcccgcctgccccacacggaggctctggctgtcctctttctccactccatttgcttggctctttctacacctccctcttgggcatgggctgagggctggagcgagtccctcagaaattccaccaggctgtcagctgacctcttttgcctgctgctgtgaaggtatagcaccaccccaggtcctcctgcagtgcggcatccccttggcagctgccgtcagccaggccagccccagggagcttaaaacagacattccacagggcctgggcccctgggaggtgaggtgtggtgtgcggcttcacccagggcagaacaaggcagaatcgcaggaaacccgcttccccttcctgacagctcctgccaagccaaatgtgcttcctgcagctcacgcccaccagctactgaagggacccaaggcaccccctgaagccagcgatagagggtccctctctgctccccagcagctcctgcccccaaggcctgactgtatatactgtaaatgaaactttgtttgggtcaagcttccttctttctaacccccagactttggcctctgagtgaaatgtctctctttgccctgtggggcttctctccttgatgcttctttctttttttaaagacaacctgccattaccacatgactcaataaaccattgctcttcatctcaggctttggggttggctggggaaggaggcatcccggggctgggctttctcccaagaacatcagagctgagtagccgacaaactcactttggggccgtgggctggaagggaccatctgatgccccagagctctggcttggccttctccctctgcctttaattcacgttgaacgctgggtacctcactcatcccaagttcttcaacactgagcaaatgcaaggatagcacagtactgagccaaccatagactccccacaaggagttgctgttgttattaacaggaagccagagaatcagcagggtgggttagtgagggatccgggaatagctgtgactggagcctgcataaacagctctgaagggagagagaagactgggctctcttgtgtgccaggcacagtatggaaggcttcatataagttaagctgaaattagccctgttttacatacagcttcattttacatatgaggaaactgaggctttgaaaaaaatgagatgtcttgtccaagatgaaaagtagtagattcaaccaagtcctcttactctaagcccaacgcttttacccaaaaccccagagtcctcatcagggatgccaaatggttctagacccagtggaggttctggagctgccactggggatttaatttcttttgatttgctaaagatttgacctgactgaatggagaggtagagtgtagtgtggccaggacaaggtgagggaggctgtagagacttagcactttaggccaaccacctccaggaaatctgggaaatgcaatgtgacagctcgggctctgcactccagggggctgtctggtgtccacatggaccttctccatgtgggacacagctggaacaagggggcaggggcctgcagctgggatgcccaggtgaatatgggcagctggacaaacaacactgggattgagtcagatagaaggggcccaaggactccagggctgggaggacagaggctgggagagagggctcttacctccttaggcctcccaaagagcggttagggatgctgccatggatggcatggcagggggaaccctcctggaagaaaatccatctcttctgaagggatctgagatgcggctggtttttcaatggcagaacttccctctgcagcgcgactccgaatccatgacatctgagagtcttcctgaccacaaacctctgggatcccgagggctccctacccaagaatcactttgagcacagcatcccaaggagcccatagagcgatcccttgcattcacagccacagcccctctggggacactctgtacccccggcagaccctttccaactcacaaccaataaaggggcttgggctgtgctttgactaaggtga

SEQ ID NO: 2995 - DNA, 949 bp, Homo sapiens
gcagtgtggggctgagggaggccggacggcgcgcgtgcgtgctggcgtgcgttcattttcagcctggtgtggggtgagtggtacccaacgggccggggcgccgcgtccgcaggaagaggcgcggggtgcaggcttgtaaacatataacataaaaatggcttccaaaagagctctggtcatcctggctaaaggagcagaggaaatggagacggtcatccctgtagatgtcatgaggcgagctgggattaaggtcaccgttgcaggcctggctggaaaagacccagtacagtgtagccgtgatgtggtcatttgtcctgatgccagccttgaagatgcaaaaaaagagggaccatatgatgtggtggttctaccaggaggtaatctgggcgcacagaatttatctgagtctgctgctgtgaaggagatactgaaggagcaggaaaaccggaagggcctgatagccgccatctgtgcaggtcctactgctctgttggctcatgaaataggttttggaagtaaagttacaacacaccctcttgctaaagacaaaatgatgaatggaggtcattacacctactctgagaatcgtgtggaaaaagacggcctgattcttacaagccgggggcctgggaccagcttcgagtttgcgcttgcaattgttgaagccctgaatggcaaggaggtggcggctcaagtgaaggctccacttgttcttaaagactagagcagcgaactgcgacgatcacttagagaaacaggccgttaggaatccattctcactgtgttcgctctaaacaaaacagtggtaggttaatgtgttcagaagtcgctgtccttactacttttgcggaagtatggaagtcacaactacacagagatttctcagcctacaaattgtgtctatacatttctaagccttgtttgcagaataaacagggcatttagcaaa

SEQ ID NO: 2996 - DNA, 783 bp, Homo sapiens
tttgactgaccgccagcgtggtggcaacgctgaagcgtccagaatcttctgcctaacctctcgccggcatggaactggctagccgttttattaaactctgttttgcgtggacggtaaaccctccagataatctgcttgtaaacatataacataaaaatggcttccaaaagagctctggtcatcctggctaaaggagcagaggaaatggagacggtcatccctgtagatgtcatgaggcgagctgggattaaggtcaccgttgcaggcctggctggaaaagacccagtacagtgtagccgtgatgtggtcatttgtcctgatgccagccttgaagatgcaaaaaaagagggaccatatgatgtggtggttctaccaggaggtaatctgggcgcacagaatttatctgagtctgctgctgtgaaggagatactgaaggagcaggaaaaccggaagggcctgatagccgccatctgtgcaggtcctactgctctgttggctcatgaaataggttttggaagtaaagttacaacacaccctcttgctaaagacaaaatgatgaatggaggtcattacacctactctgagaatcgtgtggaaaaagacggcctgattcttacaagccgggggcctgggaccagcttcgagtttgcgcttgcaattgttgaagccctgaatggcaaggaggtggcggctcaagtgaaggctccacttgttcttaaagactagagcagcgaactgcgacgatcacttagagaaacaggccgttaggaatccattctcact

SEQ ID NO: 2997 - DNA, 977 bp, Homo sapiens
agaaccggcgcggggcctgggtcggggccgccctcgcttccggcctcccagtcgggccctgtcgctggcgttggatttgactgaccgccagcgtggtggcaacgctgaagcgtccagaatcttctgcctaacctctcgccggcatggaactggctagccgttttattaaactctgttttgcgtggacggcttgtaaacatataacataaaaatggcttccaaaagagctctggtcatcctggctaaaggagcagaggaaatggagacggtcatccctgtagatgtcatgaggcgagctgggattaaggtcaccgttgcaggcctggctggaaaagacccagtacagtgtagccgtgatgtggtcatttgtcctgatgccagccttgaagatgcaaaaaaagagggaccatatgatgtggtggttctaccaggaggtaatctgggcgcacagaatttatctgagtctgctgctgtgaaggagatactgaaggagcaggaaaaccggaagggcctgatagccgccatctgtgcaggtcctactgctctgttggctcatgaaataggttttggaagtaaagttacaacacaccctcttgctaaagacaaaatgatgaatggaggtcattacacctactctgagaatcgtgtggaaaaagacggcctgattcttacaagccgggggcctgggaccagcttcgagtttgcgcttgcaattgttgaagccctgaatggcaaggaggtggcggctcaagtgaaggctccacttgttcttaaagactagagcagcgaactgcgacgatcacttagagaaacaggccgttaggaatccattctcactgtgttcgctctaaacaaaacagtggtaggttaatgtgttcagaagtcgctgtccttactacttttgcggaagtatggaagtcacaactacacagagatttctcagcctacaaattgtgtctatacatttctaagccttg

SEQ ID NO: 2998 - DNA, 1088 bp, Homo sapiens
cgcgcgtgcgtgctggcgtgcgttcattttcagcctggtgtggggcttgtaaacatataacataaaaatggcttccaaaagagctctggtcatcctggctaaaggagcagaggaaatggagacggtcatccctgtagatgtcatgaggcgagctgggattaaggtcaccgttgcaggcctggctggaaaagacccagtacagtgtagccgtgatgtggtcatttgtcctgatgccagccttgaagatgcaaaaaaagagggaccatatgatgtggtggttctaccaggaggtaatctgggcgcacagaatttatctgagtctgctgctgtgaaggagatactgaaggagcaggaaaaccggaagggcctgatagccgccatctgtgcaggtcctactgctctgttggctcatgaaataggttttggaagtaaagttacaacacaccctcttgctaaagacaaaatgatgaatggaggtcattacacctactctgagaatcgtgtggaaaaagacggcctgattcttacaagccgggggcctgggaccagcttcgagtttgcgcttgcaattgttgaagccctgaatggcaaggaggtggcggctcaagtgaaggctccacttgttcttaaagactagagcagcgaactgcgacgatcacttagagaaacaggccgttaggaatccattctcactgtgttcgctctaaacaaaacagtggtaggttaatgtgttcagaagtcgctgtccttactacttttgcggaagtatggaagtcacaactacacagagatttctcagcctacaaattgtgtctatacatttctaagccttgtttgcagaataaacagggcatttagcaaactactgattgtttcttgttttgtctctcatttcttttgtgaaattaaattccgtatcaccttcatttgcagctcttaactgtccatatggcactgaaataaaagaacagtgaccacattttacacagcaaggaggaaaggcatacaaacagaatttaagaggcttgtgattttctctgcttattagctgtgtgtttttaatgtgctattaaaaaataccaatgagg

SEQ ID NO: 2999 - DNA, 4058 bp, Homo sapiens
gcaggccgaatggtggatttaattggccggagtttagggcgcgcttggcccgcgtgggtcagctgatcgcgcactgagggtgcgatcccgggctccccattccttcctggggcgcctccccggcccagggccaactgggtcccggtgtcggcaggcctggggtcggcgacggctgctcttttcgttctgtcgcctgcccgatggacgagcctcccgggaagcccctcagctgtgaggagaaggaaaagttaaaggagaaattagcattcttgaaaagggaatacagcaagacactagcccgccttcagcgtgcccaaagagctgaaaagattaagcattctattaagaaaacagtagaagaacaagattgtttgtctcagcaggatctctcaccgcagctaaaacactcagaacctaaaaataaaatatgtgtttatgacaagttacacatcaaaacccatcttgatgaagaaactggagaaaagacatctatcacacttgatgttgggcctgagtcctttaaccctggagatggcccaggaggattacctatacaaagaacagatgacacccaagaacattttccccacagggtcagtgaccctagtggtgagcaaaagcagaagctgccaagcagaagaaagaagcagcagaagaggacatttatttcacaggagagagactgtgtctttggcactgattcactcagattgtctgggaaaagactaaaggaacaggaagaaatcagtagcaaaaatcctgctagatcaccagtaactgaaataagaactcaccttttaagtcttaaatctgaacttccagattctccagaaccagttacagaaattaatgaagacagtgtattaattccaccaactgcccaaccagaaaaaggtgttgatacattcctaagaagacctaatttcaccagggcgactacagttcctttacagactctatcagatagcggtagtagtcagcaccttgaacacattcctcctaaaggtagcagtgaacttactactcacgacctaaaaaacattagatttacttcacctgtaagtttggaggcacaaggcaaaaaaatgactgtctctacagataacctccttgtaaataaagctataagtaaaagtggccaactgcccacaagttctaatttagaggcaaatatttcatgttctctaaatgaactcacctacaataacttaccagcaaatgaaaaccaaaacttaaaagaacaaaatcaaacagagaaatctttaaaatctcccagtgacactcttgatggcaggaatgaaaatcttcaggaaagtgagattctaagtcaacctaagagtcttagcctggaagcaacctctcctctttctgcagaaaaacattcttgcacagtgcctgaaggccttctgtttcctgcagaatattatgttagaacaacacgaagcatgtccaattgccagaggaaagtagccgtggaggctgtcattcagagtcatttggatgtcaagaaaaaagggtttaaaaataaaaataaggatgcaagtaaaaatttaaacctttccaatgaggaaactgaccaaagtgaaattaggatgtctggcacatgcacaggacaaccaagttcaagaacctctcagaaacttctctcattaactaaagtcagctctcccgctgggcccactgaagataatgacttgtctaggaaggcagttgcccaagcacctggtagaagatacacaggaaaaagaaaatcagcctgcaccccagcatcagatcattgtgaaccacttttgccaacttctagcctgtcgattgttaacaggtccaaggaagaagtcacctcacacaaatatcagcacgaaaaattatttattcaagtgaaagggaagaaaagtcgtcatcaaaaagaggattccctttcttggagtaatagtgcttatttatccttggatgatgatgctttcacggctccatttcatagggatggaatgctgagtttaaagcaactactgtcttttctcagtatcacagactttcagttacctgatgaagactttggacctcttaagcttgaaaaagtgaagtcctgctcagaaaaaccagtggagccctttgagtcaaaaatgtttggagagagacatcttaaagagggaagctgtatttttccagaggaactgagtcctaaacgcatggatacagaaatggaggacttagaagaggaccttattgttctaccaggaaaatcacatcccaaaaggccaaactcgcaaagccagcatacaaagacgggcctttcttcatccatattactttatactcctttaaatacggttgcgcctgatgataatgacaggcctaccacagacatgtgttcacctgctttccccatcttaggtactactccagcctttggccctcaaggctcctatgaaaaagcatctacagaagttgctggacgaacttgctgcacaccccaacttgctcatttgaaagactcagtctgtcttgccagtgatactaaacaattcgacagttcaggcagcccagcaaaaccacataccaccctgcaagtgtcaggcaggcaaggacaacctacctgtgactgtgactctgtcccgccaggaacacctccacccattgagtcattcacttttaaagaaaatcagctctgtagaaacacatgccaggagctgcataaacattccgtcgaacagactgaaacagcagagcttcctgcttctgatagcataaacccaggcaacctacaattggtttcagagttaaagaatccttcaggttcctgttccgtagatgtgagtgccatgttttgggaaagagccggttgtaaagagccatgtatcataactgcttgcgaagatgtagtttctctttggaaagctctggatgcttggcagtgggaaaaactttatacctggcacttcgcagaggttccagtattacagatagttccagtgcctgatgtgtataatctcgtgtgtgtagctttgggaaatttggaaatcagagagatcagggcattgttttgttcctctgatgatgaaagtgaaaagcaagtactactgaagtctggaaatataaaagctgtgcttggcctgacaaagaggaggctagttagtagcagtgggaccctttctgatcaacaagtagaagtcatgacgtttgcagaagatggaggaggcaaagaaaaccaatttttgatgccccctgaggagactatactaacttttgctgaggtccaagggatgcaagaagctctgcttggtactactattatgaacaacattgttatttggaatttaaaaactggtcaactcctgaaaaagatgcacattgatgattcttaccaagcttcagtctgtcacaaagcctattctgaaatggggcttctctttattgtcctgagtcatccctgtgccaaagagagtgagtcgttgcgaagccctgtgtttcagctcattgtgattaaccctaagacgactctcagcgtgggtgtgatgctgtactgtcttcctccagggcaggctggcaggttcctggaaggtgacgtgaaagatcactgtgcagcagcaatcttgacttctggaacaattgccatttgggacttacttctcggtcagtgtactgccctcctcccacctgtctctgaccaacattggtcttttgtgaaatggtcgggtacagactctcatttgctggctggacaaaaagatggaaatatatttgtataccactattcataagttagggtaaagtgaaaacacaattttctggatatattgggcctcttagtattttttggagttttaaatataaaggagaatatctgaatgacacttaaaatgattgcttgtttatgtccagacagacttattttttattctaatgatggtagcaccactgatcttggatgtacatttatgtatactttgagaaaaagggttttaggttgatttttgtaatttcccacatttgtacatgtgcttttaaaggtgtacataaagcttcaaatggcaataaatatttatttttatacattc

SEQ ID NO: 3000 - DNA, 8057 bp, Homo sapiens
gaactggatgtgggcagcggcggccgcagagacctcgggacccccgcgcaatgtggcaatggaaggcgcagggtctgactccccggcagcggccgcggccgcagcggcagcagcgcccgccgtgtgagcagcagcagcggctggtctgtcaaccggagcccgagcccgagcagcctgcggccagcagcgtcctcgcaagccgagcgcccaggcgcgccaggagcccgcagcagcggcagcagcgcgccgggccgcccgggaagcctccgtccccgcggcggcggcggcggcggcggcaacatggcctcggctggtaacgccgccgagccccaggaccgcggcggcggcggcagcggctgtatcggtgccccgggacggccggctggaggcgggaggcgcagacggacgggggggctgcgccgtgctgccgcgccggaccgggactatctgcaccggcccagctactgcgacgccgccttcgctctggagcagatttccaaggggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaagttggaggacgagtaagtcgtgaattaaattatactcgccagaagattggagaagaggctatgtttaatcctcaactcatgatacagacccctaaagaagaaggtgctaatgtcctgaccacagaagcgctcctacaacacctggactcggcactccaggccagccgtgtccatgtatacatgtacaacaggcagtggaaattggaacatttgtgttacaaatcaggagagcttatcacagaaacaggttacatggatcagataatagaatatctttacccttgtttgattattacacctttggactgcttctgggaaggggcgaaattacagtctgggacagcatacctcctaggtaaacctcctttgcggtggacaaacttcgaccctttggaattcctggaagagttaaagaaaataaactatcaagtggacagctgggaggaaatgctgaataaggctgaggttggtcatggttacatggaccgcccctgcctcaatccggccgatccagactgccccgccacagcccccaacaaaaattcaaccaaacctcttgatatggcccttgttttgaatggtggatgtcatggcttatccagaaagtatatgcactggcaggaggagttgattgtgggtggcacagtcaagaacagcactggaaaactcgtcagcgcccatgccctgcagaccatgttccagttaatgactcccaagcaaatgtacgagcacttcaaggggtacgagtatgtctcacacatcaactggaacgaggacaaagcggcagccatcctggaggcctggcagaggacatatgtggaggtggttcatcagagtgtcgcacagaactccactcaaaaggtgctttccttcaccaccacgaccctggacgacatcctgaaatccttctctgacgtcagtgtcatccgcgtggccagcggctacttactcatgctcgcctatgcctgtctaaccatgctgcgctgggactgctccaagtcccagggtgccgtggggctggctggcgtcctgctggttgcactgtcagtggctgcaggactgggcctgtgctcattgatcggaatttcctttaacgctgcaacaactcaggttttgccatttctcgctcttggtgttggtgtggatgatgtttttcttctggcccacgccttcagtgaaacaggacagaataaaagaatcccttttgaggacaggaccggggagtgcctgaagcgcacaggagccagcgtggccctcacgtccatcagcaatgtcacagccttcttcatggccgcgttaatcccaattcccgctctgcgggcgttctccctccaggcagcggtagtagtggtgttcaattttgccatggttctgctcatttttcctgcaattctcagcatggatttatatcgacgcgaggacaggagactggatattttctgctgttttacaagcccctgcgtcagcagagtgattcaggttgaacctcaggcctacaccgacacacacgacaatacccgctacagccccccacctccctacagcagccacagctttgcccatgaaacgcagattaccatgcagtccactgtccagctccgcacggagtacgacccccacacgcacgtgtactacaccaccgctgagccgcgctccgagatctctgtgcagcccgtcaccgtgacacaggacaccctcagctgccagagcccagagagcaccagctccacaagggacctgctctcccagttctccgactccagcctccactgcctcgagcccccctgtacgaagtggacactctcatcttttgctgagaagcactatgctcctttcctcttgaaaccaaaagccaaggtagtggtgatcttcctttttctgggcttgctgggggtcagcctttatggcaccacccgagtgagagacgggctggaccttacggacattgtacctcgggaaaccagagaatatgactttattgctgcacaattcaaatacttttctttctacaacatgtatatagtcacccagaaagcagactacccgaatatccagcacttactttacgacctacacaggagtttcagtaacgtgaagtatgtcatgttggaagaaaacaaacagcttcccaaaatgtggctgcactacttcagagactggcttcagggacttcaggatgcatttgacagtgactgggaaaccgggaaaatcatgccaaacaattacaagaatggatcagacgatggagtccttgcctacaaactcctggtgcaaaccggcagccgcgataagcccatcgacatcagccagttgactaaacagcgtctggtggatgcagatggcatcattaatcccagcgctttctacatctacctgacggcttgggtcagcaacgaccccgtcgcgtatgctgcctcccaggccaacatccggccacaccgaccagaatgggtccacgacaaagccgactacatgcctgaaacaaggctgagaatcccggcagcagagcccatcgagtatgcccagttccctttctacctcaacggcttgcgggacacctcagactttgtggaggcaattgaaaaagtaaggaccatctgcagcaactatacgagcctggggctgtccagttaccccaacggctaccccttcctcttctgggagcagtacatcggcctccgccactggctgctgctgttcatcagcgtggtgttggcctgcacattcctcgtgtgcgctgtcttccttctgaacccctggacggccgggatcattgtgatggtcctggcgctgatgacggtcgagctgttcggcatgatgggcctcatcggaatcaagctcagtgccgtgcccgtggtcatcctgatcgcttctgttggcataggagtggagttcaccgttcacgttgctttggcctttctgacggccatcggcgacaagaaccgcagggctgtgcttgccctggagcacatgtttgcacccgtcctggatggcgccgtgtccactctgctgggagtgctgatgctggcgggatctgagttcgacttcattgtcaggtatttctttgctgtgctggcgatcctcaccatcctcggcgttctcaatgggctggttttgcttcccgtgcttttgtctttctttggaccatatcctgaggtgtctccagccaacggcttgaaccgcctgcccacaccctcccctgagccaccccccagcgtggtccgcttcgccatgccgcccggccacacgcacagcgggtctgattcctccgactcggagtatagttcccagacgacagtgtcaggcctcagcgaggagcttcggcactacgaggcccagcagggcgcgggaggccctgcccaccaagtgatcgtggaagccacagaaaaccccgtcttcgcccactccactgtggtccatcccgaatccaggcatcacccaccctcgaacccgagacagcagccccacctggactcagggtccctgcctcccggacggcaaggccagcagccccgcagggacccccccagagaaggcttgtggccacccccctacagaccgcgcagagacgcttttgaaatttctactgaagggcattctggccctagcaatagggcccgctggggccctcgcggggcccgttctcacaaccctcggaacccagcgtccactgccatgggcagctccgtgcccggctactgccagcccatcaccactgtgacggcttctgcctccgtgactgtcgccgtgcacccgccgcctgtccctgggcctgggcggaacccccgagggggactctgcccaggctaccctgagactgaccacggcctgtttgaggacccccacgtgcctttccacgtccggtgtgagaggagggattcgaaggtggaagtcattgagctgcaggacgtggaatgcgaggagaggccccggggaagcagctccaactgagggtgattaaaatctgaagcaaagaggccaaagattggaaaccccccacccccacctctttccagaactgcttgaagagaactggttggagttatggaaaagatgccctgtgccaggacagcagttcattgttactgtaaccgattgtattattttgttaaatatttctataaatatttaagagatgtacacatgtgtaatataggaaggaaggatgtaaagtggtatgatctggggcttctccactcctgccccagagtgtggaggccacagtggggcctctccgtatttgtgcattgggctccgtgccacaaccaagcttcattagtcttaaatttcagcatatgttgctgctgcttaaatattgtataatttacttgtataattctatgcaaatattgcttatgtaataggattattttgtaaaggtttctgtttaaaatattttaaatttgcatatcacaaccctgtggtagtatgaaatgttactgttaactttcaaacacgctatgcgtgataatttttttgtttaatgagcagatatgaagaaagcacgttaatcctggtggcttctctaggtgtcgttgtgtgcggtcctcttgtttggctgtgcgtgtgaacacgtgtgtgagttcaccatgtactgtactgtgattttttttttgtcttgttttgtttctctacactgtctgtaacctgtagtaggctctgacctagtcaggctggaagcgtcaggatatcttttcttcgtgctggtgagggctggccctaaacatccacctaatcctttcaaatcagcccggcaaaagctagactctcctcgtgtctacggcatctcttatgatcattggctgccatccaggaccccaatttgtgcttcagggggataatctccttctctcggatcattgtgatggatgctggaacctcagggtatggagctcacatcagttcatcatggtgggtgttagagaattcggtgacatgcctagtgctgagccttggctgggccatgagagtctgtatactctaaaaagcatgcagcatggtgcccctcttctgaccaacacacacacgacccctcccccaacacccccaaattcaagagtggatgtggccctgtcacaggtagaaaaacctatttagttaattctttcttggcccacagtctcccagaaatgatgttttgagtccctatagtttaaactccctctcttaaatggagcagctggttgaggctttctagatctgtttgcatcttctttaaaactaagtggtgagcatgcattgtggtgtagaggcaggcattatgtaggataagagctccggggggattcttcatgcaccagtgtttagggtacgtgcttcctaagtaaatccaaacattgtctccatcctccccgtcattagtgctctttcaatgtgatgtgggaaagcaggaggatggacacaccccactgaaagatgtaggcaggggcaggtctctcaaccaggcatatttttaaaagttgcttctgtactggttctcttcttttgctctgaggtgtgggctccctcatctcgtaaccagagaccagcacatgtcagggaagcacccagtgtcggctccccatccaaatccacaccagcaccttgttacagacaagaagtcagaggaaagggcggggtccctgcagggctgaagcctaagctactgtgaggcgctcacgagtggcagctcctgttactcccttttaaattacctgggaaatcttaacagaaaggtaatgggcccccagaaatacccacagcatagtgacctcagaccctgatactcaccacaaaacttttaagatgctgattgggagccgcttgtggctgctgggtgtgtgtgtgtgtgtgtgcgtgcgtgcgtgtgtgtgtgtctctgctggggaccctggccacccccctgctgctgtcttggtgcctgtcacccacatggtctgccatcctaacacccagctctgctcagaaaacgtcctgcgtggaggagggatgatgcagaattctgaagtcgacttccctctggctcctggcgtgccctcgctcccttcctgagcccagctcgtgttgcgccggaggctgcgcggcccctgatttctgcatggtgtagaactttctccaatagtcacattggcaaagggagaactggggtgggcggggggtggggctggcagggaattagaatttctctctctcttttaatagttttattttgtctgtcctgtttgttcatttggatgttttaatttttaaaaaaaaaaaaactttgctgatatttataattttgtatcataagaatgttttcctctacagtatttgtcatgccagtttataacaaaaaaaaatgcagggattttatttctattggaaacattacagctatgttttacttttggacagaatttttatttgtatagagtgcttactaatgttaaatagttcagagtatataacatttacattaaggactcatggtaggttttagggtaaggagtttaaaggaaataaatattcaaactgggtctcattgccaattttggtggaaatgagtttgtgtcatttcaattacaaagataaaagtatgccatataatttatttatatgaagatttatttttgtagtgtacatagtagtcatcaagtcttttgacagaagtatatttttaaagaatttatatgtgatgaatccataatgtctggaactttgctgagacatgagtgggcacagttttcattgtaaattacagcaaggaaagaaaatgtttaacagtgttaagagagtcagagcagagtggatattcatgcgattatgaagtgtttattagttaccattggcgacctagcatgcttctcatttcaaaccttggaaggtgaaaatgtacaaactctctaaataattaatgttcaaacactgatagaaattctaacatgaataaaaaataatataacttgttggttatatctttgtttgtagaatgctttttttctttaaaatacttgggagagacagttagtgttggagccatcagaaactgttgtttcatcttgctgaccttgtgacactcttcttttttgctctatctgatggagagagttttaggttttcctcctttttgttttgtataaatagtgggtataagcatagctctgttacatggatgtattacaaagtgggggctgagcttttagtgtgatcatcacccaaatagtgtacattgtacccattaattaatttcttatcacctgaccctatttttgttttctcataccaagaaacttcctaagttaaccatcaaaattagtccttctgtcatctctcttagcatacttatttcccttatgtgatgcctaataatgagggaacataaataaagccaaattcaaagatga

SEQ ID NO: 3001 - DNA, 1058 bp, Homo sapiens
aaggctgaggttggtcatggttacatggaccgcccctgcctcaatccggccgatccagactgccccgccacagcccccaacaaaaattcaaccaaacctcttgatatggcccttgttttgaatggtggatgtcatggcttatccagaaagtatatgcactggcaggaggagttgattgtgggtggcacagtcaagaacagcactggaaaactcgtcagcgcccatgccctgcagaccatgttccagttaatgactcccaagcaaatgtacgagcacttcaaggggtacgagtatgtctcacacatcaactggaacgaggacaaagcggcagccatcctggaggcctggcagaggacatatgtggaggtggttcatcagagtgtcgcacagaactccactcaaaaggtgctttccttcaccaccacgaccctggacgacatcctgaaatccttctctgacgtcagtgtcatccgcgtggccagcggctacttactcatggttttgccatttctcgctcttggtgttggtgtggatgatgtttttcttctggcccacgccttcagtgaaacaggacagaataaaagaatcccttttgaggacaggaccggggagtgcctgaagcgcacaggagccagcgtggccctcacgtccatcagcaatgtcacagccttcttcatggccgcgttaatcccaattcccgctctgcgggcgttctccctccaggcagcggtagtagtggtgttcaattttgccatggttctgctcatttttcctgcaattctcagcatggatttatatcgacgcgaggacaggagactggatattttctgctgttttacaagcccctgcgtcagcagagtgattcaggttgaacctcaggcctacaccgacacacacgacaatacccgctacagccccccacctccctacagcagccacagctttgcccatgaaacgcagattaccatgcagtccactgtccagctccgcacggagtacgacccccacacgcacgtgtactacaccaccgctgagccgcgctccgagatctctgtgca

SEQ ID NO: 3002 - DNA, 4720 bp, Homo sapiens
acccaggagggctgtgctgatagcacgttcctcgagtttactttgctttccttgagtttattgtaaaggggtaaagttttcggatccgtcacgtgaccctgacaggtcctgcctatggcgcggcagaccacccacgccgagggccatggaactgcttaatagaaacaggcttgtaattgtgagtccgcgctgcactccgccgaaagcctccggcggcccagcgcgccggggtttttacactttccgttccttttgtaaagacggaggaggaggagaagaagaagaagaaaacggaggagaagaaaaagacgacaggggagacaaagagacccgcagcgacaaggggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaagttggaggacgagtaagtcgtgaattaaattatactcgccagaagattggagaagaggctatgtttaatcctcaactcatgatacagacccctaaagaagaaggtgctaatgtcctgaccacagaagcgctcctacaacacctggactcggcactccaggccagccgtgtccatgtatacatgtacaacaggcagtggaaattggaacatttgtgttacaaatcaggagagcttatcacagaaacaggttacatggatcagataatagaatatctttacccttgtttgattattacacctttggactgcttctgggaaggggcgaaattacagtctgggacagcatacctcctaggtaaacctcctttgcggtggacaaacttcgaccctttggaattcctggaagagttaaagaaaataaactatcaagtggacagctgggaggaaatgctgaataaggctgaggttggtcatggttacatggaccgcccctgcctcaatccggccgatccagactgccccgccacagcccccaacaaaaattcaaccaaacctcttgatatggcccttgttttgaatggtggatgtcatggcttatccagaaagtatatgcactggcaggaggagttgattgtgggtggcacagtcaagaacagcactggaaaactcgtcagcgcccatgccctgcagaccatgttccagttaatgactcccaagcaaatgtacgagcacttcaaggggtacgagtatgtctcacacatcaactggaacgaggacaaagcggcagccatcctggaggcctggcagaggacatatgtggaggtggttcatcagagtgtcgcacagaactccactcaaaaggtgctttccttcaccaccacgaccctggacgacatcctgaaatccttctctgacgtcagtgtcatccgcgtggccagcggctacttactcatgctcgcctatgcctgtctaaccatgctgcgctgggactgctccaagtcccagggtgccgtggggctggctggcgtcctgctggttgcactgtcagtggctgcaggactgggcctgtgctcattgatcggaatttcctttaacgctgcaacaactcaggttttgccatttctcgctcttggtgttggtgtggatgatgtttttcttctggcccacgccttcagtgaaacaggacagaataaaagaatcccttttgaggacaggaccggggagtgcctgaagcgcacaggagccagcgtggccctcacgtccatcagcaatgtcacagccttcttcatggccgcgttaatcccaattcccgctctgcgggcgttctccctccaggcagcggtagtagtggtgttcaattttgccatggttctgctcatttttcctgcaattctcagcatggatttatatcgacgcgaggacaggagactggatattttctgctgttttacaagcccctgcgtcagcagagtgattcaggttgaacctcaggcctacaccgacacacacgacaatacccgctacagccccccacctccctacagcagccacagctttgcccatgaaacgcagattaccatgcagtccactgtccagctccgcacggagtacgacccccacacgcacgtgtactacaccaccgctgagccgcgctccgagatctctgtgcagcccgtcaccgtgacacaggacaccctcagctgccagagcccagagagcaccagctccacaagggacctgctctcccagttctccgactccagcctccactgcctcgagcccccctgtacgaagtggacactctcatcttttgctgagaagcactatgctcctttcctcttgaaaccaaaagccaaggtagtggtgatcttcctttttctgggcttgctgggggtcagcctttatggcaccacccgagtgagagacgggctggaccttacggacattgtacctcgggaaaccagagaatatgactttattgctgcacaattcaaatacttttctttctacaacatgtatatagtcacccagaaagcagactacccgaatatccagcacttactttacgacctacacaggagtttcagtaacgtgaagtatgtcatgttggaagaaaacaaacagcttcccaaaatgtggctgcactacttcagagactggcttcagggacttcaggatgcatttgacagtgactgggaaaccgggaaaatcatgccaaacaattacaagaatggatcagacgatggagtccttgcctacaaactcctggtgcaaaccggcagccgcgataagcccatcgacatcagccagttgactaaacagcgtctggtggatgcagatggcatcattaatcccagcgctttctacatctacctgacggcttgggtcagcaacgaccccgtcgcgtatgctgcctcccaggccaacatccggccacaccgaccagaatgggtccacgacaaagccgactacatgcctgaaacaaggctgagaatcccggcagcagagcccatcgagtatgcccagttccctttctacctcaacggcttgcgggacacctcagactttgtggaggcaattgaaaaagtaaggaccatctgcagcaactatacgagcctggggctgtccagttaccccaacggctaccccttcctcttctgggagcagtacatcggcctccgccactggctgctgctgttcatcagcgtggtgttggcctgcacattcctcgtgtgcgctgtcttccttctgaacccctggacggccgggatcattgtgatggtcctggcgctgatgacggtcgagctgttcggcatgatgggcctcatcggaatcaagctcagtgccgtgcccgtggtcatcctgatcgcttctgttggcataggagtggagttcaccgttcacgttgctttggcctttctgacggccatcggcgacaagaaccgcagggctgtgcttgccctggagcacatgtttgcacccgtcctggatggcgccgtgtccactctgctgggagtgctgatgctggcgggatctgagttcgacttcattgtcaggtatttctttgctgtgctggcgatcctcaccatcctcggcgttctcaatgggctggttttgcttcccgtgcttttgtctttctttggaccatatcctgaggtgtctccagccaacggcttgaaccgcctgcccacaccctcccctgagccaccccccagcgtggtccgcttcgccatgccgcccggccacacgcacagcgggtctgattcctccgactcggagtatagttcccagacgacagtgtcaggcctcagcgaggagcttcggcactacgaggcccagcagggcgcgggaggccctgcccaccaagtgatcgtggaagccacagaaaaccccgtcttcgcccactccactgtggtccatcccgaatccaggcatcacccaccctcgaacccgagacagcagccccacctggactcagggtccctgcctcccggacggcaaggccagcagccccgcagggacccccccagagaaggcttgtggccacccccctacagaccgcgcagagacgcttttgaaatttctactgaagggcattctggccctagcaatagggcccgctggggccctcgcggggcccgttctcacaaccctcggaacccagcgtccactgccatgggcagctccgtgcccggctactgccagcccatcaccactgtgacggcttctgcctccgtgactgtcgccgtgcacccgccgcctgtccctgggcctgggcggaacccccgagggggactctgcccaggctaccctgagactgaccacggcctgtttgaggacccccacgtgcctttccacgtccggtgtgagaggagggattcgaaggtggaagtcattgagctgcaggacgtggaatgcgaggagaggccccggggaagcagctccaactgagggtgattaaaatctgaagcaaagaggccaaagattggaaaccccccacccccacctctttccagaactgcttgaagagaactggttggagttatggaaaagatgccctgtgccaggacagcagttcattgttactgtaaccgattgtattattttgttaaatatttctataaatatttaagagatgtacacatgtgtaatataggaaggaaggatgtaaagtggtatgatctg

SEQ ID NO: 3003 - DNA, 6061 bp, Homo sapiens
ccttgtagaaaatccagtgcgctaaattctcccaaggcagcggtagtagtggtgttcaattttgccatggttctgctcatttttcctgcaattctcagcatggatttatatcgacgcgaggacaggagactggatattttctgctgttttacaagcccctgcgtcagcagagtgattcaggttgaacctcaggcctacaccgacacacacgacaatacccgctacagccccccacctccctacagcagccacagctttgcccatgaaacgcagattaccatgcagtccactgtccagctccgcacggagtacgacccccacacgcacgtgtactacaccaccgctgagccgcgctccgagatctctgtgcagcccgtcaccgtgacacaggacaccctcagctgccagagcccagagagcaccagctccacaagggacctgctctcccagttctccgactccagcctccactgcctcgagcccccctgtacgaagtggacactctcatcttttgctgagaagcactatgctcctttcctcttgaaaccaaaagccaaggtagtggtgatcttcctttttctgggcttgctgggggtcagcctttatggcaccacccgagtgagagacgggctggaccttacggacattgtacctcgggaaaccagagaatatgactttattgctgcacaattcaaatacttttctttctacaacatgtatatagtcacccagaaagcagactacccgaatatccagcacttactttacgacctacacaggagtttcagtaacgtgaagtatgtcatgttggaagaaaacaaacagcttcccaaaatgtggctgcactacttcagagactggcttcagggacttcaggatgcatttgacagtgactgggaaaccgggaaaatcatgccaaacaattacaagaatggatcagacgatggagtccttgcctacaaactcctggtgcaaaccggcagccgcgataagcccatcgacatcagccagttgactaaacagcgtctggtggatgcagatggcatcattaatcccagcgctttctacatctacctgacggcttgggtcagcaacgaccccgtcgcgtatgctgcctcccaggccaacatccggccacaccgaccagaatgggtccacgacaaagccgactacatgcctgaaacaaggctgagaatcccggcagcagagcccatcgagtatgcccagttccctttctacctcaacggcttgcgggacacctcagactttgtggaggcaattgaaaaagtaaggaccatctgcagcaactatacgagcctggggctgtccagttaccccaacggctaccccttcctcttctgggagcagtacatcggcctccgccactggctgctgctgttcatcagcgtggtgttggcctgcacattcctcgtgtgcgctgtcttccttctgaacccctggacggccgggatcattgtgatggtcctggcgctgatgacggtcgagctgttcggcatgatgggcctcatcggaatcaagctcagtgccgtgcccgtggtcatcctgatcgcttctgttggcataggagtggagttcaccgttcacgttgctttggcctttctgacggccatcggcgacaagaaccgcagggctgtgcttgccctggagcacatgtttgcacccgtcctggatggcgccgtgtccactctgctgggagtgctgatgctggcgggatctgagttcgacttcattgtcaggtatttctttgctgtgctggcgatcctcaccatcctcggcgttctcaatgggctggttttgcttcccgtgcttttgtctttctttggaccatatcctgaggtgtctccagccaacggcttgaaccgcctgcccacaccctcccctgagccaccccccagcgtggtccgcttcgccatgccgcccggccacacgcacagcgggtctgattcctccgactcggagtatagttcccagacgacagtgtcaggcctcagcgaggagcttcggcactacgaggcccagcagggcgcgggaggccctgcccaccaagtgatcgtggaagccacagaaaaccccgtcttcgcccactccactgtggtccatcccgaatccaggcatcacccaccctcgaacccgagacagcagccccacctggactcagggtccctgcctcccggacggcaaggccagcagccccgcagggacccccccagagaaggcttgtggccacccccctacagaccgcgcagagacgcttttgaaatttctactgaagggcattctggccctagcaatagggcccgctggggccctcgcggggcccgttctcacaaccctcggaacccagcgtccactgccatgggcagctccgtgcccggctactgccagcccatcaccactgtgacggcttctgcctccgtgactgtcgccgtgcacccgccgcctgtccctgggcctgggcggaacccccgagggggactctgcccaggctaccctgagactgaccacggcctgtttgaggacccccacgtgcctttccacgtccggtgtgagaggagggattcgaaggtggaagtcattgagctgcaggacgtggaatgcgaggagaggccccggggaagcagctccaactgagggtgattaaaatctgaagcaaagaggccaaagattggaaaccccccacccccacctctttccagaactgcttgaagagaactggttggagttatggaaaagatgccctgtgccaggacagcagttcattgttactgtaaccgattgtattattttgttaaatatttctataaatatttaagagatgtacacatgtgtaatataggaaggaaggatgtaaagtggtatgatctggggcttctccactcctgccccagagtgtggaggccacagtggggcctctccgtatttgtgcattgggctccgtgccacaaccaagcttcattagtcttaaatttcagcatatgttgctgctgcttaaatattgtataatttacttgtataattctatgcaaatattgcttatgtaataggattattttgtaaaggtttctgtttaaaatattttaaatttgcatatcacaaccctgtggtagtatgaaatgttactgttaactttcaaacacgctatgcgtgataatttttttgtttaatgagcagatatgaagaaagcacgttaatcctggtggcttctctaggtgtcgttgtgtgcggtcctcttgtttggctgtgcgtgtgaacacgtgtgtgagttcaccatgtactgtactgtgattttttttttgtcttgttttgtttctctacactgtctgtaacctgtagtaggctctgacctagtcaggctggaagcgtcaggatatcttttcttcgtgctggtgagggctggccctaaacatccacctaatcctttcaaatcagcccggcaaaagctagactctcctcgtgtctacggcatctcttatgatcattggctgccatccaggaccccaatttgtgcttcagggggataatctccttctctcggatcattgtgatggatgctggaacctcagggtatggagctcacatcagttcatcatggtgggtgttagagaattcggtgacatgcctagtgctgagccttggctgggccatgagagtctgtatactctaaaaagcatgcagcatggtgcccctcttctgaccaacacacacacgacccctcccccaacacccccaaattcaagagtggatgtggccctgtcacaggtagaaaaacctatttagttaattctttcttggcccacagtctcccagaaatgatgttttgagtccctatagtttaaactccctctcttaaatggagcagctggttgaggctttctagatctgtttgcatcttctttaaaactaagtggtgagcatgcattgtggtgtagaggcaggcattatgtaggataagagctccggggggattcttcatgcaccagtgtttagggtacgtgcttcctaagtaaatccaaacattgtctccatcctccccgtcattagtgctctttcaatgtgatgtgggaaagcaggaggatggacacaccccactgaaagatgtaggcaggggcaggtctctcaaccaggcatatttttaaaagttgcttctgtactggttctcttcttttgctctgaggtgtgggctccctcatctcgtaaccagagaccagcacatgtcagggaagcacccagtgtcggctccccatccaaatccacaccagcaccttgttacagacaagaagtcagaggaaagggcggggtccctgcagggctgaagcctaagctactgtgaggcgctcacgagtggcagctcctgttactcccttttaaattacctgggaaatcttaacagaaaggtaatgggcccccagaaatacccacagcatagtgacctcagaccctgatactcaccacaaaacttttaagatgctgattgggagccgcttgtggctgctgggtgtgtgtgtgtgtgtgtgcgtgcgtgcgtgtgtgtgtgtctctgctggggaccctggccacccccctgctgctgtcttggtgcctgtcacccacatggtctgccatcctaacacccagctctgctcagaaaacgtcctgcgtggaggagggatgatgcagaattctgaagtcgacttccctctggctcctggcgtgccctcgctcccttcctgagcccagctcgtgttgcgccggaggctgcgcggcccctgatttctgcatggtgtagaactttctccaatagtcacattggcaaagggagaactggggtgggcggggggtggggctggcagggaattagaatttctctctctcttttaatagttttattttgtctgtcctgtttgttcatttggatgttttaatttttaaaaaaaaaaaaactttgctgatatttataattttgtatcataagaatgttttcctctacagtatttgtcatgccagtttataacaaaaaaaaatgcagggattttatttctattggaaacattacagctatgttttacttttggacagaatttttatttgtatagagtgcttactaatgttaaatagttcagagtatataacatttacattaaggactcatggtaggttttagggtaaggagtttaaaggaaataaatattcaaactgggtctcattgccaattttggtggaaatgagtttgtgtcatttcaattacaaagataaaagtatgccatataatttatttatatgaagatttatttttgtagtgtacatagtagtcatcaagtcttttgacagaagtatatttttaaagaatttatatgtgatgaatccataatgtctggaactttgctgagacatgagtgggcacagttttcattgtaaattacagcaaggaaagaaaatgtttaacagtgttaagagagtcagagcagagtggatattcatgcgattatgaagtgtttattagttaccattggcgacctagcatgcttctcatttcaaaccttggaaggtgaaaatgtacaaactctctaaataattaatgttcaaacactgatagaaattctaacatgaataaaaaataatataacttgttggttatatctttgtttgtagaatgctttttttctttaaaatacttgggagagacagttagtgttggagccatcagaaactgttgtttcatcttgctgaccttgtgacactcttcttttttgctctatctgatggagagagttttaggttttcctcctttttgttttgtataaatagtgggtataagcatagctctgttacatggatgtattacaaagtgggggctgagcttttagtgtgatcatcacccaaatagtgtacattgtacccattaattaatttcttatcacctgaccctatttttgttttctcataccaagaaacttcctaagttaaccatcaaaattagtccttctgtcatctctcttagcatacttatttcccttatgtgatgcctaataatgagggaacataaataaagccaaattcaaag

SEQ ID NO: 3004 - DNA, 4388 bp, Homo sapiens
ttctttgctgtgctggcgatcctcaccatcctcggcgttctcaatgggctggttttgcttcccgtgcttttgtctttctttggaccatatcctgaggtcagtagtgacacggggatgtcccacgtgtaggccggctgaatgctgtgtttcctgtgccgctcttcacttcgatacttaggtgcctccccacttgctggtggttcttcagtaaacatctcagagtcatgtctgttttcctcttcggtgtactggctttgagggctagagggcgggttcggtttggttcctctaaatcaactgattggcagcctgggtcttacagatctttatacagtaaatgaagactttccccttgagatgcataattggacttcacaagagtaaaaagtacacatcctgcctttccagtgtggagcagaggacagttcttctgctccagctgcgggacctgaaggtcctccaggtggtagagaaggggaggttaatacggcacagtgcgcagggccccagggcagggaacagaggcccctgaaaaataccgtgctttgagctttgagtgtggccagcaggtaaatggacaagaacacttttaacatggaatccccttaaataggtgtctccagccaacggcttgaaccgcctgcccacaccctcccctgagccaccccccagcgtggtccgcttcgccatgccgcccggccacacgcacagcgggtctgattcctccgactcggagtatagttcccagacgacagtgtcaggcctcagcgaggagcttcggcactacgaggcccagcagggcgcgggaggccctgcccaccaagtgatcgtggaagccacagaaaaccccgtcttcgcccactccactgtggtccatcccgaatccaggcatcacccaccctcgaacccgagacagcagccccacctggactcagggtccctgcctcccggacggcaaggccagcagccccgcagggacccccccagagaaggcttgtggccacccccctacagaccgcgcagagacgcttttgaaatttctactgaagggcattctggccctagcaatagggcccgctggggccctcgcggggcccgttctcacaaccctcggaacccagcgtccactgccatgggcagctccgtgcccggctactgccagcccatcaccactgtgacggcttctgcctccgtgactgtcgccgtgcacccgccgcctgtccctgggcctgggcggaacccccgagggggactctgcccaggctaccctgagactgaccacggcctgtttgaggaccccacgtgcctttccacgtccggtgtgagaggagggattcgaaggtggaagtcattgagctgcaggacgtggaatgcgaggagaggccccggggaagcagctccaactgagggtgattaaaatctgaagcaaagaggccaaagattggaaaccccccacccccacctctttccagaactgcttgaagagaactggttggagttatggaaaagatgccctgtgccaggacagcagttcattgttactgtaaccgattgtattattttgttaaatatttctataaatatttaagagatgtacacatgtgtaatataggaaggaaggatgtaaagtggtatgatctggggcttctccactcctgccccagagtgtggaggccacagtggggcctctccgtatttgtgcattgggctccgtgccacaaccaagcttcattagtcttaaatttcagcatatgttgctgctgcttaaatattgtataatttacttgtataattctatgcaaatattgcttatgtaataggattattttgtaaaggtttctgtttaaaatattttaaatttgcatatcacaaccctgtggtagtatgaaatgttactgttaactttcaaacacgctatgcgtgataatttttttgtttaatgagcagatatgaagaaagcacgttaatcctggtggcttctctaggtgtcgttgtgtgcggtcctcttgtttggctgtgcgtgtgaacacgtgtgtgagttcaccatgtactgtactgtgattttttttttgtcttgttttgtttctctacactgtctgtaacctgtagtaggctctgacctagtcaggctggaagcgtcaggatatcttttcttcgtgctggtgagggctggccctaaacatccacctaatcctttcaaatcagcccggcaaaagctagactctcctcgtgtctacggcatctcttatgatcattggctgccatccaggaccccaatttgtgcttcagggggataatctccttctctcggatcattgtgatggatgctggaacctcagggtatggagctcacatcagttcatcatggtgggtgttagagaattcggtgacatgcctagtgctgagccttggctgggccatgagagtctgtatactctaaaaagcatgcagcatggtgcccctcttctgaccaacacacacacgacccctcccccaacacccccaaattcaagagtggatgtggccctgtcacaggtagaaaaacctatttagttaattctttcttggcccacagtctcccagaaatgatgttttgagtccctatagtttaaactccctctcttaaatggagcagctggttgaggctttctagatctgtttgcatcttctttaaaactaagtggtgagcatgcattgtggtgtagaggcaggcattatgtaggataagagctccggggggattcttcatgcaccagtgtttagggtacgtgcttcctaagtaaatccaaacattgtctccatcctccccgtcattagtgctctttcaatgtgatgtgggaaagcaggaggatggacacaccccactgaaagatgtaggcaggggcaggtctctcaaccaggcatatttttaaaagttgcttctgtactggttctcttcttttgctctgaggtgtgggctccctcatctcgtaaccagagaccagcacatgtcagggaagcacccagtgtcggctccccatccaaatccacaccagcaccttgttacagacaagaagtcagaggaaagggcggggtccctgcagggctgaagcctaagctactgtgaggcgctcacgagtggcagctcctgttactcccttttaaattacctgggaaatcttaacagaaaggtaatgggcccccagaaatacccacagcatagtgacctcagaccctgatactcaccacaaaacttttaagatgctgattgggagccgcttgtggctgctgggtgtgtgtgtgtgtgtgtgcgtgcgtgcgtgtgtgtgtgtctctgctggggaccctggccacccccctgctgctgtcttggtgcctgtcacccacatggtctgccatcctaacacccagctctgctcagaaaacgtcctgcgtggaggagggatgatgcagaattctgaagtcgacttccctctggctcctggcgtgccctcgctcccttcctgagcccagctcgtgttgcgccggaggctgcgcggcccctgatttctgcatggtgtagaactttctccaatagtcacattggcaaagggagaactggggtgggcggggggtggggctggcagggaattagaatttctctctctcttttaatagttttattttgtctgtcctgtttgttcatttggatgttttaatttttaaaaaaaaaaaaactttgctgatatttataattttgtatcataagaatgttttcctctacagtatttgtcatgccagtttataacaaaaaaaaatgcagggattttatttctattggaaacattacagctatgttttacttttggacagaatttttatttgtatagagtgcttactaatgttaaatagttcagagtatataacatttacattaaggactcatggtaggttttagggtaaggagtttaaaggaaataaatattcaaactgggtctcattgccaattttggtggaaatgagtttgtgtcatttcaattacaaagataaaagtatgccatataatttatttatatgaagatttatttttgtagtgtacatagtagtcatcaagtcttttgacagaagtatatttttaaagaatttatatgtgatgaatccataatgtctggaactttgctgagacatgagtgggcacagttttcattgtaaattacagcaaggaaagaaaatgtttaacagtgttaagagagtcagagcagagtggatattcatgcgattatgaagtgtttattagttaccattggcgacctagcatgcttctcatttcaaaccttggaaggtgaaaatgtacaaactctctaaataattaatgttcaaacactgatagaaattctaacatgaataaaaaataatataacttgttggtt

SEQ ID NO: 3005 - DNA, 10631 bp, Homo sapiens
gggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaagttggaggacgagtaagtcgtgaattaaattatactcgccagaagattggagaagaggctatgtttaatcctcaactcatgatacagacccctaaagaagaaggtgctaatgtcctgaccacagaagcgctcctacaacacctggactcggcactccaggccagccgtgtccatgtatacatgtacaacagaggtaaacctcctttgcggtggacaaacttcgaccctttggaattcctggaagagttaaagaaaataaactatcaagtggacagctgggaggaaatgctgaataaggctgaggttggtcatggttacatggaccgcccctgcctcaatccggccgatccagactgccccgccacagcccccaacaaaaattcaaccaaacctcttgatatggcccttgttttgaatggtggatgtcatggcttatccagaaagtatatgcactggcaggaggagttgattgtgggtggcacagtcaagaacagcactggaaaactcgtcagcgcccatgccctgcagaccatgttccagttaatgactcccaagcaaatgtacgagcacttcaaggggtacgagtatgtctcacacatcaactggaacgaggacaaagcggcagccatcctggaggcctggcagaggacatatgtggaggtggttcatcagagtgtcgcacagaactccactcaaaaggtgctttccttcaccaccacgaccctggacgacatcctgaaatccttctctgacgtcagtgtcatccgcgtggccagcggctacttactcatgctcgcctatgcctgtctaaccatgctgcgctgggactgctccaagtcccagggtgccgtggggctggctggcgtcctgctggttgcactgtcagtggctgcaggactgggcctgtgctcattgatcggaatttcctttaacgctgcaacaactcaggttttgccatttctcgctcttggtgttggtgtggatgatgtttttcttctggcccacgccttcagtgaaacaggacagaataaaagaatcccttttgaggacaggaccggggagtgcctgaagcgcacaggagccagcgtggccctcacgtccatcagcaatgtcacagccttcttcatggccgcgttaatcccaattcccgctctgcgggcgttctccctccagtacatactgatggctcatcgaggccgactctcctttaatgataccctgtggtgtggtggtctgaaaagctacatgaggtttccttacgaggagtagccttgtagaaaatccagtgcgctaaattctcccaaggcagcggtagtagtggtgttcaattttgccatggttctgctcatttttcctgcaattctcagcatggatttatatcgacgcgaggacaggagactggatattttctgctgttttacaagcccctgcgtcagcagagtgattcaggttgaacctcaggcctacaccgacacacacgacaatacccgctacagccccccacctccctacagcagccacagctttgcccatgaaacgcagattaccatgcagtccactgtccagctccgcacggagtacgacccccacacgcacgtgtactacaccaccgctgagccgcgctccgagatctctgtgcagcccgtcaccgtgacacaggacaccctcagctgccagagcccagagagcaccagctccacaagggacctgctctcccagttctccgactccagcctccactgcctcgagcccccctgtacgaagtggacactctcatcttttgctgagaagcactatgctcctttcctcttgaaaccaaaagccaaggtagtggtgatcttcctttttctgggcttgctgggggtcagcctttatggcaccacccgagtgagagacgggctggaccttacggacattgtacctcgggaaaccagagaatatgactttattgctgcacaattcaaatacttttctttctacaacatgtatatagtcacccagaaagcagactacccgaatatccagcacttactttacgacctacacaggagtttcagtaacgtgaagtatgtcatgttggaagaaaacaaacagcttcccaaaatgtggctgcactacttcagagactggcttcagggacttcaggatgcatttgacagtgactgggaaaccgggaaaatcatgccaaacaattacaagaatggatcagacgatggagtccttgcctacaaactcctggtgcaaaccggcagccgcgataagcccatcgacatcagccagttgactaaacagcgtctggtggatgcagatggcatcattaatcccagcgctttctacatctacctgacggcttgggtcagcaacgaccccgtcgcgtatgctgcctcccaggccaacatccggccacaccgaccagaatgggtccacgacaaagccgactacatgcctgaaacaaggctgagaatcccggcagcagagcccatcgagtatgcccagttccctttctacctcaacggcttgcgggacacctcagactttgtggaggcaattgaaaaagtaaggaccatctgcagcaactatacgagcctggggctgtccagttaccccaacggctaccccttcctcttctgggagcagtacatcggcctccgccactggctgctgctgttcatcagcgtggtgttggcctgcacattcctcgtgtgcgctgtcttccttctgaacccctggacggccgggatcattgtgatggtcctggcgctgatgacggtcgagctgttcggcatgatgggcctcatcggaatcaagctcagtgccgtgcccgtggtcatcctgatcgcttctgttggcataggagtggagttcaccgttcacgttgctttggcctttctgacggccatcggcgacaagaaccgcagggctgtgcttgccctggagcacatgtttgcacccgtcctggatggcgccgtgtccactctgctgggagtgctgatgctggcgggatctgagttcgacttcattgtcaggtaagcaggcgtgtgcaaggagacatgttttagaaatcattgtgattgggccgggtgcagtggctcacgcctgtaatcccagcactttaggaggccgaggcgggtggatcagaaggtcaaggagttcaagaccagcctggccaagatggtgaaactcatctccactcaaaatacaaaaattagccgggcgtggtggtgggtgcctgtaatcccagctacttgggaggctgaggcagagaattgctcgaacccgggaggcggaggttgcagtgagctgagattgcgccactacactccagcctgggtgacagagcgagattctgtctcaaaaaaaaaaatattgttattagctcaggtgatcttcgttgcttatttccttctgtatctggtagattgcagcacctcgtcatcgtgactctgctttcttttgaacttgttaacgtagagatattcggaggtataaagacaagctctcttctagagctgtcttggggagtatcttgaaaacagaaggtaaaggatttggggctggcagcaaagacaactctgcagcttgaagccaaaggatcacccaataggtggcccattattgtctcgggttagaaacactgcagaaagaaatgccacatttgacctacgctccctctccttcaaactgtagaaaggaaaacttaaaaatacctaaaattgtcacctgactttattcttttaagaagtgaaaatgacgtgctcagatttcatattcgagtccccacaattaggaagcatttagcattggactttggtgtcaactcttgggaatctaagcctagtttggatctcaaggcaagtcgtttccagttgatttaattaagaatatgactttgtgaaatataaaagaacagtgagttttccttttgaaaagaatttgagaactgcagaggaggaaaccacttgcttctttgagcagcctccatggctttgtgagggacctgctcttggatagaactctgctactttatggagctctaaggccagaatcaccaataagtaaaagatagtccaggattagaaccatgacagggcagaaccagatgtgagaaatgattggtttgtttggcacgcttcagtactgagaggttgtgtgtgtgtgtgtgtgtgtgtgtgtgtcagagagagagatacgcttcttatcttcaagtaaaaagaagagggtttcaactagaagttttagccaaagttttattacgggaaagagatgagtccattggttggcctgtggcatagcccactgggcaatttggcatcatggaggccgccttcttagaatgagtgccaagcttgcttattgtagtttttgcatagagtgaatggtgaagtggaatcgctgtagaccagcgcttctcacaccgatgtgctgaggaatcatctgagggtctaagtgcagggccgatttcggggggcgggaggtgggatgagggctgggtctgcatctccagctacctccctgcaatgtccatggagctagacttctcagcacaaactactgctaagccagcaagccagttcctaaattcctgtttgccaataccaagtagagagttgcccaactgagttaaatgttttggtctgtgttttattttagttcttagtttgattttagcttttcctttgttcttagtatacactttttcaggcactaacgttatcattatgatataaaagctcaatgtcaagtagagtttcttttgcatatttactttctcgtttaacacaaatataacaagcaccccataagtgccatttgcacaacagcaaataatggggacccccatatccctctgtgtagcctaaggtcttttaggggagagacaagttcacaggcaaaaccaggggaaatgcaaggtgtgctggggtctcatgagttacaggagggtctcgctcagccttgtgggggatgctgaatgaggaaacttagcctgaattagagcccccagctggaaacctggcagctggaatcccagcgctctcctctcagccggggttgttcccgcccagaaatatcagggttcctctttcaagcacttaaaagggcttcccattttctaggatgggatggattaacctgataaaggcctcaccaaggtcaaataaatgagcagacactgtatatgctaagccgtcagaaatctaattggcctgtttatgcttcagctagatggatgggatgcaaatgtcttaatgtggctgctgatacatgccccagccgaaagttccagcagtttacattagaccaagacattggctgcttggtttttactaatgtagttcagaagtttctagtgtttacaatagctgtgaggtatttgtatttttatggggattctctctcctttcatctgatgtcaaaacatatatagacatggcagcactggttgcctgttccattttatgaaccagaggaccattaacagatagatatcttgccccccccttcccagaacatcctgagcctctcccctaccccagcccacttccatcagagttgccctagaaatcattagttccagaaacgcatccctgcgtggagtctgtgccctccagccatgcagagtgtctgccagaggctgtccctggctgacaggtttaccttggtattcatgaaggattccagaccttagccctcaatggtgggaaagcagaactacttctgcactctcctcctctgccatggtgctgcggcctttatgtttgaattggctgacgcaaaacaagagtattcagagatgctaaattgttcaacaaaagattggcccgcagagcagccccgccattgtggagtgccctcacccagcacaatgccccagctcccacagaatgggcagcattttctttgcagaaagctggttcctgtgttctaaaaaggttgcaattggagctatttggtaaaactggaactcacagaattctaggcagaaagttgtgattaatgaaaggccagggaaagccttacctgatatgctagagacttaattagagattctgccgtaagatgcagaagcatttcacagtggattagcagcctgcagaagtgggctgcttttcctcctgggctaaattgtttaaattctacacccttcacttcatttgtttgcttctgctgggttttcacgagcggggcccctcggcattgtgtttgtgctttcagtctgcccagccattcaggtcgcattccatatttttgtgtttgtgtaacacattcataaataacattacatgccatcagagttcagcaaattaacaaactaattttttttttcttcccttcatgaactaacactttgggttgtggaatgtagtcctcaaagtcataaggtaaagaaacaaaaagcaaaaactcaccttgtgttgaatgtgaactgcggttggataacagccttttcagtggggtgggttttgttcatttctggcgttgccatgctgctgtgtcgggcacacggagggtggcgcgatccaccctgtcacagcgcgtgttcccgtttcctcttgatctcccaggtatttctttgctgtgctggcgatcctcaccatcctcggcgttctcaatgggctggttttgcttcccgtgcttttgtctttctttggaccatatcctgaggtgtctccagccaacggcttgaaccgcctgcccacaccctcccctgagccaccccccagcgtggtccgcttcgccatgccgcccggccacacgcacagcgggtctgattcctccgactcggagtatagttcccagacgacagtgtcaggcctcagcgaggagcttcggcactacgaggcccagcagggcgcgggaggccctgcccaccaagtgatcgtggaagccacagaaaaccccgtcttcgcccactccactgtggtccatcccgaatccaggcatcacccaccctcgaacccgagacagcagccccacctggactcagggtccctgcctcccggacggcaaggccagcagccccgcagggacccccccagagaaggcttgtggccacccccctacagaccgcgcagagacgcttttgaaatttctactgaagggcattctggccctagcaatagggcccgctggggccctcgcggggcccgttctcacaaccctcggaacccagcgtccactgccatgggcagctccgtgcccggctactgccagcccatcaccactgtgacggcttctgcctccgtgactgtcgccgtgcacccgccgcctgtccctgggcctgggcggaacccccgagggggactctgcccaggctaccctgagactgaccacggcctgtttgaggacccccacgtgcctttccacgtccggtgtgagaggagggattcgaaggtggaagtcattgagctgcaggacgtggaatgcgaggagaggccccggggaagcagctccaactgagggtgattaaaatctgaagcaaagaggccaaagattggaaaccccccacccccacctctttccagaactgcttgaagagaactggttggagttatggaaaagatgccctgtgccaggacagcagttcattgttactgtaaccgattgtattattttgttaaatatttctataaatatttaagagatgtacacatgtgtaatataggaaggaaggatgtaaagtggtatgatctggggcttctccactcctgccccagagtgtggaggccacagtggggcctctccgtatttgtgcattgggctccgtgccacaaccaagcttcattagtcttaaatttcagcatatgttgctgctgcttaaatattgtataatttacttgtataattctatgcaaatattgcttatgtaataggattattttgtaaaggtttctgtttaaaatattttaaatttgcatatcacaaccctgtggtagtatgaaatgttactgttaactttcaaacacgctatgcgtgataatttttttgtttaatgagcagatatgaagaaagcacgttaatcctggtggcttctctaggtgtcgttgtgtgcggtcctcttgtttggctgtgcgtgtgaacacgtgtgtgagttcaccatgtactgtactgtgattttttttttgtcttgttttgtttctctacactgtctgtaacctgtagtaggctctgacctagtcaggctggaagcgtcaggatatcttttcttcgtgctggtgagggctggccctaaacatccacctaatcctttcaaatcagcccggcaaaagctagactctcctcgtgtctacggcatctcttatgatcattggctgccatccaggaccccaatttgtgcttcagggggataatctccttctctcggatcattgtgatggatgctggaacctcagggtatggagctcacatcagttcatcatggtgggtgttagagaattcggtgacatgcctagtgctgagccttggctgggccatgagagtctgtatactctaaaaagcatgcagcatggtgcccctcttctgaccaacacacacacgacccctcccccaacacccccaaattcaagagtggatgtggccctgtcacaggtagaaaaacctatttagttaattctttcttggcccacagtctcccagaaatgatgttttgagtccctatagtttaaactccctctcttaaatggagcagctggttgaggctttctagatctgtttgcatcttctttaaaactaagtggtgagcatgcattgtggtgtagaggcaggcattatgtaggataagagctccggggggattcttcatgcaccagtgtttagggtacgtgcttcctaagtaaatccaaacattgtctccatcctccccgtcattagtgctctttcaatgtgatgtgggaaagcaggaggatggacacaccccactgaaagatgtaggcaggggcaggtctctcaaccaggcatatttttaaaagttgcttctgtactggttctcttcttttgctctgaggtgtgggctccctcatctcgtaaccagagaccagcacatgtcagggaagcacccagtgtcggctccccatccaaatccacaccagcaccttgttacagacaagaagtcagaggaaagggcggggtccctgcagggctgaagcctaagctactgtgaggcgctcacgagtggcagctcctgttactcccttttaaattacctgggaaatcttaacagaaaggtaatgggcccccagaaatacccacagcatagtgacctcagaccctgatactcaccacaaaacttttaagatgctgattgggagccgcttgtggctgctgggtgtgtgtgtgtgtgtgtgcgtgcgtgcgtgtgtgtgtgtctctgctggggaccctggccacccccctgctgctgtcttggtgcctgtcacccacatggtctgccatcctaacacccagctctgctcagaaaacgtcctgcgtggaggagggatgatgcagaattctgaagtcgacttccctctggctcctggcgtgccctcgctcccttcctgagcccagctcgtgttgcgccggaggctgcgcggcccctgatttctgcatggtgtagaactttctccaatagtcacattggcaaagggagaactggggtgggcggggggtggggctggcagggaattagaatttctctctctcttttaatagttttattttgtctgtcctgtttgttcatttggatgttttaatttttaaaaaaaaaaaaactttgctgatatttataattttgtatcataagaatgttttcctctacagtatttgtcatgccagtttataacaaaaaaaaatgcagggattttatttctattggaaacattacagctatgttttacttttggacagaatttttatttgtatagagtgcttactaatgttaaatagttcagagtatataacatttacattaaggactcatggtaggttttagggtaaggagtttaaaggaaataaatattcaaactgggtctcattgccaattttggtggaaatgagtttgtgtcatttcaattacaaagataaaagtatgccatataatttatttatatgaagatttatttttgtagtgtacatagtagtcatcaagtcttttgacagaagtatatttttaaagaatttatatgtgatgaatccataatgtctggaactttgctgagacatgagtgggcacagttttcattgtaaattacagcaaggaaagaaaatgtttaacagtgttaagagagtcagagcagagtggatattcatgcgattatgaagtgtttattagttaccattggcgacctagcatgcttctcatttcaaaccttggaaggtgaaaatgtacaaactctctaaataattaatgttcaaacactgatagaaattctaacatgaataaaaaataatataacttgttggtt

SEQ ID NO: 3006 - DNA, 7815 bp, Homo sapiens
aattcagctcacacagcctctccccacgctatggaaatgcgtcgggagtgaactccggcggccgcgctcaccacgtggatccccacttactaccattctcggcgggggtccagttgggggaacccgcaatatgttgttccaaagagcgctcgcccctagcgcccgtccccgagggtgatggacagagcaggactggtttgctggctcctgaaccttgggctccatcgctgggattacgcagcccctcccttctcagctctggggggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaagttggaggacgagtaagtcgtgaattaaattatactcgccagaagattggagaagaggctatgtttaatcctcaactcatgatacagacccctaaagaagaaggtgctaatgtcctgaccacagaagcgctcctacaacacctggactcggcactccaggccagccgtgtccatgtatacatgtacaacaggcagtggaaattggaacatttgtgttacaaatcaggagagcttatcacagaaacaggttacatggatcagataatagaatatctttacccttgtttgattattacacctttggactgcttctgggaaggggcgaaattacagtctgggacagcatacctcctaggtaaacctcctttgcggtggacaaacttcgaccctttggaattcctggaagagttaaagaaaataaactatcaagtggacagctgggaggaaatgctgaataaggctgaggttggtcatggttacatggaccgcccctgcctcaatccggccgatccagactgccccgccacagcccccaacaaaaattcaaccaaacctcttgatatggcccttgttttgaatggtggatgtcatggcttatccagaaagtatatgcactggcaggaggagttgattgtgggtggcacagtcaagaacagcactggaaaactcgtcagcgcccatgccctgcagaccatgttccagttaatgactcccaagcaaatgtacgagcacttcaaggggtacgagtatgtctcacacatcaactggaacgaggacaaagcggcagccatcctggaggcctggcagaggacatatgtggaggtggttcatcagagtgtcgcacagaactccactcaaaaggtgctttccttcaccaccacgaccctggacgacatcctgaaatccttctctgacgtcagtgtcatccgcgtggccagcggctacttactcatgctcgcctatgcctgtctaaccatgctgcgctgggactgctccaagtcccagggtgccgtggggctggctggcgtcctgctggttgcactgtcagtggctgcaggactgggcctgtgctcattgatcggaatttcctttaacgctgcaacaactcaggttttgccatttctcgctcttggtgttggtgtggatgatgtttttcttctggcccacgccttcagtgaaacaggacagaataaaagaatcccttttgaggacaggaccggggagtgcctgaagcgcacaggagccagcgtggccctcacgtccatcagcaatgtcacagccttcttcatggccgcgttaatcccaattcccgctctgcgggcgttctccctccaggcagcggtagtagtggtgttcaattttgccatggttctgctcatttttcctgcaattctcagcatggatttatatcgacgcgaggacaggagactggatattttctgctgttttacaagcccctgcgtcagcagagtgattcaggttgaacctcaggcctacaccgacacacacgacaatacccgctacagccccccacctccctacagcagccacagctttgcccatgaaacgcagattaccatgcagtccactgtccagctccgcacggagtacgacccccacacgcacgtgtactacaccaccgctgagccgcgctccgagatctctgtgcagcccgtcaccgtgacacaggacaccctcagctgccagagcccagagagcaccagctccacaagggacctgctctcccagttctccgactccagcctccactgcctcgagcccccctgtacgaagtggacactctcatcttttgctgagaagcactatgctcctttcctcttgaaaccaaaagccaaggtagtggtgatcttcctttttctgggcttgctgggggtcagcctttatggcaccacccgagtgagagacgggctggaccttacggacattgtacctcgggaaaccagagaatatgactttattgctgcacaattcaaatacttttctttctacaacatgtatatagtcacccagaaagcagactacccgaatatccagcacttactttacgacctacacaggagtttcagtaacgtgaagtatgtcatgttggaagaaaacaaacagcttcccaaaatgtggctgcactacttcagagactggcttcagggacttcaggatgcatttgacagtgactgggaaaccgggaaaatcatgccaaacaattacaagaatggatcagacgatggagtccttgcctacaaactcctggtgcaaaccggcagccgcgataagcccatcgacatcagccagttgactaaacagcgtctggtggatgcagatggcatcattaatcccagcgctttctacatctacctgacggcttgggtcagcaacgaccccgtcgcgtatgctgcctcccaggccaacatccggccacaccgaccagaatgggtccacgacaaagccgactacatgcctgaaacaaggctgagaatcccggcagcagagcccatcgagtatgcccagttccctttctacctcaacggcttgcgggacacctcagactttgtggaggcaattgaaaaagtaaggaccatctgcagcaactatacgagcctggggctgtccagttaccccaacggctaccccttcctcttctgggagcagtacatcggcctccgccactggctgctgctgttcatcagcgtggtgttggcctgcacattcctcgtgtgcgctgtcttccttctgaacccctggacggccgggatcattgtgatggtcctggcgctgatgacggtcgagctgttcggcatgatgggcctcatcggaatcaagctcagtgccgtgcccgtggtcatcctgatcgcttctgttggcataggagtggagttcaccgttcacgttgctttggcctttctgacggccatcggcgacaagaaccgcagggctgtgcttgccctggagcacatgtttgcacccgtcctggatggcgccgtgtccactctgctgggagtgctgatgctggcgggatctgagttcgacttcattgtcaggtatttctttgctgtgctggcgatcctcaccatcctcggcgttctcaatgggctggttttgcttcccgtgcttttgtctttctttggaccatatcctgaggtgtctccagccaacggcttgaaccgcctgcccacaccctcccctgagccaccccccagcgtggtccgcttcgccatgccgcccggccacacgcacagcgggtctgattcctccgactcggagtatagttcccagacgacagtgtcaggcctcagcgaggagcttcggcactacgaggcccagcagggcgcgggaggccctgcccaccaagtgatcgtggaagccacagaaaaccccgtcttcgcccactccactgtggtccatcccgaatccaggcatcacccaccctcgaacccgagacagcagccccacctggactcagggtccctgcctcccggacggcaaggccagcagccccgcagggacccccccagagaaggcttgtggccacccccctacagaccgcgcagagacgcttttgaaatttctactgaagggcattctggccctagcaatagggcccgctggggccctcgcggggcccgttctcacaaccctcggaacccagcgtccactgccatgggcagctccgtgcccggctactgccagcccatcaccactgtgacggcttctgcctccgtgactgtcgccgtgcacccgccgcctgtccctgggcctgggcggaacccccgagggggactctgcccaggctaccctgagactgaccacggcctgtttgaggacccccacgtgcctttccacgtccggtgtgagaggagggattcgaaggtggaagtcattgagctgcaggacgtggaatgcgaggagaggccccggggaagcagctccaactgagggtgattaaaatctgaagcaaagaggccaaagattggaaaccccccacccccacctctttccagaactgcttgaagagaactggttggagttatggaaaagatgccctgtgccaggacagcagttcattgttactgtaaccgattgtattattttgttaaatatttctataaatatttaagagatgtacacatgtgtaatataggaaggaaggatgtaaagtggtatgatctggggcttctccactcctgccccagagtgtggaggccacagtggggcctctccgtatttgtgcattgggctccgtgccacaaccaagcttcattagtcttaaatttcagcatatgttgctgctgcttaaatattgtataatttacttgtataattctatgcaaatattgcttatgtaataggattattttgtaaaggtttctgtttaaaatattttaaatttgcatatcacaaccctgtggtagtatgaaatgttactgttaactttcaaacacgctatgcgtgataatttttttgtttaatgagcagatatgaagaaagcacgttaatcctggtggcttctctaggtgtcgttgtgtgcggtcctcttgtttggctgtgcgtgtgaacacgtgtgtgagttcaccatgtactgtactgtgattttttttttgtcttgttttgtttctctacactgtctgtaacctgtagtaggctctgacctagtcaggctggaagcgtcaggatatcttttcttcgtgctggtgagggctggccctaaacatccacctaatcctttcaaatcagcccggcaaaagctagactctcctcgtgtctacggcatctcttatgatcattggctgccatccaggaccccaatttgtgcttcagggggataatctccttctctcggatcattgtgatggatgctggaacctcagggtatggagctcacatcagttcatcatggtgggtgttagagaattcggtgacatgcctagtgctgagccttggctgggccatgagagtctgtatactctaaaaagcatgcagcatggtgcccctcttctgaccaacacacacacgacccctcccccaacacccccaaattcaagagtggatgtggccctgtcacaggtagaaaaacctatttagttaattctttcttggcccacagtctcccagaaatgatgttttgagtccctatagtttaaactccctctcttaaatggagcagctggttgaggctttctagatctgtttgcatcttctttaaaactaagtggtgagcatgcattgtggtgtagaggcaggcattatgtaggataagagctccggggggattcttcatgcaccagtgtttagggtacgtgcttcctaagtaaatccaaacattgtctccatcctccccgtcattagtgctctttcaatgtgatgtgggaaagcaggaggatggacacaccccactgaaagatgtaggcaggggcaggtctctcaaccaggcatatttttaaaagttgcttctgtactggttctcttcttttgctctgaggtgtgggctccctcatctcgtaaccagagaccagcacatgtcagggaagcacccagtgtcggctccccatccaaatccacaccagcaccttgttacagacaagaagtcagaggaaagggcggggtccctgcagggctgaagcctaagctactgtgaggcgctcacgagtggcagctcctgttactcccttttaaattacctgggaaatcttaacagaaaggtaatgggcccccagaaatacccacagcatagtgacctcagaccctgatactcaccacaaaacttttaagatgctgattgggagccgcttgtggctgctgggtgtgtgtgtgtgtgtgtgcgtgcgtgcgtgtgtgtgtgtctctgctggggaccctggccacccccctgctgctgtcttggtgcctgtcacccacatggtctgccatcctaacacccagctctgctcagaaaacgtcctgcgtggaggagggatgatgcagaattctgaagtcgacttccctctggctcctggcgtgccctcgctcccttcctgagcccagctcgtgttgcgccggaggctgcgcggcccctgatttctgcatggtgtagaactttctccaatagtcacattggcaaagggagaactggggtgggcggggggtggggctggcagggaattagaatttctctctctcttttaatagttttattttgtctgtcctgtttgttcatttggatgttttaatttttaaaaaaaaaaaaactttgctgatatttataattttgtatcataagaatgttttcctctacagtatttgtcatgccagtttataacaaaaaaaaatgcagggattttatttctattggaaacattacagctatgttttacttttggacagaatttttatttgtatagagtgcttactaatgttaaatagttcagagtatataacatttacattaaggactcatggtaggttttagggtaaggagtttaaaggaaataaatattcaaactgggtctcattgccaattttggtggaaatgagtttgtgtcatttcaattacaaagataaaagtatgccatataatttatttatatgaagatttatttttgtagtgtacatagtagtcatcaagtcttttgacagaagtatatttttaaagaatttatatgtgatgaatccataatgtctggaactttgctgagacatgagtgggcacagttttcattgtaaattacagcaaggaaagaaaatgtttaacagtgttaagagagtcagagcagagtggatattcatgcgattatgaagtgtttattagttaccattggcgacctagcatgcttctcatttcaaaccttggaaggtgaaaatgtacaaactctctaaataattaatgttcaaacactgatagaaattctaacatgaataaaaaataatataacttgttggttatatctttgtttgtagaatgctttttttctttaaaatacttgggagagacagttagtgttggagccatcagaaactgttgtttcatcttgctgaccttgtgacactcttcttttttgctctatctgatggagagagttttaggttttcctcctttttgttttgtataaatagtgggtataagcatagctctgttacatggatgtattacaaagtgggggctgagcttttagtgtgatcatcacccaaatagtgtacattgtacccattaattaatttcttatcacctgaccctatttttgttttctcataccaagaaacttcctaagttaaccatcaaaattagtccttctgtcatctctcttagcatacttatttcccttatgtgatgcctaataatgagggaacataaataaagccaaattcaaag

SEQ ID NO: 3007 - DNA, 7659 bp, Homo sapiens
actcacacctctccaggaaaagcagcagacaaatggggattgaaaaattcaaaccctccctctggtcctgggaggaaagggctgtctgaggtccgcagggggtggaggggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaagttggaggacgagtaagtcgtgaattaaattatactcgccagaagattggagaagaggctatgtttaatcctcaactcatgatacagacccctaaagaagaaggtgctaatgtcctgaccacagaagcgctcctacaacacctggactcggcactccaggccagccgtgtccatgtatacatgtacaacaggcagtggaaattggaacatttgtgttacaaatcaggagagcttatcacagaaacaggttacatggatcagataatagaatatctttacccttgtttgattattacacctttggactgcttctgggaaggggcgaaattacagtctgggacagcatacctcctaggtaaacctcctttgcggtggacaaacttcgaccctttggaattcctggaagagttaaagaaaataaactatcaagtggacagctgggaggaaatgctgaataaggctgaggttggtcatggttacatggaccgcccctgcctcaatccggccgatccagactgccccgccacagcccccaacaaaaattcaaccaaacctcttgatatggcccttgttttgaatggtggatgtcatggcttatccagaaagtatatgcactggcaggaggagttgattgtgggtggcacagtcaagaacagcactggaaaactcgtcagcgcccatgccctgcagaccatgttccagttaatgactcccaagcaaatgtacgagcacttcaaggggtacgagtatgtctcacacatcaactggaacgaggacaaagcggcagccatcctggaggcctggcagaggacatatgtggaggtggttcatcagagtgtcgcacagaactccactcaaaaggtgctttccttcaccaccacgaccctggacgacatcctgaaatccttctctgacgtcagtgtcatccgcgtggccagcggctacttactcatgctcgcctatgcctgtctaaccatgctgcgctgggactgctccaagtcccagggtgccgtggggctggctggcgtcctgctggttgcactgtcagtggctgcaggactgggcctgtgctcattgatcggaatttcctttaacgctgcaacaactcaggttttgccatttctcgctcttggtgttggtgtggatgatgtttttcttctggcccacgccttcagtgaaacaggacagaataaaagaatcccttttgaggacaggaccggggagtgcctgaagcgcacaggagccagcgtggccctcacgtccatcagcaatgtcacagccttcttcatggccgcgttaatcccaattcccgctctgcgggcgttctccctccaggcagcggtagtagtggtgttcaattttgccatggttctgctcatttttcctgcaattctcagcatggatttatatcgacgcgaggacaggagactggatattttctgctgttttacaagcccctgcgtcagcagagtgattcaggttgaacctcaggcctacaccgacacacacgacaatacccgctacagccccccacctccctacagcagccacagctttgcccatgaaacgcagattaccatgcagtccactgtccagctccgcacggagtacgacccccacacgcacgtgtactacaccaccgctgagccgcgctccgagatctctgtgcagcccgtcaccgtgacacaggacaccctcagctgccagagcccagagagcaccagctccacaagggacctgctctcccagttctccgactccagcctccactgcctcgagcccccctgtacgaagtggacactctcatcttttgctgagaagcactatgctcctttcctcttgaaaccaaaagccaaggtagtggtgatcttcctttttctgggcttgctgggggtcagcctttatggcaccacccgagtgagagacgggctggaccttacggacattgtacctcgggaaaccagagaatatgactttattgctgcacaattcaaatacttttctttctacaacatgtatatagtcacccagaaagcagactacccgaatatccagcacttactttacgacctacacaggagtttcagtaacgtgaagtatgtcatgttggaagaaaacaaacagcttcccaaaatgtggctgcactacttcagagactggcttcagggacttcaggatgcatttgacagtgactgggaaaccgggaaaatcatgccaaacaattacaagaatggatcagacgatggagtccttgcctacaaactcctggtgcaaaccggcagccgcgataagcccatcgacatcagccagttgactaaacagcgtctggtggatgcagatggcatcattaatcccagcgctttctacatctacctgacggcttgggtcagcaacgaccccgtcgcgtatgctgcctcccaggccaacatccggccacaccgaccagaatgggtccacgacaaagccgactacatgcctgaaacaaggctgagaatcccggcagcagagcccatcgagtatgcccagttccctttctacctcaacggcttgcgggacacctcagactttgtggaggcaattgaaaaagtaaggaccatctgcagcaactatacgagcctggggctgtccagttaccccaacggctaccccttcctcttctgggagcagtacatcggcctccgccactggctgctgctgttcatcagcgtggtgttggcctgcacattcctcgtgtgcgctgtcttccttctgaacccctggacggccgggatcattgtgatggtcctggcgctgatgacggtcgagctgttcggcatgatgggcctcatcggaatcaagctcagtgccgtgcccgtggtcatcctgatcgcttctgttggcataggagtggagttcaccgttcacgttgctttggcctttctgacggccatcggcgacaagaaccgcagggctgtgcttgccctggagcacatgtttgcacccgtcctggatggcgccgtgtccactctgctgggagtgctgatgctggcgggatctgagttcgacttcattgtcaggtatttctttgctgtgctggcgatcctcaccatcctcggcgttctcaatgggctggttttgcttcccgtgcttttgtctttctttggaccatatcctgaggtgtctccagccaacggcttgaaccgcctgcccacaccctcccctgagccaccccccagcgtggtccgcttcgccatgccgcccggccacacgcacagcgggtctgattcctccgactcggagtatagttcccagacgacagtgtcaggcctcagcgaggagcttcggcactacgaggcccagcagggcgcgggaggccctgcccaccaagtgatcgtggaagccacagaaaaccccgtcttcgcccactccactgtggtccatcccgaatccaggcatcacccaccctcgaacccgagacagcagccccacctggactcagggtccctgcctcccggacggcaaggccagcagccccgcagggacccccccagagaaggcttgtggccacccccctacagaccgcgcagagacgcttttgaaatttctactgaagggcattctggccctagcaatagggcccgctggggccctcgcggggcccgttctcacaaccctcggaacccagcgtccactgccatgggcagctccgtgcccggctactgccagcccatcaccactgtgacggcttctgcctccgtgactgtcgccgtgcacccgccgcctgtccctgggcctgggcggaacccccgagggggactctgcccaggctaccctgagactgaccacggcctgtttgaggacccccacgtgcctttccacgtccggtgtgagaggagggattcgaaggtggaagtcattgagctgcaggacgtggaatgcgaggagaggccccggggaagcagctccaactgagggtgattaaaatctgaagcaaagaggccaaagattggaaaccccccacccccacctctttccagaactgcttgaagagaactggttggagttatggaaaagatgccctgtgccaggacagcagttcattgttactgtaaccgattgtattattttgttaaatatttctataaatatttaagagatgtacacatgtgtaatataggaaggaaggatgtaaagtggtatgatctggggcttctccactcctgccccagagtgtggaggccacagtggggcctctccgtatttgtgcattgggctccgtgccacaaccaagcttcattagtcttaaatttcagcatatgttgctgctgcttaaatattgtataatttacttgtataattctatgcaaatattgcttatgtaataggattattttgtaaaggtttctgtttaaaatattttaaatttgcatatcacaaccctgtggtagtatgaaatgttactgttaactttcaaacacgctatgcgtgataatttttttgtttaatgagcagatatgaagaaagcacgttaatcctggtggcttctctaggtgtcgttgtgtgcggtcctcttgtttggctgtgcgtgtgaacacgtgtgtgagttcaccatgtactgtactgtgattttttttttgtcttgttttgtttctctacactgtctgtaacctgtagtaggctctgacctagtcaggctggaagcgtcaggatatcttttcttcgtgctggtgagggctggccctaaacatccacctaatcctttcaaatcagcccggcaaaagctagactctcctcgtgtctacggcatctcttatgatcattggctgccatccaggaccccaatttgtgcttcagggggataatctccttctctcggatcattgtgatggatgctggaacctcagggtatggagctcacatcagttcatcatggtgggtgttagagaattcggtgacatgcctagtgctgagccttggctgggccatgagagtctgtatactctaaaaagcatgcagcatggtgcccctcttctgaccaacacacacacgacccctcccccaacacccccaaattcaagagtggatgtggccctgtcacaggtagaaaaacctatttagttaattctttcttggcccacagtctcccagaaatgatgttttgagtccctatagtttaaactccctctcttaaatggagcagctggttgaggctttctagatctgtttgcatcttctttaaaactaagtggtgagcatgcattgtggtgtagaggcaggcattatgtaggataagagctccggggggattcttcatgcaccagtgtttagggtacgtgcttcctaagtaaatccaaacattgtctccatcctccccgtcattagtgctctttcaatgtgatgtgggaaagcaggaggatggacacaccccactgaaagatgtaggcaggggcaggtctctcaaccaggcatatttttaaaagttgcttctgtactggttctcttcttttgctctgaggtgtgggctccctcatctcgtaaccagagaccagcacatgtcagggaagcacccagtgtcggctccccatccaaatccacaccagcaccttgttacagacaagaagtcagaggaaagggcggggtccctgcagggctgaagcctaagctactgtgaggcgctcacgagtggcagctcctgttactcccttttaaattacctgggaaatcttaacagaaaggtaatgggcccccagaaatacccacagcatagtgacctcagaccctgatactcaccacaaaacttttaagatgctgattgggagccgcttgtggctgctgggtgtgtgtgtgtgtgtgtgcgtgcgtgcgtgtgtgtgtgtctctgctggggaccctggccacccccctgctgctgtcttggtgcctgtcacccacatggtctgccatcctaacacccagctctgctcagaaaacgtcctgcgtggaggagggatgatgcagaattctgaagtcgacttccctctggctcctggcgtgccctcgctcccttcctgagcccagctcgtgttgcgccggaggctgcgcggcccctgatttctgcatggtgtagaactttctccaatagtcacattggcaaagggagaactggggtgggcggggggtggggctggcagggaattagaatttctctctctcttttaatagttttattttgtctgtcctgtttgttcatttggatgttttaatttttaaaaaaaaaaaaactttgctgatatttataattttgtatcataagaatgttttcctctacagtatttgtcatgccagtttataacaaaaaaaaatgcagggattttatttctattggaaacattacagctatgttttacttttggacagaatttttatttgtatagagtgcttactaatgttaaatagttcagagtatataacatttacattaaggactcatggtaggttttagggtaaggagtttaaaggaaataaatattcaaactgggtctcattgccaattttggtggaaatgagtttgtgtcatttcaattacaaagataaaagtatgccatataatttatttatatgaagatttatttttgtagtgtacatagtagtcatcaagtcttttgacagaagtatatttttaaagaatttatatgtgatgaatccataatgtctggaactttgctgagacatgagtgggcacagttttcattgtaaattacagcaaggaaagaaaatgtttaacagtgttaagagagtcagagcagagtggatattcatgcgattatgaagtgtttattagttaccattggcgacctagcatgcttctcatttcaaaccttggaaggtgaaaatgtacaaactctctaaataattaatgttcaaacactgatagaaattctaacatgaataaaaaataatataacttgttggttatatctttgtttgtagaatgctttttttctttaaaatacttgggagagacagttagtgttggagccatcagaaactgttgtttcatcttgctgaccttgtgacactcttcttttttgctctatctgatggagagagttttaggttttcctcctttttgttttgtataaatagtgggtataagcatagctctgttacatggatgtattacaaagtgggggctgagcttttagtgtgatcatcacccaaatagtgtacattgtacccattaattaatttcttatcacctgaccctatttttgttttctcataccaagaaacttcctaagttaaccatcaaaattagtccttctgtcatctctcttagcatacttatttcccttatgtgatgcctaataatgagggaacataaataaagccaaattcaaag

SEQ ID NO: 3008 - DNA, 6563 bp, Homo sapiens
gaaggcgagcacccagacgggggcccgccggggccgcggccagcgccggggaaatgccgcgccggggagcagcctgcgccggcctgagcccttccctttgcactcggctgttttttacgtttaaccagaaaggaagggagaggagggaaagatccatgtggctgccctcttccgatcacaaatattgtcgggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaagttggaggacgagtaagtcgtgaattaaattatactcgccagaagattggagaagaggctatgtttaatcctcaactcatgatacagacccctaaagaagaaggtgctaatgtcctgaccacagaagcgctcctacaacacctggactcggcactccaggccagccgtgtccatgtatacatgtacaacaggcagtggaaattggaacatttgtgttacaaatcaggagagcttatcacagaaacaggttacatggatcagataatagaatatctttacccttgtttgattattacacctttggactgcttctgggaaggggcgaaattacagtctgggacagcatacctcctaggtaaacctcctttgcggtggacaaacttcgaccctttggaattcctggaagagttaaagaaaataaactatcaagtggacagctgggaggaaatgctgaataaggctgaggttggtcatggttacatggaccgcccctgcctcaatccggccgatccagactgccccgccacagcccccaacaaaaattcaaccaaacctcttgatatggcccttgttttgaatggtggatgtcatggcttatccagaaagtatatgcactggcaggaggagttgattgtgggtggcacagtcaagaacagcactggaaaactcgtcagcgcccatgccctgcagaccatgttccagttaatgactcccaagcaaatgtacgagcacttcaaggggtacgagtatgtctcacacatcaactggaacgaggacaaagcggcagccatcctggaggcctggcagaggacatatgtggaggtggttcatcagagtgtcgcacagaactccactcaaaaggtgctttccttcaccaccacgaccctggacgacatcctgaaatccttctctgacgtcagtgtcatccgcgtggccagcggctacttactcatgctcgcctatgcctgtctaaccatgctgcgctgggactgctccaagtcccagggtgccgtggggctggctggcgtcctgctggttgcactgtcagtggctgcaggactgggcctgtgctcattgatcggaatttcctttaacgctgcaacaactcaggttttgccatttctcgctcttggtgttggtgtggatgatgtttttcttctggcccacgccttcagtgaaacaggacagaataaaagaatcccttttgaggacaggaccggggagtgcctgaagcgcacaggagccagcgtggccctcacgtccatcagcaatgtcacagccttcttcatggccgcgttaatcccaattcccgctctgcgggcgttctccctccaggcagcggtagtagtggtgttcaattttgccatggttctgctcatttttcctgcaattctcagcatggatttatatcgacgcgaggacaggagactggatattttctgctgttttacaagcccctgcgtcagcagagtgattcaggttgaacctcaggcctacaccgacacacacgacaatacccgctacagccccccacctccctacagcagccacagctttgcccatgaaacgcagattaccatgcagtccactgtccagctccgcacggagtacgacccccacacgcacgtgtactacaccaccgctgagccgcgctccgagatctctgtgcagcccgtcaccgtgacacaggacaccctcagctgccagagcccagagagcaccagctccacaagggacctgctctcccagttctccgactccagcctccactgcctcgagcccccctgtacgaagtggacactctcatcttttgctgagaagcactatgctcctttcctcttgaaaccaaaagccaaggtagtggtgatcttcctttttctgggcttgctgggggtcagcctttatggcaccacccgagtgagagacgggctggaccttacggacattgtacctcgggaaaccagagaatatgactttattgctgcacaattcaaatacttttctttctacaacatgtatatagtcacccagaaagcagactacccgaatatccagcacttactttacgacctacacaggagtttcagtaacgtgaagtatgtcatgttggaagaaaacaaacagcttcccaaaatgtggctgcactacttcagagactggcttcagggacttcaggatgcatttgacagtgactgggaaaccgggaaaatcatgccaaacaattacaagaatggatcagacgatggagtccttgcctacaaactcctggtgcaaaccggcagccgcgataagcccatcgacatcagccagttgactaaacagcgtctggtggatgcagatggcatcattaatcccagcgctttctacatctacctgacggcttgggtcagcaacgaccccgtcgcgtatgctgcctcccaggccaacatccggccacaccgaccagaatgggtccacgacaaagccgactacatgcctgaaacaaggctgagaatcccggcagcagagcccatcgagtatgcccagttccctttctacctcaacggcttgcgggacacctcagactttgtggaggcaattgaaaaagtaaggaccatctgcagcaactatacgagcctggggctgtccagttaccccaacggctaccccttcctcttctgggagcagtacatcggcctccgccactggctgctgctgttcatcagcgtggtgttggcctgcacattcctcgtgtgcgctgtcttccttctgaacccctggacggccgggatcattgtgatggtcctggcgctgatgacggtcgagctgttcggcatgatgggcctcatcggaatcaagctcagtgccgtgcccgtggtcatcctgatcgcttctgttggcataggagtggagttcaccgttcacgttgctttggcctttctgacggccatcggcgacaagaaccgcagggctgtgcttgccctggagcacatgtttgcacccgtcctggatggcgccgtgtccactctgctgggagtgctgatgctggcgggatctgagttcgacttcattgtcaggtatttctttgctgtgctggcgatcctcaccatcctcggcgttctcaatgggctggttttgcttcccgtgcttttgtctttctttggaccatatcctgaggtgtctccagccaacggcttgaaccgcctgcccacaccctcccctgagccaccccccagcgtggtccgcttcgccatgccgcccggccacacgcacagcgggtctgattcctccgactcggagtatagttcccagacgacagtgtcaggcctcagcgaggagcttcggcactacgaggcccagcagggcgcgggaggccctgcccaccaagtgatcgtggaagccacagaaaaccccgtcttcgcccactccactgtggtccatcccgaatccaggcatcacccaccctcgaacccgagacagcagccccacctggactcagggtccctgcctcccggacggcaaggccagcagccccgcagggacccccccagagaaggcttgtggccacccccctacagaccgcgcagagacgcttttgaaatttctactgaagggcattctggccctagcaatagggcccgctggggccctcgcggggcccgttctcacaaccctcggaacccagcgtccactgccatgggcagctccgtgcccggctactgccagcccatcaccactgtgacggcttctgcctccgtgactgtcgccgtgcacccgccgcctgtccctgggcctgggcggaacccccgagggggactctgcccaggctaccctgagactgaccacggcctgtttgaggacccccacgtgcctttccacgtccggtgtgagaggagggattcgaaggtggaagtcattgagctgcaggacgtggaatgcgaggagaggccccggggaagcagctccaactgagggtgattaaaatctgaagcaaagaggccaaagattggaaaccccccacccccacctctttccagaactgcttgaagagaactggttggagttatggaaaagatgccctgtgccaggacagcagttcattgttactgtaaccgattgtattattttgttaaatatttctataaatatttaagagatgtacacatgtgtaatataggaaggaaggatgtaaagtggtatgatctggggcttctccactcctgccccagagtgtggaggccacagtggggcctctccgtatttgtgcattgggctccgtgccacaaccaagcttcattagtcttaaatttcagcatatgttgctgctgcttaaatattgtataatttacttgtataattctatgcaaatattgcttatgtaataggattattttgtaaaggtttctgtttaaaatattttaaatttgcatatcacaaccctgtggtagtatgaaatgttactgttaactttcaaacacgctatgcgtgataatttttttgtttaatgagcagatatgaagaaagcacgttaatcctggtggcttctctaggtgtcgttgtgtgcggtcctcttgtttggctgtgcgtgtgaacacgtgtgtgagttcaccatgtactgtactgtgattttttttttgtcttgttttgtttctctacactgtctgtaacctgtagtaggctctgacctagtcaggctggaagcgtcaggatatcttttcttcgtgctggtgagggctggccctaaacatccacctaatcctttcaaatcagcccggcaaaagctagactctcctcgtgtctacggcatctcttatgatcattggctgccatccaggaccccaatttgtgcttcagggggataatctccttctctcggatcattgtgatggatgctggaacctcagggtatggagctcacatcagttcatcatggtgggtgttagagaattcggtgacatgcctagtgctgagccttggctgggccatgagagtctgtatactctaaaaagcatgcagcatggtgcccctcttctgaccaacacacacacgacccctcccccaacacccccaaattcaagagtggatgtggccctgtcacaggtagaaaaacctatttagttaattctttcttggcccacagtctcccagaaatgatgttttgagtccctatagtttaaactccctctcttaaatggagcagctggttgaggctttctagatctgtttgcatcttctttaaaactaagtggtgagcatgcattgtggtgtagaggcaggcattatgtaggataagagctccggggggattcttcatgcaccagtgtttagggtacgtgcttcctaagtaaatccaaacattgtctccatcctccccgtcattagtgctctttcaatgtgatgtgggaaagcaggaggatggacacaccccactgaaagatgtaggcaggggcaggtctctcaaccaggcatatttttaaaagttgcttctgtactggttctcttcttttgctctgaggtgtgggctccctcatctcgtaaccagagaccagcacatgtcagggaagcacccagtgtcggctccccatccaaatccacaccagcaccttgttacagacaagaagtcagaggaaagggcggggtccctgcagggctgaagcctaagctactgtgaggcgctcacgagtggcagctcctgttactcccttttaaattacctgggaaatcttaacagaaaggtaatgggcccccagaaatacccacagcatagtgacctcagaccctgatactcaccacaaaacttttaagatgctgattgggagccgcttgtggctgctgggtgtgtgtgtgtgtgtgtgcgtgcgtgcgtgtgtgtgtgtctctgctggggaccctggccacccccctgctgctgtcttggtgcctgtcacccacatggtctgccatcctaacacccagctctgctcagaaaacgtcctgcgtggaggagggatgatgcagaattctgaagtcgacttccctctggctcctggcgtgccctcgctcccttcctgagcccagctcgtgttgcgccggaggctgcgcggcccctgatttctgcatggtgtagaactttctccaatagtcacattggcaaagggagaactggggtgggcggggggtggggctggcagggaattagaatttctctctctcttttaatagtt

SEQ ID NO: 3009 - DNA, 8232 bp, Homo sapiens
cggccgcggggggcggggagagggtggctaggctcgcgggagctcgccgggcagggcgcctcccaggaaggcggggaggggagcgcctgtttacccaggagggctgtgctgatagcacgttcctcgagtttactttgctttccttgagtttattgtaaaggggtaaagttttcggatccgtcacgtgaccctgacaggtcctgcctatggcgcggcagaccacccacgccgagggccatggaactgcttaatagaaacaggcttgtaattgtgagtccgcgctgcactccgccgaaagcctccggcggcccagcgcgccggggtttttacactttccgttccttttgtaaagacggaggaggaggagaagaagaagaagaaaacggaggagaagaaaaagacgacaggggagacaaagagacccgcagcgacaaggcaagggggagacgagggaagactgggagaagacggaggagcggaggacgaggaaaggggggccagggaaaaaaaaggaattgatgtgaaatccaagcccagcgtccgcgccatcggcacccgcgctccgagcaggggttgacggccggctatggggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaagttggaggacgagtaagtcgtgaattaaattatactcgccagaagattggagaagaggctatgtttaatcctcaactcatgatacagacccctaaagaagaaggtgctaatgtcctgaccacagaagcgctcctacaacacctggactcggcactccaggccagccgtgtccatgtatacatgtacaacaggcagtggaaattggaacatttgtgttacaaatcaggagagcttatcacagaaacaggttacatggatcagataatagaatatctttacccttgtttgattattacacctttggactgcttctgggaaggggcgaaattacagtctgggacagcatacctcctaggtaaacctcctttgcggtggacaaacttcgaccctttggaattcctggaagagttaaagaaaataaactatcaagtggacagctgggaggaaatgctgaataaggctgaggttggtcatggttacatggaccgcccctgcctcaatccggccgatccagactgccccgccacagcccccaacaaaaattcaaccaaacctcttgatatggcccttgttttgaatggtggatgtcatggcttatccagaaagtatatgcactggcaggaggagttgattgtgggtggcacagtcaagaacagcactggaaaactcgtcagcgcccatgccctgcagaccatgttccagttaatgactcccaagcaaatgtacgagcacttcaaggggtacgagtatgtctcacacatcaactggaacgaggacaaagcggcagccatcctggaggcctggcagaggacatatgtggaggtggttcatcagagtgtcgcacagaactccactcaaaaggtgctttccttcaccaccacgaccctggacgacatcctgaaatccttctctgacgtcagtgtcatccgcgtggccagcggctacttactcatgctcgcctatgcctgtctaaccatgctgcgctgggactgctccaagtcccagggtgccgtggggctggctggcgtcctgctggttgcactgtcagtggctgcaggactgggcctgtgctcattgatcggaatttcctttaacgctgcaacaactcaggttttgccatttctcgctcttggtgttggtgtggatgatgtttttcttctggcccacgccttcagtgaaacaggacagaataaaagaatcccttttgaggacaggaccggggagtgcctgaagcgcacaggagccagcgtggccctcacgtccatcagcaatgtcacagccttcttcatggccgcgttaatcccaattcccgctctgcgggcgttctccctccaggcagcggtagtagtggtgttcaattttgccatggttctgctcatttttcctgcaattctcagcatggatttatatcgacgcgaggacaggagactggatattttctgctgttttacaagcccctgcgtcagcagagtgattcaggttgaacctcaggcctacaccgacacacacgacaatacccgctacagccccccacctccctacagcagccacagctttgcccatgaaacgcagattaccatgcagtccactgtccagctccgcacggagtacgacccccacacgcacgtgtactacaccaccgctgagccgcgctccgagatctctgtgcagcccgtcaccgtgacacaggacaccctcagctgccagagcccagagagcaccagctccacaagggacctgctctcccagttctccgactccagcctccactgcctcgagcccccctgtacgaagtggacactctcatcttttgctgagaagcactatgctcctttcctcttgaaaccaaaagccaaggtagtggtgatcttcctttttctgggcttgctgggggtcagcctttatggcaccacccgagtgagagacgggctggaccttacggacattgtacctcgggaaaccagagaatatgactttattgctgcacaattcaaatacttttctttctacaacatgtatatagtcacccagaaagcagactacccgaatatccagcacttactttacgacctacacaggagtttcagtaacgtgaagtatgtcatgttggaagaaaacaaacagcttcccaaaatgtggctgcactacttcagagactggcttcagggacttcaggatgcatttgacagtgactgggaaaccgggaaaatcatgccaaacaattacaagaatggatcagacgatggagtccttgcctacaaactcctggtgcaaaccggcagccgcgataagcccatcgacatcagccagttgactaaacagcgtctggtggatgcagatggcatcattaatcccagcgctttctacatctacctgacggcttgggtcagcaacgaccccgtcgcgtatgctgcctcccaggccaacatccggccacaccgaccagaatgggtccacgacaaagccgactacatgcctgaaacaaggctgagaatcccggcagcagagcccatcgagtatgcccagttccctttctacctcaacggcttgcgggacacctcagactttgtggaggcaattgaaaaagtaaggaccatctgcagcaactatacgagcctggggctgtccagttaccccaacggctaccccttcctcttctgggagcagtacatcggcctccgccactggctgctgctgttcatcagcgtggtgttggcctgcacattcctcgtgtgcgctgtcttccttctgaacccctggacggccgggatcattgtgatggtcctggcgctgatgacggtcgagctgttcggcatgatgggcctcatcggaatcaagctcagtgccgtgcccgtggtcatcctgatcgcttctgttggcataggagtggagttcaccgttcacgttgctttggcctttctgacggccatcggcgacaagaaccgcagggctgtgcttgccctggagcacatgtttgcacccgtcctggatggcgccgtgtccactctgctgggagtgctgatgctggcgggatctgagttcgacttcattgtcaggtatttctttgctgtgctggcgatcctcaccatcctcggcgttctcaatgggctggttttgcttcccgtgcttttgtctttctttggaccatatcctgaggtgtctccagccaacggcttgaaccgcctgcccacaccctcccctgagccaccccccagcgtggtccgcttcgccatgccgcccggccacacgcacagcgggtctgattcctccgactcggagtatagttcccagacgacagtgtcaggcctcagcgaggagcttcggcactacgaggcccagcagggcgcgggaggccctgcccaccaagtgatcgtggaagccacagaaaaccccgtcttcgcccactccactgtggtccatcccgaatccaggcatcacccaccctcgaacccgagacagcagccccacctggactcagggtccctgcctcccggacggcaaggccagcagccccgcagggacccccccagagaaggcttgtggccacccccctacagaccgcgcagagacgcttttgaaatttctactgaagggcattctggccctagcaatagggcccgctggggccctcgcggggcccgttctcacaaccctcggaacccagcgtccactgccatgggcagctccgtgcccggctactgccagcccatcaccactgtgacggcttctgcctccgtgactgtcgccgtgcacccgccgcctgtccctgggcctgggcggaacccccgagggggactctgcccaggctaccctgagactgaccacggcctgtttgaggacccccacgtgcctttccacgtccggtgtgagaggagggattcgaaggtggaagtcattgagctgcaggacgtggaatgcgaggagaggccccggggaagcagctccaactgaggtgagtgccactgacaagggcagccaagggacctagagccaggcaaagaggaggacaaggttctcctggggttctcggcatccccgaggggctgtggcgctcgggcacatcccacgctggaccccagtgaccttttatccccagagcaaggctgatgtgtccaagctttgtcatccttggggaaccagtccagctccacactgctctcttcccccactgctaacctgcggagggtcggtgcagcgccacaaggacacaaacagcaccaccttttaccaatatttgccagtctttatggaggtgcatgccacagcgaattggtcacatgggaacgcatccgtgtaaccagcccccagatgaagggagaggtcacaagcagcccccagggacacctcaggcccacaccccactctcgtgatttctaataccaaggttactgctgcctgcttttgtactttataaatacggacttgcacacctcttactctgttcaacttccttttttgcttccttttaaagggtgattaaaatctgaagcaaagaggccaaagattggaaaccccccacccccacctctttccagaactgcttgaagagaactggttggagttatggaaaagatgccctgtgccaggacagcagttcattgttactgtaaccgattgtattattttgttaaatatttctataaatatttaagagatgtacacatgtgtaatataggaaggaaggatgtaaagtggtatgatctggggcttctccactcctgccccagagtgtggaggccacagtggggcctctccgtatttgtgcattgggctccgtgccacaaccaagcttcattagtcttaaatttcagcatatgttgctgctgcttaaatattgtataatttacttgtataattctatgcaaatattgcttatgtaataggattattttgtaaaggtttctgtttaaaatattttaaatttgcatatcacaaccctgtggtagtatgaaatgttactgttaactttcaaacacgctatgcgtgataatttttttgtttaatgagcagatatgaagaaagcacgttaatcctggtggcttctctaggtgtcgttgtgtgcggtcctcttgtttggctgtgcgtgtgaacacgtgtgtgagttcaccatgtactgtactgtgattttttttttgtcttgttttgtttctctacactgtctgtaacctgtagtaggctctgacctagtcaggctggaagcgtcaggatatcttttcttcgtgctggtgagggctggccctaaacatccacctaatcctttcaaatcagcccggcaaaagctagactctcctcgtgtctacggcatctcttatgatcattggctgccatccaggaccccaatttgtgcttcagggggataatctccttctctcggatcattgtgatggatgctggaacctcagggtatggagctcacatcagttcatcatggtgggtgttagagaattcggtgacatgcctagtgctgagccttggctgggccatgagagtctgtatactctaaaaagcatgcagcatggtgcccctcttctgaccaacacacacacgacccctcccccaacacccccaaattcaagagtggatgtggccctgtcacaggtagaaaaacctatttagttaattctttcttggcccacagtctcccagaaatgatgttttgagtccctatagtttaaactccctctcttaaatggagcagctggttgaggctttctagatctgtttgcatcttctttaaaactaagtggtgagcatgcattgtggtgtagaggcaggcattatgtaggataagagctccggggggattcttcatgcaccagtgtttagggtacgtgcttcctaagtaaatccaaacattgtctccatcctccccgtcattagtgctctttcaatgtgatgtgggaaagcaggaggatggacacaccccactgaaagatgtaggcaggggcaggtctctcaaccaggcatatttttaaaagttgcttctgtactggttctcttcttttgctctgaggtgtgggctccctcatctcgtaaccagagaccagcacatgtcagggaagcacccagtgtcggctccccatccaaatccacaccagcaccttgttacagacaagaagtcagaggaaagggcggggtccctgcagggctgaagcctaagctactgtgaggcgctcacgagtggcagctcctgttactcccttttaaattacctgggaaatcttaacagaaaggtaatgggcccccagaaatacccacagcatagtgacctcagaccctgatactcaccacaaaacttttaagatgctgattgggagccgcttgtggctgctgggtgtgtgtgtgtgtgtgtgcgtgcgtgcgtgtgtgtgtgtctctgctggggaccctggccacccccctgctgctgtcttggtgcctgtcacccacatggtctgccatcctaacacccagctctgctcagaaaacgtcctgcgtggaggagggatgatgcagaattctgaagtcgacttccctctggctcctggcgtgccctcgctcccttcctgagcccagctcgtgttgcgccggaggctgcgcggcccctgatttctgcatggtgtagaactttctccaatagtcacattggcaaagggagaactggggtgggcggggggtggggctggcagggaattagaatttctctctctcttttaatagttttattttgtctgtcctgtttgttcatttggatgttttaatttttaaaaaaaaaaaaactttgctgatatttataattttgtatcataagaatgttttcctctacagtatttgtcatgccagtttataacaaaaaaaaatgcagggattttatttctattggaaacattacagctatgttttacttttggacagaatttttatttgtatagagtgcttactaatgttaaatagttcagagtatataacatttacattaaggactcatggtaggttttagggtaaggagtttaaaggaaataaatattcaaactgggtctcattgccaattttggtggaaatgagtttgtgtcatttcaattacaaagataaaagtatgccatataatttatttatatgaagatttatttttgtagtgtacatagtagtcatcaagtcttttgacagaagtatatttttaaagaatttatatgtgatgaatccataatgtctggaactttgctgagacatgagtgggcacagttttcattgtaaattacagcaaggaaagaaaatgtttaacagtgttaagagagtcagagcagagtggatattcatgcgattatgaagtgtttattagttaccattggcgacctagcatgcttctcatttcaaaccttggaaggtgaaaatgtacaaactctctaaataattaatgttcaaacactgatagaaattctaacatgaataaaaaataatataacttgttggtt

SEQ ID NO: 3010 - DNA, 8049 bp, Homo sapiens
acccaggagggctgtgctgatagcacgttcctcgagtttactttgctttccttgagtttattgtaaaggggtaaagttttcggatccgtcacgtgaccctgacaggtcctgcctatggcgcggcagaccacccacgccgagggccatggaactgcttaatagaaacaggcttgtaattgtgagtccgcgctgcactccgccgaaagcctccggcggcccagcgcgccggggtttttacactttccgttccttttgtaaagacggaggaggaggagaagaagaagaagaaaacggaggagaagaaaaagacgacaggggagacaaagagacccgcagcgacaaggcaagggggagacgagggaagactgggagaagacggaggagcggaggacgaggaaaggggggccagggaaaaaaaaggaattgatgtgaaatccaagcccagcgtccgcgccatcggcacccgcgctccgagcaggggttgacggccggctatggggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaagttggaggacgagtaagtcgtgaattaaattatactcgccagaagattggagaagaggctatgtttaatcctcaactcatgatacagacccctaaagaagaaggtgctaatgtcctgaccacagaagcgctcctacaacacctggactcggcactccaggccagccgtgtccatgtatacatgtacaacaggcagtggaaattggaacatttgtgttacaaatcaggagagcttatcacagaaacaggttacatggatcagataatagaatatctttacccttgtttgattattacacctttggactgcttctgggaaggggcgaaattacagtctgggacagcatacctcctaggtaaacctcctttgcggtggacaaacttcgaccctttggaattcctggaagagttaaagaaaataaactatcaagtggacagctgggaggaaatgctgaataaggctgaggttggtcatggttacatggaccgcccctgcctcaatccggccgatccagactgccccgccacagcccccaacaaaaattcaaccaaacctcttgatatggcccttgttttgaatggtggatgtcatggcttatccagaaagtatatgcactggcaggaggagttgattgtgggtggcacagtcaagaacagcactggaaaactcgtcagcgcccatgccctgcagaccatgttccagttaatgactcccaagcaaatgtacgagcacttcaaggggtacgagtatgtctcacacatcaactggaacgaggacaaagcggcagccatcctggaggcctggcagaggacatatgtggaggtggttcatcagagtgtcgcacagaactccactcaaaaggtgctttccttcaccaccacgaccctggacgacatcctgaaatccttctctgacgtcagtgtcatccgcgtggccagcggctacttactcatgctcgcctatgcctgtctaaccatgctgcgctgggactgctccaagtcccagggtgccgtggggctggctggcgtcctgctggttgcactgtcagtggctgcaggactgggcctgtgctcattgatcggaatttcctttaacgctgcaacaactcaggttttgccatttctcgctcttggtgttggtgtggatgatgtttttcttctggcccacgccttcagtgaaacaggacagaataaaagaatcccttttgaggacaggaccggggagtgcctgaagcgcacaggagccagcgtggccctcacgtccatcagcaatgtcacagccttcttcatggccgcgttaatcccaattcccgctctgcgggcgttctccctccaggcagcggtagtagtggtgttcaattttgccatggttctgctcatttttcctgcaattctcagcatggatttatatcgacgcgaggacaggagactggatattttctgctgttttacaagcccctgcgtcagcagagtgattcaggttgaacctcaggcctacaccgacacacacgacaatacccgctacagccccccacctccctacagcagccacagctttgcccatgaaacgcagattaccatgcagtccactgtccagctccgcacggagtacgacccccacacgcacgtgtactacaccaccgctgagccgcgctccgagatctctgtgcagcccgtcaccgtgacacaggacaccctcagctgccagagcccagagagcaccagctccacaagggacctgctctcccagttctccgactccagcctccactgcctcgagcccccctgtacgaagtggacactctcatcttttgctgagaagcactatgctcctttcctcttgaaaccaaaagccaaggtagtggtgatcttcctttttctgggcttgctgggggtcagcctttatggcaccacccgagtgagagacgggctggaccttacggacattgtacctcgggaaaccagagaatatgactttattgctgcacaattcaaatacttttctttctacaacatgtatatagtcacccagaaagcagactacccgaatatccagcacttactttacgacctacacaggagtttcagtaacgtgaagtatgtcatgttggaagaaaacaaacagcttcccaaaatgtggctgcactacttcagagactggcttcagggacttcaggatgcatttgacagtgactgggaaaccgggaaaatcatgccaaacaattacaagaatggatcagacgatggagtccttgcctacaaactcctggtgcaaaccggcagccgcgataagcccatcgacatcagccagttgactaaacagcgtctggtggatgcagatggcatcattaatcccagcgctttctacatctacctgacggcttgggtcagcaacgaccccgtcgcgtatgctgcctcccaggccaacatccggccacaccgaccagaatgggtccacgacaaagccgactacatgcctgaaacaaggctgagaatcccggcagcagagcccatcgagtatgcccagttccctttctacctcaacggcttgcgggacacctcagactttgtggaggcaattgaaaaagtaaggaccatctgcagcaactatacgagcctggggctgtccagttaccccaacggctaccccttcctcttctgggagcagtacatcggcctccgccactggctgctgctgttcatcagcgtggtgttggcctgcacattcctcgtgtgcgctgtcttccttctgaacccctggacggccgggatcattgtgatggtcctggcgctgatgacggtcgagctgttcggcatgatgggcctcatcggaatcaagctcagtgccgtgcccgtggtcatcctgatcgcttctgttggcataggagtggagttcaccgttcacgttgctttggcctttctgacggccatcggcgacaagaaccgcagggctgtgcttgccctggagcacatgtttgcacccgtcctggatggcgccgtgtccactctgctgggagtgctgatgctggcgggatctgagttcgacttcattgtcaggtatttctttgctgtgctggcgatcctcaccatcctcggcgttctcaatgggctggttttgcttcccgtgcttttgtctttctttggaccatatcctgaggtgtctccagccaacggcttgaaccgcctgcccacaccctcccctgagccaccccccagcgtggtccgcttcgccatgccgcccggccacacgcacagcgggtctgattcctccgactcggagtatagttcccagacgacagtgtcaggcctcagcgaggagcttcggcactacgaggcccagcagggcgcgggaggccctgcccaccaagtgatcgtggaagccacagaaaaccccgtcttcgcccactccactgtggtccatcccgaatccaggcatcacccaccctcgaacccgagacagcagccccacctggactcagggtccctgcctcccggacggcaaggccagcagccccgcagggacccccccagagaaggcttgtggccacccccctacagaccgcgcagagacgcttttgaaatttctactgaagggcattctggccctagcaatagggcccgctggggccctcgcggggcccgttctcacaaccctcggaacccagcgtccactgccatgggcagctccgtgcccggctactgccagcccatcaccactgtgacggcttctgcctccgtgactgtcgccgtgcacccgccgcctgtccctgggcctgggcggaacccccgagggggactctgcccaggctaccctgagactgaccacggcctgtttgaggacccccacgtgcctttccacgtccggtgtgagaggagggattcgaaggtggaagtcattgagctgcaggacgtggaatgcgaggagaggccccggggaagcagctccaactgagggtgattaaaatctgaagcaaagaggccaaagattggaaaccccccacccccacctctttccagaactgcttgaagagaactggttggagttatggaaaagatgccctgtgccaggacagcagttcattgttactgtaaccgattgtattattttgttaaatatttctataaatatttaagagatgtacacatgtgtaatataggaaggaaggatgtaaagtggtatgatctggggcttctccactcctgccccagagtgtggaggccacagtggggcctctccgtatttgtgcattgggctccgtgccacaaccaagcttcattagtcttaaatttcagcatatgttgctgctgcttaaatattgtataatttacttgtataattctatgcaaatattgcttatgtaataggattattttgtaaaggtttctgtttaaaatattttaaatttgcatatcacaaccctgtggtagtatgaaatgttactgttaactttcaaacacgctatgcgtgataatttttttgtttaatgagcagatatgaagaaagcacgttaatcctggtggcttctctaggtgtcgttgtgtgcggtcctcttgtttggctgtgcgtgtgaacacgtgtgtgagttcaccatgtactgtactgtgattttttttttgtcttgttttgtttctctacactgtctgtaacctgtagtaggctctgacctagtcaggctggaagcgtcaggatatcttttcttcgtgctggtgagggctggccctaaacatccacctaatcctttcaaatcagcccggcaaaagctagactctcctcgtgtctacggcatctcttatgatcattggctgccatccaggaccccaatttgtgcttcagggggataatctccttctctcggatcattgtgatggatgctggaacctcagggtatggagctcacatcagttcatcatggtgggtgttagagaattcggtgacatgcctagtgctgagccttggctgggccatgagagtctgtatactctaaaaagcatgcagcatggtgcccctcttctgaccaacacacacacgacccctcccccaacacccccaaattcaagagtggatgtggccctgtcacaggtagaaaaacctatttagttaattctttcttggcccacagtctcccagaaatgatgttttgagtccctatagtttaaactccctctcttaaatggagcagctggttgaggctttctagatctgtttgcatcttctttaaaactaagtggtgagcatgcattgtggtgtagaggcaggcattatgtaggataagagctccggggggattcttcatgcaccagtgtttagggtacgtgcttcctaagtaaatccaaacattgtctccatcctccccgtcattagtgctctttcaatgtgatgtgggaaagcaggaggatggacacaccccactgaaagatgtaggcaggggcaggtctctcaaccaggcatatttttaaaagttgcttctgtactggttctcttcttttgctctgaggtgtgggctccctcatctcgtaaccagagaccagcacatgtcagggaagcacccagtgtcggctccccatccaaatccacaccagcaccttgttacagacaagaagtcagaggaaagggcggggtccctgcagggctgaagcctaagctactgtgaggcgctcacgagtggcagctcctgttactcccttttaaattacctgggaaatcttaacagaaaggtaatgggcccccagaaatacccacagcatagtgacctcagaccctgatactcaccacaaaacttttaagatgctgattgggagccgcttgtggctgctgggtgtgtgtgtgtgtgtgtgcgtgcgtgcgtgtgtgtgtgtctctgctggggaccctggccacccccctgctgctgtcttggtgcctgtcacccacatggtctgccatcctaacacccagctctgctcagaaaacgtcctgcgtggaggagggatgatgcagaattctgaagtcgacttccctctggctcctggcgtgccctcgctcccttcctgagcccagctcgtgttgcgccggaggctgcgcggcccctgatttctgcatggtgtagaactttctccaatagtcacattggcaaagggagaactggggtgggcggggggtggggctggcagggaattagaatttctctctctcttttaatagttttattttgtctgtcctgtttgttcatttggatgttttaatttttaaaaaaaaaaaaactttgctgatatttataattttgtatcataagaatgttttcctctacagtatttgtcatgccagtttataacaaaaaaaaatgcagggattttatttctattggaaacattacagctatgttttacttttggacagaatttttatttgtatagagtgcttactaatgttaaatagttcagagtatataacatttacattaaggactcatggtaggttttagggtaaggagtttaaaggaaataaatattcaaactgggtctcattgccaattttggtggaaatgagtttgtgtcatttcaattacaaagataaaagtatgccatataatttatttatatgaagatttatttttgtagtgtacatagtagtcatcaagtcttttgacagaagtatatttttaaagaatttatatgtgatgaatccataatgtctggaactttgctgagacatgagtgggcacagttttcattgtaaattacagcaaggaaagaaaatgtttaacagtgttaagagagtcagagcagagtggatattcatgcgattatgaagtgtttattagttaccattggcgacctagcatgcttctcatttcaaaccttggaaggtgaaaatgtacaaactctctaaataattaatgttcaaacactgatagaaattctaacatgaataaaaaataatataacttgttggttatatctttgtttgtagaatgctttttttctttaaaatacttgggagagacagttagtgttggagccatcagaaactgttgtttcatcttgctgaccttgtgacactcttcttttttgctctatctgatggagagagttttaggttttcctcctttttgttttgtataaatagtgggtataagcatagctctgttacatggatgtattacaaagtgggggctgagcttttagtgtgatcatcacccaaatagtgtacattgtacccattaattaatttcttatcacctgaccctatttttgttttctcataccaagaaacttcctaagttaaccatcaaaattagtccttctgtcatctctcttagcatacttatttcccttatgtgatgcctaataatgagggaacataaataaagccaaattcaaag

SEQ ID NO: 3011 - DNA, 919 bp, Homo sapiens
acccaggagggctgtgctgatagcacgttcctcgagtttactttgctttccttgagtttattgtaaaggggtaaagttttcggatccgtcacgtgaccctgacaggtcctgcctatggcgcggcagaccacccacgccgagggccatggaactgcttaatagaaacaggcttgtaattgtgagtccgcgctgcactccgccgaaagcctccggcggcccagcgcgccggggtttttacactttccgttccttttgtaaagacggaggaggaggagaagaagaagaagaaaacggaggagaagaaaaagacgacaggggagacaaagagacccgcagcgacaaggcaagggggagacgagggaagactgggagaagacggaggagcggaggacgaggaaaggggggccagggaaaaaaaaggaattgatgtgaaatccaagcccagcgtccgcgccatcggcacccgcgctccgagcaggggttgacggccggctatggggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaagaggtaaacctcctttgcggtggacaaacttcgaccctttggaattcctggaagagttaaagaaaataaactatcaagtggacagctgggaggaaatgctgaataaggctgaggttggtcatggttacatggaccgcccctgcctcaatccggccgatccagactgccccgccacagcccccaacaaaaattcaaccaaacctcttgatatggcccttgttttgaatggt

SEQ ID NO: 3012 - DNA, 864 bp, Homo sapiens
actcacacctctccaggaaaagcagcagacaaatggggattgaaaaattcaaaccctccctctggtcctgggaggaaagggctgtctgaggggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaagttggaggacgagtaagtcgtgaattaaattatactcgccagaagattggagaagaggctatgtttaatcctcaactcatgatacagacccctaaagaagaaggtgctaatgtcctgaccacagaagcgctcctacaacacctggactcggcactccaggccagccgtgtccatgtatacatgtacaacaggcagtggaaattggaacatttgtgttacaaatcaggagagcttatcacagaaacaggttacatggatcagataatagaatatctttacccttgtttgattattacacctttggactgcttctgggaaggggcgaaattacagtctgggacagcatacctcctaggtaaacctcctttgcggtggacaaacttcgaccctttggaattcctggaagagttaaagaaaataaactatcaagtggacagctgggaggaaatgctgaataaggctgaggttggtcatggttacatggaccgcccctgcctcaatccggccgatccagactgccccgccacagcccccaacaaaaattcaaccaaacctcttgatatggcccttgttttgaatggt

SEQ ID NO: 3013 - DNA, 881 bp, Homo sapiens
actcacacctctccaggaaaagcagcagacaaatggggattgaaaaattcaaaccctccctctggtcctgggaggaaagggctgtctgaggtccgcagggggtggaggggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaagttggaggacgagtaagtcgtgaattaaattatactcgccagaagattggagaagaggctatgtttaatcctcaactcatgatacagacccctaaagaagaaggtgctaatgtcctgaccacagaagcgctcctacaacacctggactcggcactccaggccagccgtgtccatgtatacatgtacaacaggcagtggaaattggaacatttgtgttacaaatcaggagagcttatcacagaaacaggttacatggatcagataatagaatatctttacccttgtttgattattacacctttggactgcttctgggaaggggcgaaattacagtctgggacagcatacctcctaggtaaacctcctttgcggtggacaaacttcgaccctttggaattcctggaagagttaaagaaaataaactatcaagtggacagctgggaggaaatgctgaataaggctgaggttggtcatggttacatggaccgcccctgcctcaatccggccgatccagactgccccgccacagcccccaacaaaaattcaaccaaacctcttgatatggcccttgttttgaatggt

SEQ ID NO: 3014 - DNA, 539 bp, Homo sapiens
ttcgtccccaggggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaagttggaggacgagtaagtcgtgaattaaattatactcgccagaagattggagaagaggctatgtttaatcctcaactcatgatacagacccctaaagaagaaggtgctaatgtcctgaccacagaagcgctcctacaacacctggactcggcactccaggccagccgtgtccatgtatacatgtacaacaggcagtggaaattggaacatttgtgttacaaatcaggagagcttatcacagaaacaggttacatggatcagataatagaatatctttacccttgtttgattattacacctttggactgcttctgggaaggggcgaaattacagtct

SEQ ID NO: 3015 - DNA, 809 bp, Homo sapiens
atccatgtggctgccctcttccgatcacaaatattgggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaagttggaggacgagtaagtcgtgaattaaattatactcgccagaagattggagaagaggctatgtttaatcctcaactcatgatacagacccctaaagaagaaggtgctaatgtcctgaccacagaagcgctcctacaacacctggactcggcactccaggccagccgtgtccatgtatacatgtacaacaggcagtggaaattggaacatttgtgttacaaatcaggagagcttatcacagaaacaggttacatggatcagataatagaatatctttacccttgtttgattattacacctttggactgcttctgggaaggggcgaaattacagtctgggacagcatacctcctaggtaaacctcctttgcggtggacaaacttcgaccctttggaattcctggaagagttaaagaaaataaactatcaagtggacagctgggaggaaatgctgaataaggctgaggttggtcatggttacatggaccgcccctgcctcaatccggccgatccagactgccccgccacagcccccaacaaaaattcaaccaaacctcttgatatggcccttgttttgaatggt

SEQ ID NO: 3016 - DNA, 1037 bp, Homo sapiens
aattcagctcacacagcctctccccacgctatggaaatgcgtcgggagtgaactccggcggccgcgctcaccacgtggatccccacttactaccattctcggcgggggtccagttgggggaacccgcaatatgttgttccaaagagcgctcgcccctagcgcccgtccccgagggtgatggacagagcaggactggtttgctggctcctgaaccttgggctccatcgctgggattacgcagcccctcccttctcagctctggggggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaagttggaggacgagtaagtcgtgaattaaattatactcgccagaagattggagaagaggctatgtttaatcctcaactcatgatacagacccctaaagaagaaggtgctaatgtcctgaccacagaagcgctcctacaacacctggactcggcactccaggccagccgtgtccatgtatacatgtacaacaggcagtggaaattggaacatttgtgttacaaatcaggagagcttatcacagaaacaggttacatggatcagataatagaatatctttacccttgtttgattattacacctttggactgcttctgggaaggggcgaaattacagtctgggacagcatacctcctaggtaaacctcctttgcggtggacaaacttcgaccctttggaattcctggaagagttaaagaaaataaactatcaagtggacagctgggaggaaatgctgaataaggctgaggttggtcatggttacatggaccgcccctgcctcaatccggccgatccagactgccccgccacagcccccaacaaaaattcaaccaaacctcttgatatggcccttgttttgaatggt

SEQ ID NO: 3017 - DNA, 3785 bp, Homo sapiens
ggcgggcgcgggcgcgggcgcgcgcggcggcggcgcgttccgttccgggccgaggctcgcggcggaaaagttgcggggcatagacgagcggccccgggacgggcagctagcgcgaccctgagccggcgcccgtggtccggccatggacgacctcgacgccctgctggcggacttggagtctaccacctcccacatctccaaacggcctgtgttcttgtcggaggagaccccctactcatacccaactggaaaccacacataccaggagattgccgtgccaccccccgtccccccacccccgtccagcgaggccctcaatggcacaatccttgaccccttagaccagtggcagcccagcagctcccgattcatccaccagcagcctcagtcctcatcacctgtgtacggctccagtgccaaaacttccagtgtctccaaccctcaggacagtgttggctctccgtgctcccgagtgggtgaggaggagcacgtctacagcttccccaacaagcagaaatcagctgagccttcacccaccgtaatgagcacgtccctgggcagcaacctttctgaactcgaccgcctgctgctggaactgaacgctgtacagcataacccgccaggcttccctgcagatgaggccaactcaagccccccgcttcctggggccctgagccccctctatggtgtcccagagactaacagccccttgggaggcaaagctgggcccctgacgaaagagaagcctaagcggaatgggggccggggcctggaggacgtgcggcccagtgtggagagtctcttggatgaactggagagctccgtgcccagccccgtccctgccatcactgtgaaccagggcgagatgagcagcccgcagcgcgtcacctccacccaacagcagacacgcatctcggcctcctctgccaccagggagctggacgagctgatggcttcgctgtcggatttcaagatccagggcctggagcaaagagcggatggggagcggtgctgggcggccggctggcctcgggacggcgggcggagcagccccggagggcaggacgagggagggttcatggcccaggggaagacagggagcagctcaccccctggggggcccccgaagcccgggagccagctggacagcatgctggggagcctgcagtctgacctgaacaagctgggggtcgccacagtcgccaaaggagtctgcggggcctgcaagaagcccatcgccgggcaggttgtgaccgccatggggaagacgtggcaccccgagcacttcgtctgcacccactgccaggaggagatcggatcccggaacttcttcgagcgggatggacagccctactgtgaaaaggactaccacaacctcttctccccgcgctgctactactgcaacggccccatcctggataaagtggtgacagcccttgaccggacgtggcaccctgaacacttcttctgtgcacagtgtggagccttctttggtcccgaagggttccacgagaaggacggcaaggcctactgtcgcaaggactacttcgacatgttcgcacccaagtgtggcggctgcgcccgggccatcctggagaactatatctcagccctcaacacgctgtggcatcctgagtgctttgtgtgccgggaatgcttcacgccattcgtgaacggcagcttcttcgagcacgacgggcagccctactgtgaggtgcactaccacgagcggcgcggctcgctgtgttctggctgccagaagcccatcaccggccgctgcatcaccgccatggccaagaagttccaccccgagcacttcgtctgtgccttctgcctcaagcagctcaacaagggcaccttcaaggagcagaacgacaagccttactgtcagaactgcttcctcaagctcttctgctaggtgccctgcccctgtctctgccccccttccccagccagcatccccaactgcgactgtgacctagagacttcacccgggggtgaaggggtaaacccgactgaaactggaacccttgtcctccgctggtgcgggatggacagagggccgtgaggggtccccctgcttgtcttcacccctgccagagcctctgggccccctcctccctcctgtagctctccctaggctgcccactctccatcctccccaggggtagaggctgggggctccaccccagcccatgtacgtccccacgaactggcctggccagcaccccacactggagccatctcttcctcatatttcagcagtgcagccggggggcagggaagggcaggcagggtctgttggggtctctttttatccttattcctcccccgacctaattgtctttgttctgtgattattgggggacacccggctccctccagacaatgccagcataaatccatccatccaaaggcagagaaccaaaggggccatggaaggttctctgtgctcctcctacccttccagtgccctaggcctggcgactgcccctgccttttagacccgccctccccttttatacctgctcttgttctactgagaaaagcctctccagcaataatgttttctagtcacttcctccgtctccgggacggcgtgcctggacactgtaccgactttgatagatttctacactgaggtttgaattcatatcgcctgagttgcttttacttctctatacaaaatgattttgaagagattttaaagacgttcccttttgtattctcttcctcatccaccgccactgggcctgtcactgatggtggctctggtgtgaagtttgctttgtactgagggttggggtggggaagcaatttgtattttattgtttcttagcacaagcaggtgaactgggagcagctctgtgactccccctctttcacttcatagctcaccaggactgttttataaactgctgtatttggaaaccccttctttacttcccaggccagcaagctcttcactgaaactggttgaagggtgttgcacccttttgggcctagaattctgaactttatctgttctgtttctgtgggaggagaaggggaagtatgttttggggggctgcttcctgtctgagtaagccctcaggagcctctgctcccctgtgaacccactgaaccttctgagcccccactgcttctatggggctctctcttctgccttctcaggaaagctggtgtctgattttggccatcaggactctgacgtctctttggtcttgttgatttcctctgggcatatcccttccccagatctgctcctcccctttcacaggtgggatcggcactcagggggtctggaaagaaggtcataagggagcatgataggatttggggcagagggacaggctcctctggggaaaccccccagagctctttaccaaggatgaaagaggagccaggccttgggctcctgatgaggagaaaggggccccaccggggtctaatggtgacagtccaaaccactccactggcctcctggcagaagccgagtgtgctggggtctccgaagagggtccctcctttttgggggaaggtcagcccagcccctccaaaggtctgatgtctccactttcacccgcaggccttaccgctctgtttatagtgacccaccctagatcttccccaagagggactggggtttctggggtccattctctgagtcagtggttatttgaaaatttgattttgattttattttttctctgtaaacttccaagctggcttttcccatttcaattcctgtgatttatgccaataaagtttgcccatgattttca

SEQ ID NO: 3018 - DNA, 3815 bp, Homo sapiens
gcgcgggcgcgcgcggcggcggcgcgttccgttccgggccgaggctcgcggcggaaaagttgcggggcatagacgagcggccccgggacgggcagctagcgcgaccctgagccggcgcccgtggtccggccatggacgacctcgacgccctgctggcggacttggagtctaccacctcccacatctccaaacggcctgtgttcttgtcggaggagaccccctactcatacccaactggaaaccacacataccaggagattgccgtgccaccccccgtccccccacccccgtccagcgaggccctcaatggcacaatccttgaccccttagaccagtggcagcccagcagctcccgattcatccaccagcagcctcagtcctcatcacctgtgtacggctccagtgccaaaacttccagtgtctccaaccctcaggacagtgttggctctccgtgctcccgagtgggtgaggaggagcacgtctacagcttccccaacaagcagaaatcagctgagccttcacccaccgtaatgagcacgtccctgggcagcaacctttctgaactcgaccgcctgctgctggaactgaacgctgtacagcataacccgccaggcttccctgcagatgaggccaactcaagccccccgcttcctggggccctgagccccctctatggtgtcccagagactaacagccccttgggaggcaaagctgggcccctgacgaaagagaagcctaagcggaatgggggccggggcctggaggacgtgcggcccagtgtggagagtctcttggatgaactggagagctccgtgcccagccccgtccctgccatcactgtgaaccagggcgagatgagcagcccgcagcgcgtcacctccacccaacagcagacacgcatctcggcctcctctgccaccagggagctggacgagctgatggcttcgctgtcggatttcaagggctcctggcccctggaggaggttgtacttcttgtctccatcagctcatctgtccaggagggagaaaagtacccccatccctgtgctgccagacaccgtaccccgagcctcaggagtcctgaccagccccctccgtgtccacagttcatggcccaggggaagacagggagcagctcaccccctggggggcccccgaagcccgggagccagctggacagcatgctggggagcctgcagtctgacctgaacaagctgggggtcgccacagtcgccaaaggagtctgcggggcctgcaagaagcccatcgccgggcaggttgtgaccgccatggggaagacgtggcaccccgagcacttcgtctgcacccactgccaggaggagatcggatcccggaacttcttcgagcgggatggacagccctactgtgaaaaggactaccacaacctcttctccccgcgctgctactactgcaacggccccatcctggataaagtggtgacagcccttgaccggacgtggcaccctgaacacttcttctgtgcacagtgtggagccttctttggtcccgaagggttccacgagaaggacggcaaggcctactgtcgcaaggactacttcgacatgttcgcacccaagtgtggcggctgcgcccgggccatcctggagaactatatctcagccctcaacacgctgtggcatcctgagtgctttgtgtgccgggaatgcttcacgccattcgtgaacggcagcttcttcgagcacgacgggcagccctactgtgaggtgcactaccacgagcggcgcggctcgctgtgttctggctgccagaagcccatcaccggccgctgcatcaccgccatggccaagaagttccaccccgagcacttcgtctgtgccttctgcctcaagcagctcaacaagggcaccttcaaggagcagaacgacaagccttactgtcagaactgcttcctcaagctcttctgctaggtgccctgcccctgtctctgccccccttccccagccagcatccccaactgcgactgtgacctagagacttcacccgggggtgaaggggtaaacccgactgaaactggaacccttgtcctccgctggtgcgggatggacagagggccgtgaggggtccccctgcttgtcttcacccctgccagagcctctgggccccctcctccctcctgtagctctccctaggctgcccactctccatcctccccaggggtagaggctgggggctccaccccagcccatgtacgtccccacgaactggcctggccagcaccccacactggagccatctcttcctcatatttcagcagtgcagccggggggcagggaagggcaggcagggtctgttggggtctctttttatccttattcctcccccgacctaattgtctttgttctgtgattattgggggacacccggctccctccagacaatgccagcataaatccatccatccaaaggcagagaaccaaaggggccatggaaggttctctgtgctcctcctacccttccagtgccctaggcctggcgactgcccctgccttttagacccgccctccccttttatacctgctcttgttctactgagaaaagcctctccagcaataatgttttctagtcacttcctccgtctccgggacggcgtgcctggacactgtaccgactttgatagatttctacactgaggtttgaattcatatcgcctgagttgcttttacttctctatacaaaatgattttgaagagattttaaagacgttcccttttgtattctcttcctcatccaccgccactgggcctgtcactgatggtggctctggtgtgaagtttgctttgtactgagggttggggtggggaagcaatttgtattttattgtttcttagcacaagcaggtgaactgggagcagctctgtgactccccctctttcacttcatagctcaccaggactgttttataaactgctgtatttggaaaccccttctttacttcccaggccagcaagctcttcactgaaactggttgaagggtgttgcacccttttgggcctagaattctgaactttatctgttctgtttctgtgggaggagaaggggaagtatgttttggggggctgcttcctgtctgagtaagccctcaggagcctctgctcccctgtgaacccactgaaccttctgagcccccactgcttctatggggctctctcttctgccttctcaggaaagctggtgtctgattttggccatcaggactctgacgtctctttggtcttgttgatttcctctgggcatatcccttccccagatctgctcctcccctttcacaggtgggatcggcactcagggggtctggaaagaaggtcataagggagcatgataggatttggggcagagggacaggctcctctggggaaaccccccagagctctttaccaaggatgaaagaggagccaggccttgggctcctgatgaggagaaaggggccccaccggggtctaatggtgacagtccaaaccactccactggcctcctggcagaagccgagtgtgctggggtctccgaagagggtccctcctttttgggggaaggtcagcccagcccctccaaaggtctgatgtctccactttcacccgcaggccttaccgctctgtttatagtgacccaccctagatcttccccaagagggactggggtttctggggtccattctctgagtcagtggttatttgaaaatttgattttgattttattttttctctgtaaacttccaagctggcttttcccatttcaattcctgtgatttatgccaataaagtttgcccatgattttc

SEQ ID NO: 3019 - DNA, 1847 bp, Homo sapiens
gcgcgggcgcgcgcggcggcggcgcgttccgttccgggccgaggctcgcggcggaaaagttgcggggcatagacgagcggccccgggacgggcagctagcgcgaccctgagccggcgcccgtggtccggccatggacgacctcgacgccctgctggcggacttggagtctaccacctcccacatctccaaacggcctgtgttcttgtcggaggagaccccctactcatacccaactggaaaccacacataccaggagattgccgtgccaccccccgtccccccacccccgtccagcgaggccctcaatggcacaatccttgaccccttagaccagtggcagcccagcagctcccgattcatccaccagcagcctcagtcctcatcacctgtgtacggctccagtgccaaaacttccagtgtctccaaccctcaggacagtgttggctctccgtgctcccgagtgggtgaggaggagcacgtctacagcttccccaacaagcagaaatcagctgagccttcacccaccgtaatgagcacgtccctgggcagcaacctttctgaactcgaccgcctgctgctggaactgaacgctgtacagcataacccgccaggcttccctgcagatgaggccaactcaagccccccgcttcctggggccctgagccccctctatggtgtcccagagactaacagccccttgggaggcaaagctgggcccctgacgaaagagaagcctaagcggaatgggggccggggcctggaggacgtgcggcccagtgtggagagtctcttggatgaactggagagctccgtgcccagccccgtccctgccatcactgtgaaccagggcgagatgagcagcccgcagcgcgtcacctccacccaacagcagacacgcatctcggcctcctctgccaccagggagctggacgagctgatggcttcgctgtcggatttcaagttcatggcccaggggaagacagggagcagctcaccccctggggggcccccgaagcccgggagccagctggacagcatgctggggagcctgcagtctgacctgaacaagctgggggtcgccacagtcgccaaaggagtctgcggggcctgcaagaagcccatcgccgggcaggttgtgaccgccatggggaagacgtggcaccccgagcacttcgtctgcacccactgccaggaggagatcggatcccggaacttcttcgagcgggatggacagccctactgtgaaaaggactaccacaacctcttctccccgcgctgctactactgcaacggccccatcctggataaagtggtgacagcccttgaccggacgtggcaccctgaacacttcttctgtgcacagtgtggagccttctttggtcccgaagggttccacgagaaggacggcaaggcctactgtcgcaaggactacttcgacatgttcgcacccaagtgtggcggctgcgcccgggccatcctggagaactatatctcagccctcaacacgctgtggcatcctgagtgctttgtgtgccgggaatgcttcacgccattcgtgaacggcagcttcttcgagcacgacgggcagccctactgtgaggtgcactaccacgagcggcgcggctcgctgtgttctggctgccagaagcccatcaccggccgctgcatcaccgccatggccaagaagttccaccccgacccatgtacgtccccacgaactggcctggccagcaccccacactggagccatctcttcctcatatttcagcagtgcagccggggggcagggaagggcaggcagggtctgttggggtctctttttatccttattcctcccccgacctaa

SEQ ID NO: 3020 - DNA, 4132 bp, Homo sapiens
gatgaccgagaggggaagtgtggccaggccaacccagggacctgaaaccccaaggagcccagagggcaccacggaagctgccacccaggacgggaaggaacagccagagcttccatgtgccatggccatgggcacacccagcaccacggagaggatttccacctctggccagatccgatctgtgatcaggaggagctgggagtctggccacgcacaccccatgtcccgggagccctcccctcgccgccggctggaccctgccaccttgagcaggaccccatcccaggaacagctcatcgcggagctgcaggggcggctgggcatccagcctgaggcagaggagccggcggaggcggcggggccctctgcccaggactggctgaccgagggcgtcatcatcactgtgcagccacgtgggaagcgggccggggggcagctcgtagagaaggtggcgaggagatgcccatggctggggctgggccagagccaagcacctggggtccgggttcttccctggccccagtgctggccggaggggagatctggggagagggtgggggtttcttgcctcctgtgactttggaagactggccccactcttggtgcagagtgggaaggcccagggggagcctggggaggtcccgccacccctgtgggctgagctggcgatttcttcctcatcgctctccctcctttcttctccccaggttgtcttccctcctggctctcccattcccctgagaagaaccatctctgtcctggcttctccttctgtccctttgctccagcatcgcacagacgccgcggccagcagctcttctcccctgcccagcctgctcgcctcctcccccctggggccctcagcttatacctgtggttcttctggggtccagagtgcaggggaagagccccatgatgagggggtgcagggccctgcccttcccattcctgcaccccacaccatgaggtccgtgggctgccagactgatgaggacccgctcttccccccgatgcagaaggtccgctgccctcttgcttttctgtgggtccacccatgtctgctccttcctcgactggtcctcagtactgccccgggctcccatcgaggaaagaagccactccagaagggagaccagaaacctgtctcctcccttccagcccccaggcccagcgcccgatccagggcctggagcaaagagcggatggggagcggtgctgggcggccggctggcctcgggacggcgggcggagcagccccggagggcaggacgagggagggggctcctggcccctggaggaggttgtacttcttgtctccatcagctcatctgtccaggagggagaaaagtacccccatccctgtgctgccagacaccgtaccccgagcctcaggagtcctgaccagccccctccgtgtccacagttcatggcccaggggaagacagggagcagctcaccccctggggggcccccgaagcccgggagccagctggacagcatgctggggagcctgcagtctgacctgaacaagctgggggtcgccacagtcgccaaaggagtctgcggggcctgcaagaagcccatcgccgggcaggttgtgaccgccatggggaagacgtggcaccccgagcacttcgtctgcacccactgccaggaggagatcggatcccggaacttcttcgagcgggatggacagccctactgtgaaaaggactaccacaacctcttctccccgcgctgctactactgcaacggccccatcctggataaagtggtgacagcccttgaccggacgtggcaccctgaacacttcttctgtgcacagtgtggagccttctttggtcccgaagggttccacgagaaggacggcaaggcctactgtcgcaaggactacttcgacatgttcgcacccaagtgtggcggctgcgcccgggccatcctggagaactatatctcagccctcaacacgctgtggcatcctgagtgctttgtgtgccgggaatgcttcacgccattcgtgaacggcagcttcttcgagcacgacgggcagccctactgtgaggtgcactaccacgagcggcgcggctcgctgtgttctggctgccagaagcccatcaccggccgctgcatcaccgccatggccaagaagttccaccccgagcacttcgtctgtgccttctgcctcaagcagctcaacaagggcaccttcaaggagcagaacgacaagccttactgtcagaactgcttcctcaagctcttctgctaggtgccctgcccctgtctctgccccccttccccagccagcatccccaactgcgactgtgacctagagacttcacccgggggtgaaggggtaaacccgactgaaactggaacccttgtcctccgctggtgcgggatggacagagggccgtgaggggtccccctgcttgtcttcacccctgccagagcctctgggccccctcctccctcctgtagctctccctaggctgcccactctccatcctccccaggggtagaggctgggggctccaccccagcccatgtacgtccccacgaactggcctggccagcaccccacactggagccatctcttcctcatatttcagcagtgcagccggggggcagggaagggcaggcagggtctgttggggtctctttttatccttattcctcccccgacctaattgtctttgttctgtgattattgggggacacccggctccctccagacaatgccagcataaatccatccatccaaaggcagagaaccaaaggggccatggaaggttctctgtgctcctcctacccttccagtgccctaggcctggcgactgcccctgccttttagacccgccctccccttttatacctgctcttgttctactgagaaaagcctctccagcaataatgttttctagtcacttcctccgtctccgggacggcgtgcctggacactgtaccgactttgatagatttctacactgaggtttgaattcatatcgcctgagttgcttttacttctctatacaaaatgattttgaagagattttaaagacgttcccttttgtattctcttcctcatccaccgccactgggcctgtcactgatggtggctctggtgtgaagtttgctttgtactgagggttggggtggggaagcaatttgtattttattgtttcttagcacaagcaggtgaactgggagcagctctgtgactccccctctttcacttcatagctcaccaggactgttttataaactgctgtatttggaaaccccttctttacttcccaggccagcaagctcttcactgaaactggttgaagggtgttgcacccttttgggcctagaattctgaactttatctgttctgtttctgtgggaggagaaggggaagtatgttttggggggctgcttcctgtctgagtaagccctcaggagcctctgctcccctgtgaacccactgaaccttctgagcccccactgcttctatggggctctctcttctgccttctcaggaaagctggtgtctgattttggccatcaggactctgacgtctctttggtcttgttgatttcctctgggcatatcccttccccagatctgctcctcccctttcacaggtgggatcggcactcagggggtctggaaagaaggtcataagggagcatgataggatttggggcagagggacaggctcctctggggaaaccccccagagctctttaccaaggatgaaagaggagccaggccttgggctcctgatgaggagaaaggggccccaccggggtctaatggtgacagtccaaaccactccactggcctcctggcagaagccgagtgtgctggggtctccgaagagggtccctcctttttgggggaaggtcagcccagcccctccaaaggtctgatgtctccactttcacccgcaggccttaccgctctgtttatagtgacccaccctagatcttccccaagagggactggggtttctggggtccattctctgagtcagtggttatttgaaaatttgattttgattttattttttctctgtaaacttccaagctggcttttcccatttcaattcctgtgatttatgccaataaagtttgcccatgattttc

SEQ ID NO: 3021 - DNA, 3683 bp, Homo sapiens
ggcgggcgcgggcgcgggcgcgcgcggcggcggcgcgttccgttccgggccgaggctcgcggcggaaaagttgcggggcatagacgagcggccccgggacgggcagctagcgcgaccctgagccggcgcccgtggtccggccatggacgacctcgacgccctgctggcggacttggagtctaccacctcccacatctccaaacggcctgtgttcttgtcggaggagaccccctactcatacccaactggaaaccacacataccaggagattgccgtgccaccccccgtccccccacccccgtccagcgaggccctcaatggcacaatccttgaccccttagaccagtggcagcccagcagctcccgattcatccaccagcagcctcagtcctcatcacctgtgtacggctccagtgccaaaacttccagtgtctccaaccctcaggacagtgttggctctccgtgctcccgagtgggtgaggaggagcacgtctacagcttccccaacaagcagaaatcagctgagccttcacccaccgtaatgagcacgtccctgggcagcaacctttctgaactcgaccgcctgctgctggaactgaacgctgtacagcataacccgccaggcttccctgcagatgaggccaactcaagccccccgcttcctggggccctgagccccctctatggtgtcccagagactaacagccccttgggaggcaaagctgggcccctgacgaaagagaagcctaagcggaatgggggccggggcctggaggacgtgcggcccagtgtggagagtctcttggatgaactggagagctccgtgcccagccccgtccctgccatcactgtgaaccagggcgagatgagcagcccgcagcgcgtcacctccacccaacagcagacacgcatctcggcctcctctgccaccagggagctggacgagctgatggcttcgctgtcggatttcaagttcatggcccaggggaagacagggagcagctcaccccctggggggcccccgaagcccgggagccagctggacagcatgctggggagcctgcagtctgacctgaacaagctgggggtcgccacagtcgccaaaggagtctgcggggcctgcaagaagcccatcgccgggcaggttgtgaccgccatggggaagacgtggcaccccgagcacttcgtctgcacccactgccaggaggagatcggatcccggaacttcttcgagcgggatggacagccctactgtgaaaaggactaccacaacctcttctccccgcgctgctactactgcaacggccccatcctggataaagtggtgacagcccttgaccggacgtggcaccctgaacacttcttctgtgcacagtgtggagccttctttggtcccgaagggttccacgagaaggacggcaaggcctactgtcgcaaggactacttcgacatgttcgcacccaagtgtggcggctgcgcccgggccatcctggagaactatatctcagccctcaacacgctgtggcatcctgagtgctttgtgtgccgggaatgcttcacgccattcgtgaacggcagcttcttcgagcacgacgggcagccctactgtgaggtgcactaccacgagcggcgcggctcgctgtgttctggctgccagaagcccatcaccggccgctgcatcaccgccatggccaagaagttccaccccgagcacttcgtctgtgccttctgcctcaagcagctcaacaagggcaccttcaaggagcagaacgacaagccttactgtcagaactgcttcctcaagctcttctgctaggtgccctgcccctgtctctgccccccttccccagccagcatccccaactgcgactgtgacctagagacttcacccgggggtgaaggggtaaacccgactgaaactggaacccttgtcctccgctggtgcgggatggacagagggccgtgaggggtccccctgcttgtcttcacccctgccagagcctctgggccccctcctccctcctgtagctctccctaggctgcccactctccatcctccccaggggtagaggctgggggctccaccccagcccatgtacgtccccacgaactggcctggccagcaccccacactggagccatctcttcctcatatttcagcagtgcagccggggggcagggaagggcaggcagggtctgttggggtctctttttatccttattcctcccccgacctaattgtctttgttctgtgattattgggggacacccggctccctccagacaatgccagcataaatccatccatccaaaggcagagaaccaaaggggccatggaaggttctctgtgctcctcctacccttccagtgccctaggcctggcgactgcccctgccttttagacccgccctccccttttatacctgctcttgttctactgagaaaagcctctccagcaataatgttttctagtcacttcctccgtctccgggacggcgtgcctggacactgtaccgactttgatagatttctacactgaggtttgaattcatatcgcctgagttgcttttacttctctatacaaaatgattttgaagagattttaaagacgttcccttttgtattctcttcctcatccaccgccactgggcctgtcactgatggtggctctggtgtgaagtttgctttgtactgagggttggggtggggaagcaatttgtattttattgtttcttagcacaagcaggtgaactgggagcagctctgtgactccccctctttcacttcatagctcaccaggactgttttataaactgctgtatttggaaaccccttctttacttcccaggccagcaagctcttcactgaaactggttgaagggtgttgcacccttttgggcctagaattctgaactttatctgttctgtttctgtgggaggagaaggggaagtatgttttggggggctgcttcctgtctgagtaagccctcaggagcctctgctcccctgtgaacccactgaaccttctgagcccccactgcttctatggggctctctcttctgccttctcaggaaagctggtgtctgattttggccatcaggactctgacgtctctttggtcttgttgatttcctctgggcatatcccttccccagatctgctcctcccctttcacaggtgggatcggcactcagggggtctggaaagaaggtcataagggagcatgataggatttggggcagagggacaggctcctctggggaaaccccccagagctctttaccaaggatgaaagaggagccaggccttgggctcctgatgaggagaaaggggccccaccggggtctaatggtgacagtccaaaccactccactggcctcctggcagaagccgagtgtgctggggtctccgaagagggtccctcctttttgggggaaggtcagcccagcccctccaaaggtctgatgtctccactttcacccgcaggccttaccgctctgtttatagtgacccaccctagatcttccccaagagggactggggtttctggggtccattctctgagtcagtggttatttgaaaatttgattttgattttattttttctctgtaaacttccaagctggcttttcccatttcaattcctgtgatttatgccaataaagtttgcccatgattttca

SEQ ID NO: 3022 - DNA, 3807 bp, Homo sapiens
ttcccctgtgtactcctggctcggctggccggctaaggcagtttctcatcactgatgtgctctgggacagctgagtgggatgggctcctctggggtgggtgtggaggagtggtcgtgatgcctggaacactgcagtcactcctcagagacacgacttggcagccctcctgagcctgcctggtcacatgctgcctgtcttggaaggtcctctgtcccaagcagtggatgtgcagtttcttcacccctgcttagcttcatcaggcacaatgcgtctttgagacgccctgctggcggacttggagtctaccacctcccacatctccaaacggcctgtgttcttgtcggaggagaccccctactcatacccaactggaaaccacacataccaggagattgccgtgccaccccccgtccccccacccccgtccagcgaggccctcaatggcacaatccttgaccccttagaccagtggcagcccagcagctcccgattcatccaccagcagcctcagtcctcatcacctgtgtacggctccagtgccaaaacttccagtgtctccaaccctcaggacagtgttggctctccgtgctcccgagtgggtgaggaggagcacgtctacagcttccccaacaagcagaaatcagctgagccttcacccaccgtaatgagcacgtccctgggcagcaacctttctgaactcgaccgcctgctgctggaactgaacgctgtacagcataacccgccaggcttccctgcagatgaggccaactcaagccccccgcttcctggggccctgagccccctctatggtgtcccagagactaacagccccttgggaggcaaagctgggcccctgacgaaagagaagcctaagcggaatgggggccggggcctggaggacgtgcggcccagtgtggagagtctcttggatgaactggagagctccgtgcccagccccgtccctgccatcactgtgaaccagggcgagatgagcagcccgcagcgcgtcacctccacccaacagcagacacgcatctcggcctcctctgccaccagggagctggacgagctgatggcttcgctgtcggatttcaagttcatggcccaggggaagacagggagcagctcaccccctggggggcccccgaagcccgggagccagctggacagcatgctggggagcctgcagtctgacctgaacaagctgggggtcgccacagtcgccaaaggagtctgcggggcctgcaagaagcccatcgccgggcaggttgtgaccgccatggggaagacgtggcaccccgagcacttcgtctgcacccactgccaggaggagatcggatcccggaacttcttcgagcgggatggacagccctactgtgaaaaggactaccacaacctcttctccccgcgctgctactactgcaacggccccatcctggataaagtggtgacagcccttgaccggacgtggcaccctgaacacttcttctgtgcacagtgtggagccttctttggtcccgaagggttccacgagaaggacggcaaggcctactgtcgcaaggactacttcgacatgttcgcacccaagtgtggcggctgcgcccgggccatcctggagaactatatctcagccctcaacacgctgtggcatcctgagtgctttgtgtgccgggaatgcttcacgccattcgtgaacggcagcttcttcgagcacgacgggcagccctactgtgaggtgcactaccacgagcggcgcggctcgctgtgttctggctgccagaagcccatcaccggccgctgcatcaccgccatggccaagaagttccaccccgagcacttcgtctgtgccttctgcctcaagcagctcaacaagggcaccttcaaggagcagaacgacaagccttactgtcagaactgcttcctcaagctcttctgctaggtgccctgcccctgtctctgccccccttccccagccagcatccccaactgcgactgtgacctagagacttcacccgggggtgaaggggtaaacccgactgaaactggaacccttgtcctccgctggtgcgggatggacagagggccgtgaggggtccccctgcttgtcttcacccctgccagagcctctgggccccctcctccctcctgtagctctccctaggctgcccactctccatcctccccaggggtagaggctgggggctccaccccagcccatgtacgtccccacgaactggcctggccagcaccccacactggagccatctcttcctcatatttcagcagtgcagccggggggcagggaagggcaggcagggtctgttggggtctctttttatccttattcctcccccgacctaattgtctttgttctgtgattattgggggacacccggctccctccagacaatgccagcataaatccatccatccaaaggcagagaaccaaaggggccatggaaggttctctgtgctcctcctacccttccagtgccctaggcctggcgactgcccctgccttttagacccgccctccccttttatacctgctcttgttctactgagaaaagcctctccagcaataatgttttctagtcacttcctccgtctccgggacggcgtgcctggacactgtaccgactttgatagatttctacactgaggtttgaattcatatcgcctgagttgcttttacttctctatacaaaatgattttgaagagattttaaagacgttcccttttgtattctcttcctcatccaccgccactgggcctgtcactgatggtggctctggtgtgaagtttgctttgtactgagggttggggtggggaagcaatttgtattttattgtttcttagcacaagcaggtgaactgggagcagctctgtgactccccctctttcacttcatagctcaccaggactgttttataaactgctgtatttggaaaccccttctttacttcccaggccagcaagctcttcactgaaactggttgaagggtgttgcacccttttgggcctagaattctgaactttatctgttctgtttctgtgggaggagaaggggaagtatgttttggggggctgcttcctgtctgagtaagccctcaggagcctctgctcccctgtgaacccactgaaccttctgagcccccactgcttctatggggctctctcttctgccttctcaggaaagctggtgtctgattttggccatcaggactctgacgtctctttggtcttgttgatttcctctgggcatatcccttccccagatctgctcctcccctttcacaggtgggatcggcactcagggggtctggaaagaaggtcataagggagcatgataggatttggggcagagggacaggctcctctggggaaaccccccagagctctttaccaaggatgaaagaggagccaggccttgggctcctgatgaggagaaaggggccccaccggggtctaatggtgacagtccaaaccactccactggcctcctggcagaagccgagtgtgctggggtctccgaagagggtccctcctttttgggggaaggtcagcccagcccctccaaaggtctgatgtctccactttcacccgcaggccttaccgctctgtttatagtgacccaccctagatcttccccaagagggactggggtttctggggtccattctctgagtcagtggttatttgaaaatttgattttgattttattttttctctgtaaacttccaagctggcttttcccatttcaattcctgtgatttatgccaataaagtttgcccatgattttca

SEQ ID NO: 3023 - DNA, 1520 bp, Homo sapiens
atagacgagcggccccgggacgggcagctagcgcgaccctgagccggcgcccgtggtccggccatggacgacctcgacgccctgctggcggacttggagtctaccacctcccacatctccaaacggcctgtgttcttgtcggaggagaccccctactcatacccaactggaaaccacacataccaggagattgccgggcctggaggacgtgcggcccagtgtggagagtctcttggatgaactggagagctccgtgcccagccccgtccctgccatcactgtgaaccagggcgagatgagcagcccgcagcgcgtcacctccacccaacagcagacacgcatctcggcctcctctgccaccagggagctggacgagctgatggcttcgctgtcggatttcaagttcatggcccaggggaagacagggagcagctcaccccctggggggcccccgaagcccgggagccagctggacagcatgctggggagcctgcagtctgacctgaacaagctgggggtcgccacagtcgccaaaggagtctgcggggcctgcaagaagcccatcgccgggcaggttgtgaccgccatggggaagacgtggcaccccgagcacttcgtctgcacccactgccaggaggagatcggatcccggaacttcttcgagcgggatggacagccctactgtgaaaaggactaccacaacctcttctccccgcgctgctactactgcaacggccccatcctggataaagtggtgacagcccttgaccggacgtggcaccctgaacacttcttctgtgcacagtgtggagccttctttggtcccgaagggttccacgagaaggacggcaaggcctactgtcgcaaggactacttcgacatgttcgcacccaagtgtggcggctgcgcccgggccatcctggagaactatatctcagccctcaacacgctgtggcatcctgagtgctttgtgtgccgggaatgcttcacgccattcgtgaacggcagcttcttcgagcacgacgggcagccctactgtgaggtgcactaccacgagcggcgcggctcgctgtgttctggctgccagaagcccatcaccggccgctgcatcaccgccatggccaagaagttccaccccgagcacttcgtctgtgccttctgcctcaagcagctcaacaagggcaccttcaaggagcagaacgacaagccttactgtcagaactgcttcctcaagctcttctgctaggtgccctgcccctgtctctgccccccttccccagccagcatccccaactgcgactgtgacctagagacttcacccgggggtgaaggggtaaacccgactgaaactggaacccttgtcctccgctggtgcgggatggacagagggccgtgaggggtccccctgcttgtcttcacccctgccagagcctctgggccccctcctccctcctgtagctctccctaggctgcccactctccatcctccccaggggtagaggctgggggctccaccccag

SEQ ID NO: 3024 - DNA, 2282 bp, Homo sapiens
gctgcggcggcggcggctcctcctcagagtccggctcaggctccggctgcggctccagcccgcgatgccccattccgtgaccctgcgcgggccttcgccctggggcttccgcctggtgggcggccgggacttcagcgcgcccctcaccatctcacgggtccatgctggcagcaaggctgcattggctgccctgtgcccaggagacctgatccaggccatcaatggtgagagcacagagctcatgacacacctggaggcacagaaccgcatcaagggctgccacgatcacctcacactgtctgtgagcaggcctgagggtaggagctggcccagtgcccctgatgacagcaaggctcaggcacacaggatccacatcgatcctgagatccaggacggcagcccaacaaccagcaggcggccctcaggcaccgggactgggccagaagatggcagaccaagcctgggatctccatatggacaaccccctcgctttccagtccctcacaatggcagcagcgaggccaccctgccagcccagatgagcaccctgcatgtgtctccaccccccagcgctgacccagccagaggcctcccgcggagccgggactgcagagtcgacctgggctccgaggtgtacaggatgctgcgggagccagccgagcccgtggccgcggagcccaagcagtcaggctccttccgctacttgcagggcatgctagaggccggcgagggcggggattggcccgggcctggcggcccccggaacctcaagcccacggccagcaagctgggcgctccgctgagcggcctgcaggggctgcccgagtgcacgcgctgcggccacggcatcgtgggcaccatcgtcaaggcacgggacaagctctaccatcccgagtgcttcatgtgcagtgactgcggcctgaacctcaagcagcgtggttacttctttctggacgagcggctctactgtgagagccacgccaaggcgcgcgtgaagccgcccgagggctacgacgtggtggcggtgtaccccaatgccaaggtggaactcgtctgagctgggaccctgctcccacgcctgcttcttaaggtccctgctcggccggtgtaaatatgtttcaccctgtccctctaataaagctcctctgctccaccttgaacctgtcacctggcctgccaccctcctgcgcaggccatgcatggctcccgagtacagtagtatctgcttaggtgccaggcatgtcctaggctctgggtgcagtagtgagcaggacgggtaccatgctgccctgaagggggccacagcctgggtggaaggcagacctgaatcacaacgggccagctctagtaatacgaaggtgaggtctgggatgctgcgtgcggcgcgacgacaggaggtatgacctgggtggggtcagggaaagtcttagctgagaactaagagatgagggaggcacaaactctgcacgggggaactgtgtgtgcaaaggtgagctgggggcgagaaaggcctctgtggccgtcatcggcactagcgggttgggggtggtggtggggtgctggcagcctcaggagcgatcgctcccctggagagggtgattgagtgtggagatcaccggggccgccgcgggccgtctgcacttctgttccaggtttttctggcattttctgttccaggtttcttccacccacgagcactttattctcctccgagacccccttttcttccccttcctctctcccccaccagggggcgcgcttaaatttccagacagagaccagaaggaaggtttagaaagaaaagaacacttgcccagggcagctttgccctccaagaggctccctcctgtctctaagtcaattccacccctcctcgaagtcccggcttccacccctctcctcagagtcccggcgtttacctcgtggtgtgtttgccttgggcctttcatgccccggctgcacacatcgtctgtgaattgtggctgttcactcccgaggatgtgtcctagactccgggtcgcgtggatctaccctctagtttacttgctcgggagaagaaactgactcgttttatttagtgcctatttagcgagcccagagtaacgtacatttgtgctgttttcaattttgtgctatcgcaaatcacaaaaaaactgttatcaattcacattcatcatcagcacgagacccatttccttgtgctcctgccagctcaggatattatgtttcttttttcatttttgccagtctgttaagtaaaatgtcatatgcgtttgttttaa

SEQ ID NO: 3025 - DNA, 1006 bp, Homo sapiens
caggctccggctgcggctccagcccgcgatgccccattccgtgaccctgcgcgggccttcgccctggggcttccgcctggtgggcggccgggacttcagcgcgcccctcaccatctcacgggtccatgctggcagcaaggctgcattggctgccctgtgcccaggagacctgatccaggccatcaatggtgagagcacagagctcatgacacacctggaggcacagaaccgcatcaagggctgccacgatcacctcacactgtctgtgagcaggcctgagggtaggagctggcccagtgcccctgatgacagcaaggctcaggcacacaggatccacatcgatcctgagatccaggacggcagcccaacaaccagcaggcggccctcaggcaccgggactgggccagaagatggcagaccaagcctgggatctccatatggacaaccccctcgctttccagtccctcacaatggcagcagcgaggccaccctgccagcccagatgagcaccctgcatgtgtctccaccccccagcgctgacccagccagaggcctcccgcggagccgggactgcagagtcgacctgggctccgaggtgtacaggatgctgcgggagccagccgagcccgtggccgcggagcccaagcagtcaggctccttccgctacttgcagggcatgctagaggccggcgagggcggggcaccatcgtcaaggcacgggacaagctctaccatcccgagtgcttcatgtgcagtgactgcggcctgaacctcaagcagcgtggttacttctttctggacgagcggctctactgtgagagccacgccaaggcgcgcgtgaagccgcccgagggctacgacgtggtggcggtgtaccccaatgccaaggtggaactcgtctgagctgggaccctgctcccacgcctgcttcttaaggtccctgctcggccggtgtaaatatgtttcaccctgtccctctaataaagctcctctgctccaccttgaa

SEQ ID NO: 3026 - DNA, 6083 bp, Homo sapiens
gttcccgcgggcggtggggacggcgccctcaccgcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaagggagaacctaaagaagtagttaaacctgtgcccattacatctcctgctgtgtccaaagtcacttccacaaacaacatggcctacaataaggcaccacggccttttggttctgtgtcttcaccaaaagtcacatccatcccatcaccatcgtctgccttcaccccagcccatgcgaccacctcatcacatgcttccccttcacccgtggctgccgtcactcctcccctgttcgctgcatctggactgcatgctaatgccaatcttagtgctgaccagtctccatctgcactgagcgctggtaaaactgcagttaatgtcccacggcagcccacagtcaccagcgtgtgttccgagacttctcaggagctagcagagggacagagaagaggatcccagggtgacagtaaacagcaaaatggcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacatttgaaagaatctgaagccgataatacaaagaaggcaaataactctcaggagccttctccgcagttggcttcctcggtagcttccacacggagcatgcccgagagcctggacagcccaacctctggcagaccaggggttaccagcctcacagctgcagctgccttcaagcctgtaggatccactggcgtcatcaagtcaccaagctggcaacggccaaaccaaggagtaccttccactggaagaatctcaaacagcgctacttactcaggatcagtggcaccagccaactcagctttgggacaaacccagccaagtgaccaggacactttagtgcaaagagctgagcacattccagcagggaaacgaactccgatgtgcgcccattgtaaccaggtcatcagaggaccattcttagtggcactggggaaatcttggcacccagaagaattcaactgcgctcactgcaaaaatacaatggcctacattggatttgtagaggagaaaggagccctgtattgtgagctgtgctatgagaaattctttgcccctgaatgtggtcgatgccaaaggaagatccttggagaagtcatcagtgcgttgaaacaaacttggcatgtttcctgttttgtgtgtgtagcctgtggaaagcccattcggaacaatgtttttcacttggaggatggtgaaccctactgtgagactgattattatgccctctttggtactatatgccatggatgtgaatttcccatagaagctggtgacatgttcctggaagctctgggctacacctggcatgacacttgctttgtatgctcagtgtgttgtgaaagtttggaaggtcagacctttttctccaagaaggacaagcccctgtgtaagaaacatgctcattctgtgaatttttgaaagtcaacagttcaggagaagagaaggaatttgaagagaaaaaggaaaattaaaattactaattaatttttagattcaatatttatatggagttttgaaaaataatagtggccctgaaggaataaattccagctttaaaaaccaagtctgaggaaatatttggcttcataaagtaaagagacggtttggcatttattattactttttcctgtattttatgcccataaaataagctttataaaaaccaatttcctgatggactattaaattcatcttagaataaattagtgaagaatttaattttagaataaataatccaatctgaaataattataccttctttccttgttaggtagttatgagtaaatctgcaaaaggcaatgaaaatgccttaaattttatcaataacagaattattgtatttaaaaaaaaactaatacttatctttaaaatagtaaataggattttaaacagagaattttatcagtaataggtgtcagtttttaaaaaattgcttgtaggctgagcgcggtggctcacgcctgtaatcccagcactttgggaggccaaggtgggtggaccacatgaggtcaggagtttgagatcagcctggccaacatggtgaaaccccatctctactaaaaatacaaaaattagccggacgcagtggcacgcgcctgtaatcccagctactcaagaggctgaggcacgagaatcacttgaacccgggagggagaggttgcagtgagccaagatcgtaccactgcactccagcctgggtgacagagtgagactctgtctccaaaaaaaaactttgcttgtatattatttttgccttacagtggatcattctagtaggaaaggacaataagattttttatcaaaatgtgtcatgccagtaagagatgttatattcttttctcatttcttccccacccaaaaataagctaccatatagcttataagtctcaaatttttgccttttactaaaatgtgattgtttctattcattgtgtatgcttcatcacctatattaggcaaattccatttttttcccttgtgctaaggtaaagatttaattaaataattttggcctctcatagttttctctctctttaaagagaataaatagagggccaggtgtggtggctcacgcctgtgatcccagcactttgggaggccaagacgggcggatcatgaggtcaagagatcaagatcatcctggccaacatggtgaaaccctgtctctactaaaaatacaaaaatgagctgggcatggtggggcgtgcctgtagtcccatgtacttgggaggctgaggcaggaaaattcttgaacccaggagacggaagttgcagtgagctgagatcacaccactgcactccagcctggtgacagagcaagactccggctcttaaaaaaaaaaaaaaaaaaaaaaaaagagagagagagaataaatagaaaagaatgtggctgggaattgtgaatcagaagattataccccccaattgtttttcaatccccttttctcaaataataaattagttaaatcagtttctgagttatgccactggctgatgaagagttgagaggtctctttgcagaatgatctttttgtttcgttttgtttcttcttctgcatttaaaaattaaaagattggtttgaggatgtgatgaaattgagactttttgtggttttctctcaataataagtgaaccaatttcaaatgtgatcacaaagtttggaaagcttttattcacagaggttgggtagtgttgggaggggagtttaattactcagattggcctgttatttgatttcctcctttgggaaaagaattatgtagataccacatggagacagggaaacaattgtggtaaaactgtggatcctgttgctatttgcccagtgagaaaacagattctggtatttgatttggtttttctctttgtttccagaatggatgaaagtccatgaacctcctaagttataatttaaatttgtttggggcaaggtgattttatagtcgagacagagccctaggtccttcctgccccatcactcacttacgacatcacttccattgtgtgcatgtttgttatagaggaggttttaggctacaatatttgtttaacctccctaagaactttcaaggcatctgtcctgaaagctgttaatttatggtctagcagatttatattatatgcagataataattaactggggataaaagaatggcaaggggtgacacaaagtagcaaactgaatacttctccaatagcaaccccaagctacctcctcaccctgcatcttggagggaggcaggaaatttcttttgaaataaagtgctggagctgaattctgcattatttatcgttgctgctgaaaccacctataaaagacttgctggctaatgtgcattgtcatataatgtacactgtcacatctttacagtcttgtatgttatagaatacaaaataagttgatggttttgtttggtgtgagctttttgtttgtttgtttagttttgccttcataggttatatgccaagatagtatttgataagtcaatgacatttggatgttttcttcaaagaattttatttgacccagatttcttataaagttatcttacattaaggatgtcattttcatcagaccttctttctacatattattcatgaagcataatgttgcatttctccaaattttatgcctgaaagggtagtgttgcttcctaaggtatcatgttgtctttgtgctttgtccatctcttccgtggcgaagctttatatctgttcctaaaacagttaatcctgtgaaataaatattgaacataatccagaagaatctctctgtttcccttggggaatgccatatttaattcaccagcagtaatcctttaataactggcagagcactttattcttctggtgagctccctgaatatttatttttctgattataaattttctatattagtagcattttttaattattacttcttcactatagagcatttacttttagtctctagatgtatattttggaatgctgtacttggcataacatagattaaaatcataatgcatgactaaaaactccttggatttatttcccattttaaaatttttagcggtaagttcagatttataatctttctctagacttccatggtctgaatgttgcctgctgaagtagcaacctaaaaagtatcccctgcttatgcttgtccagttggccctccatgtccataggcttcgcatctgtgattcagcccactgtgggtcaaaaatatttggggaaaaaaatggatggttgcgcctttgctgaacatgtacaaacttttttttgtcattaaacaatatagtataacaactatttacaaagcatttacattgtattagctattataggtaatctagagatgatttaaagtgtatggtaggatgtgcataggttatatgcaaatactacaccattttctataagggacttgaacatcatggactttagtatcctagggggttcttggaacccatcacccataggggcaccataggacaactatagtaccgtgtttatttcctattaattcaggttccgtttagagtctaaaactaaaacctaatcatttagtcacagtgtaaaaacaaatggaaataacagctcaaatcttcaaaatattactatagcattatgtttaaaataatctacaacaaaaatgtaccattttcaagcagtactacattaggagcccttttatagaaaataatttcttctttacccccgttccagtgtgaatctagtattctgttaacatttgtgtggcatttggagtttgtcatccccattgaagggagagccttctcagacatgaagcaagggaaacatactgaatagttttacacaaatttgatctggcttccatttgtccccctcatttcccaaatgtttaaatgtattggatttggattctcaatgtataagttgccttatctgttaatgtctatcttctgtctctttaattttgtatatctgctgttttgcttttggatacattttctaattagaagtcacatgataaatataatcagtatagtaataataccataatgtgcacatactcaataaataaatgactgcattgttgtaaa

SEQ ID NO: 3027 - DNA, 1930 bp, Homo sapiens
agccaggaggcggaagttcccgcgggcggtggggacggcgccctcaccgcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaagaaaacacaagtgacaaataaccctggcactgtgaaaatcccacctaaacgcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacatttgaaagaatctgaagccgataatacaaagaaggcaaaggaaaagataccccttcacgtctttagtcccaaatacacaaaattacgtgactggcaccatgaagtttcagcacgtgctcttaacgtacagtgatttatgagccttgccccccaagcagccagcacataccttttcatttactttttttttttcaacttcatagcaaaatctgtattaaatttgccttatgaaaaaatagaactttttctatacttttctaacaatttcctattgttgtgagaaaaggaagatgaacatgttttgtgctagttggtagctcacaaatgtaaaaccaaaaaaaaaaaaaaatagaaaattaagggactagatctatttgtggatttgtatctgtttttgttgtgattagggtagtaatcttggaaaacgaattattttcataagttgaatttggttagttggttggttgaagcagaggataatgagcaaataaagtccttgtctaatttggaaaatactttctttatattattaacatctcccaagattactttttaagttcattattatgttacattcaaagttgattgtaaattattctaaataagtaaatataaggaggcaagaataaacaaagactttattaaagaagagtgcgtgcattgtagatttaggtatcttttaaagtaggtactattcaggatggctctatgaagaggaggaggtccagatttggctcctgaaaaaggaaagaagagaattttacccctatttgcaatggagaaatacagtattctttggtttggttggatttgcaaatcctatttcctatcaaaggaaatatctctagtggatatttttagaatatagacaatttctaggtattaactaataagatatggaaaagatagctttgctttttttaatcagaagaacataaaataaattacaatatgaatgattgtgagacatcagagaaatattttacttagtgacgtaaactactgtgcactgctgctattcctaggaagctgtgttttgggcaatacatggaagctaaatatatgaccagaaatgctttctgccttgtaatatagtgtattatatattagagctaaatttagtaataaatgcattttgaagtttggaaaagtattgtaataaagttgcctttaacttagctttgtacttgttctgtttccttgaggctagacacagtgccatccaggacttattacagtataactgggtaaaataaacaattctctg

SEQ ID NO: 3028 - DNA, 1990 bp, Homo sapiens
agccaggaggcggaagttcccgcgggcggtggggacggcgccctcaccgcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaagcccacagtcaccagcgtgtgttccgagacttctcaggagctagcagagggacagagaagaggatcccagggtgacagtaaacagcaaaatgggaaaatcccacctaaacgcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacatttgaaagaatctgaagccgataatacaaagaaggcaaaggaaaagataccccttcacgtctttagtcccaaatacacaaaattacgtgactggcaccatgaagtttcagcacgtgctcttaacgtacagtgatttatgagccttgccccccaagcagccagcacataccttttcatttactttttttttttcaacttcatagcaaaatctgtattaaatttgccttatgaaaaaatagaactttttctatacttttctaacaatttcctattgttgtgagaaaaggaagatgaacatgttttgtgctagttggtagctcacaaatgtaaaaccaaaaaaaaaaaaaaatagaaaattaagggactagatctatttgtggatttgtatctgtttttgttgtgattagggtagtaatcttggaaaacgaattattttcataagttgaatttggttagttggttggttgaagcagaggataatgagcaaataaagtccttgtctaatttggaaaatactttctttatattattaacatctcccaagattactttttaagttcattattatgttacattcaaagttgattgtaaattattctaaataagtaaatataaggaggcaagaataaacaaagactttattaaagaagagtgcgtgcattgtagatttaggtatcttttaaagtaggtactattcaggatggctctatgaagaggaggaggtccagatttggctcctgaaaaaggaaagaagagaattttacccctatttgcaatggagaaatacagtattctttggtttggttggatttgcaaatcctatttcctatcaaaggaaatatctctagtggatatttttagaatatagacaatttctaggtattaactaataagatatggaaaagatagctttgctttttttaatcagaagaacataaaataaattacaatatgaatgattgtgagacatcagagaaatattttacttagtgacgtaaactactgtgcactgctgctattcctaggaagctgtgttttgggcaatacatggaagctaaatatatgaccagaaatgctttctgccttgtaatatagtgtattatatattagagctaaatttagtaataaatgcattttgaagtttggaaaagtattgtaataaagttgcctttaacttagctttgtacttgttctgtttccttgaggctagacacagtgccatccaggacttattacagtataactgggtaaaataaacaattctctg

SEQ ID NO: 3029 - DNA, 5774 bp, Homo sapiens
agccaggaggcggaagttcccgcgggcggtggggacggcgccctcaccgcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaagcccacagtcaccagcgtgtgttccgagacttctcaggagctagcagagggacagagaagaggatcccagggtgacagtaaacagcaaaatggcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacatttgaaagaatctgaagccgataatacaaagaaggcaaataactctcaggagccttctccgcagttggcttcctcggtagcttccacacggagcatgcccgagagcctggacagcccaacctctggcagaccaggggttaccagcctcacagctgcagctgccttcaagcctgtaggatccactggcgtcatcaagtcaccaagctggcaacggccaaaccaaggagtaccttccactggaagaatctcaaacagcgctacttactcaggatcagtggcaccagccaactcagctttgggacaaacccagccaagtgaccaggacactttagtgcaaagagctgagcacattccagcagggaaacgaactccgatgtgcgcccattgtaaccaggtcatcagaggaccattcttagtggcactggggaaatcttggcacccagaagaattcaactgcgctcactgcaaaaatacaatggcctacattggatttgtagaggagaaaggagccctgtattgtgagctgtgctatgagaaattctttgcccctgaatgtggtcgatgccaaaggaagatccttggagaagtcatcagtgcgttgaaacaaacttggcatgtttcctgttttgtgtgtgtagcctgtggaaagcccattcggaacaatgtttttcacttggaggatggtgaaccctactgtgagactgattattatgccctctttggtactatatgccatggatgtgaatttcccatagaagctggtgacatgttcctggaagctctgggctacacctggcatgacacttgctttgtatgctcagtgtgttgtgaaagtttggaaggtcagacctttttctccaagaaggacaagcccctgtgtaagaaacatgctcattctgtgaatttttgaaagtcaacagttcaggagaagagaaggaatttgaagagaaaaaggaaaattaaaattactaattaatttttagattcaatatttatatggagttttgaaaaataatagtggccctgaaggaataaattccagctttaaaaaccaagtctgaggaaatatttggcttcataaagtaaagagacggtttggcatttattattactttttcctgtattttatgcccataaaataagctttataaaaaccaatttcctgatggactattaaattcatcttagaataaattagtgaagaatttaattttagaataaataatccaatctgaaataattataccttctttccttgttaggtagttatgagtaaatctgcaaaaggcaatgaaaatgccttaaattttatcaataacagaattattgtatttaaaaaaaaactaatacttatctttaaaatagtaaataggattttaaacagagaattttatcagtaataggtgtcagtttttaaaaaattgcttgtaggctgagcgcggtggctcacgcctgtaatcccagcactttgggaggccaaggtgggtggaccacatgaggtcaggagtttgagatcagcctggccaacatggtgaaaccccatctctactaaaaatacaaaaattagccggacgcagtggcacgcgcctgtaatcccagctactcaagaggctgaggcacgagaatcacttgaacccgggagggagaggttgcagtgagccaagatcgtaccactgcactccagcctgggtgacagagtgagactctgtctccaaaaaaaaactttgcttgtatattatttttgccttacagtggatcattctagtaggaaaggacaataagattttttatcaaaatgtgtcatgccagtaagagatgttatattcttttctcatttcttccccacccaaaaataagctaccatatagcttataagtctcaaatttttgccttttactaaaatgtgattgtttctattcattgtgtatgcttcatcacctatattaggcaaattccatttttttcccttgtgctaaggtaaagatttaattaaataattttggcctctcatagttttctctctctttaaagagaataaatagagggccaggtgtggtggctcacgcctgtgatcccagcactttgggaggccaagacgggcggatcatgaggtcaagagatcaagatcatcctggccaacatggtgaaaccctgtctctactaaaaatacaaaaatgagctgggcatggtggggcgtgcctgtagtcccatgtacttgggaggctgaggcaggaaaattcttgaacccaggagacggaagttgcagtgagctgagatcacaccactgcactccagcctggtgacagagcaagactccggctcttaaaaaaaaaaaaaaaaaaaaaaaaagagagagagagaataaatagaaaagaatgtggctgggaattgtgaatcagaagattataccccccaattgtttttcaatccccttttctcaaataataaattagttaaatcagtttctgagttatgccactggctgatgaagagttgagaggtctctttgcagaatgatctttttgtttcgttttgtttcttcttctgcatttaaaaattaaaagattggtttgaggatgtgatgaaattgagactttttgtggttttctctcaataataagtgaaccaatttcaaatgtgatcacaaagtttggaaagcttttattcacagaggttgggtagtgttgggaggggagtttaattactcagattggcctgttatttgatttcctcctttgggaaaagaattatgtagataccacatggagacagggaaacaattgtggtaaaactgtggatcctgttgctatttgcccagtgagaaaacagattctggtatttgatttggtttttctctttgtttccagaatggatgaaagtccatgaacctcctaagttataatttaaatttgtttggggcaaggtgattttatagtcgagacagagccctaggtccttcctgccccatcactcacttacgacatcacttccattgtgtgcatgtttgttatagaggaggttttaggctacaatatttgtttaacctccctaagaactttcaaggcatctgtcctgaaagctgttaatttatggtctagcagatttatattatatgcagataataattaactggggataaaagaatggcaaggggtgacacaaagtagcaaactgaatacttctccaatagcaaccccaagctacctcctcaccctgcatcttggagggaggcaggaaatttcttttgaaataaagtgctggagctgaattctgcattatttatcgttgctgctgaaaccacctataaaagacttgctggctaatgtgcattgtcatataatgtacactgtcacatctttacagtcttgtatgttatagaatacaaaataagttgatggttttgtttggtgtgagctttttgtttgtttgtttagttttgccttcataggttatatgccaagatagtatttgataagtcaatgacatttggatgttttcttcaaagaattttatttgacccagatttcttataaagttatcttacattaaggatgtcattttcatcagaccttctttctacatattattcatgaagcataatgttgcatttctccaaattttatgcctgaaagggtagtgttgcttcctaaggtatcatgttgtctttgtgctttgtccatctcttccgtggcgaagctttatatctgttcctaaaacagttaatcctgtgaaataaatattgaacataatccagaagaatctctctgtttcccttggggaatgccatatttaattcaccagcagtaatcctttaataactggcagagcactttattcttctggtgagctccctgaatatttatttttctgattataaattttctatattagtagcattttttaattattacttcttcactatagagcatttacttttagtctctagatgtatattttggaatgctgtacttggcataacatagattaaaatcataatgcatgactaaaaactccttggatttatttcccattttaaaatttttagcggtaagttcagatttataatctttctctagacttccatggtctgaatgttgcctgctgaagtagcaacctaaaaagtatcccctgcttatgcttgtccagttggccctccatgtccataggcttcgcatctgtgattcagcccactgtgggtcaaaaatatttggggaaaaaaatggatggttgcgcctttgctgaacatgtacaaacttttttttgtcattaaacaatatagtataacaactatttacaaagcatttacattgtattagctattataggtaatctagagatgatttaaagtgtatggtaggatgtgcataggttatatgcaaatactacaccattttctataagggacttgaacatcatggactttagtatcctagggggttcttggaacccatcacccataggggcaccataggacaactatagtaccgtgtttatttcctattaattcaggttccgtttagagtctaaaactaaaacctaatcatttagtcacagtgtaaaaacaaatggaaataacagctcaaatcttcaaaatattactatagcattatgtttaaaataatctacaacaaaaatgtaccattttcaagcagtactacattaggagcccttttatagaaaataatttcttctttacccccgttccagtgtgaatctagtattctgttaacatttgtgtggcatttggagtttgtcatccccattgaagggagagccttctcagacatgaagcaagggaaacatactgaatagttttacacaaatttgatctggcttccatttgtccccctcatttcccaaatgtttaaatgtattggatttggattctcaatgtataagttgccttatctgttaatgtctatcttctgtctctttaattttgtatatctgctgttttgcttttggatacattttctaattagaagtcacatgataaatataatcagtatagtaataataccataatgtgcacatactcaataaataaatgactgcattgttgtaaatga

SEQ ID NO: 3030 - DNA, 856 bp, Homo sapiens
agccaggaggcggaagttcccgcgggcggtggggacggcgccctcaccgcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaagcccacagtcaccagcgtgtgttccgagacttctcaggagctagcagagggacagagaagaggatcccagggtgacagtaaacagcaaaatgggccagttcccaggaaaatcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacatttgaaagaatctgaagccgataatacaaagaaggcaaaggaaaagataccccttcacgtctttagtcccaaatacacaaaattacgtgactggcaccatgaagtttcagcacgtgctcttaacgtacagtga

SEQ ID NO: 3031 - DNA, 796 bp, Homo sapiens
agccaggaggcggaagttcccgcgggcggtggggacggcgccctcaccgcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaaggtcacccagaagagggagagcaggagctctagaagaacagctcctgggctcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacatttgaaagaatctgaagccgataatacaaagaaggcaaaggaaaagataccccttcacgtctttagtcccaaatacacaaaattacgtgactggcaccatgaagtttcagcacgtgctcttaacgtacagtga

SEQ ID NO: 3032 - DNA, 1853 bp, Homo sapiens
cttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtagcatctgctgcacccaagcctgagccggttcctgttcaaaagggagaacctaaagaagtagttaaacctgtgcccattacatctcctgctgtgtccaaagtcacttccacaaacaacatggcctacaataaggcaccacggccttttggttctgtgtcttcaccaaaagtcacatccatcccatcaccatcgtctgccttcaccccagcccatgcgaccacctcatcacatgcttccccttcacccgtggctgccgtcactcctcccctgttcgctgcatctggactgcatgctaatgccaatcttagtgctgaccagtctccatctgcactgagcgctggtaaaactgcagttaatgtcccacggcagcccacagtcaccagcgtgtgttccgagacttctcaggagctagcagagggacagagaagaggatcccagggtgacagtaaacagcaaaatggcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacatttgaaagaatctgaagccgataatacaaagaaggcaaataactctcaggagccttctccgcagttggcttcctcggtagcttccacacggagcatgcccgagagcctggacagcccaacctctggcagaccaggggttaccagcctcacagctgcagctgccttcaagcctgtaggatccactggcgtcatcaagtcaccaagctggcaacggccaaaccaaggagtaccttccactggaagaatctcaaacagcgctacttactcaggatcagtggcaccagccaactcagctttgggacaaacccagccaagtgaccaggacactttagtgcaaagagctgagcacattccagcagggaaacgaactccgatgtgcgcccattgtaaccaggtcatcagaggaccattcttagtggcactggggaaatcttggcacccagaagaattcaactgcgctcactgcaaaaatacaatggcctacattggatttgtagaggagaaaggagccctgtattgtgagctgtgctatgagaaattctttgcccctgaatgtggtcgatgccaaaggaagatccttggagaagtcatcagtgcgttgaaacaaacttggcatgtttcctgttttgtgtgtgtagcctgtggaaagcccattcggaacaatgtttttcacttggaggatggtgaaccctactgtgagactgattattatgccctctttggtactatatgccatggatgtgaatttcccatagaagctggtgacatgttcctggaagctctgggctacacctggcatgacacttgctttgtatgctcagtgtgttgtgaaagtttggaaggtcagacctttttctccaagaaggacaagcccctgtgtaagaaacatgctcattctgtgaatttttgaaagtcaacagttcaggagaagagaaggaatttgaagagaaaaaggaaaattaaaattactaattaatttttagattcaatatttatatggagttttgaaaaataatagtggccctgaag

SEQ ID NO: 3033 - DNA, 1186 bp, Homo sapiens
gagccaggaggcggaagttcccgcgggcggtggggacggcgccctcaccgcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtgctggagtgcagtggcgcaatctcggctcaccacaacctccatctcccgagttcaagcgattctcctgcctcagcctcccgagtagctgggattacaggcatgtgccaccacgcctggctaattttgtatttttagtagagaccaagtttccctatgttggtcaggctggtcttgaactcccgacctcaggtgatctgcccacctcggcctcccaaagtgctaagattacaggcgtgagccaccgtgcctggcccacactgttttatactttgcttttttttgcaacaatttaccctgagatcattctctattaatatataaggaggtatgtgtgtttttttaaaacaattgtataattttattttataaggaaagtgacatttaaccaatcccctactgaagagtatttgtggcatttccatattactgttacagtggtacagtgaataccaaatataagtacatacatatatatgtgaatatatgtatctacgtcattttgaaaggttgtgccaatttacacttttgtgcaacgcatgaaaatactatttttgtgccagtcttaccaacaaacttggatatttatcaagtgctgtgaatgcatcatctcatttaattatcataccaacatgcaaaatagtgatattattcccattgtatataactgtgctgtgcgctcacatgactgtatggaagagctggctttccaacagttatgctgtgctgcctctttaataattcactttaccttaaatttagttagttgtttctttaatcagatatttagaagattgtcattttggttaataatatatgtgtatgtataaatatatatacacacacatactctgcatcttgtatgtgtatccaacttcattttgaaagattaaaaataagtttgtaacgcctaaatatccttattaaaatactgcaaatc

SEQ ID NO: 3034 - DNA, 977 bp, Homo sapiens
ctccctggagcccgacgcagagcagcgccctggccgggccaagcaggagccggcatcatggattccttcaaagtagtgctggaggggccagcaccttggggcttccggctgcaagggggcaaggacttcaatgtgcccctctccatttcccggctcactcctgggggcaaagcggcgcaggccggagtggccgtgggtgactgggtgctgagcatcgatggcgagaatgcgggtagcctcacacacatcgaagctcagaacaagatccgggcctgcggggagcgcctcagcctgggcctcagcagggcccagccggttcagagcaaaccgcagaaggcctccgcccccgccgcggaccctccgcggtacacctttgcacccagcgtctccctcaacaagacggcccggccctttggggcgcccccgcccgctgacagcgccccgcagcagaatggacagccgctccgaccgctggtcccagatgccagcaagcagcggctgatggagaacacagaggactggcggccgcggccggggacaggccagtcgcgttccttccgcatccttgcccacctcacaggcaccgagttcatgcaagacccggatgaggagcacctgaagaaatcaagggaaaagtatgtcctggagctgcagagcccacgctacacccgcctccgggactggcaccaccagcgctctgcccacgtgctcaacgtgcagtcgtagcccggccctctccagccggctgccctctctgcctccctctttctgttcctcctgcccagggcacccccttagtgcctccagcttctgcctacctcaccccccctttcgtgcccctggcctgagcctcctgctggcctggccctggccgcccacctgggttcatctgacactgccttccctctttgccctgtggtactgctgtctgccaggtctgtgctgccttgggcatggaataaacattctcagccctg

SEQ ID NO: 3035 - DNA, 1689 bp, Homo sapiens
cccaacgaggctccctggagcccgacgcagagcagcgccctggccgggccaagcaggagccggcatcatggattccttcaaagtagtgctggaggggccagcaccttggggcttccggctgcaagggggcaaggacttcaatgtgcccctctccatttcccggctcactcctgggggcaaagcggcgcaggccggagtggccgtgggtgactgggtgctgagcatcgatggcgagaatgcgggtagcctcacacacatcgaagctcagaacaagatccgggcctgcggggagcgcctcagcctgggcctcagcagggcccagccggttcagagcaaaccgcagaaggcctccgcccccgccgcggaccctccgcggtacacctttgcacccagcgtctccctcaacaagacggcccggccctttggggcgcccccgcccgctgacagcgccccgcagcagaatggacagccgctccgaccgctggtcccagatgccagcaagcagcggctgatggagaacacagaggactggcggccgcggccggggacaggccagtcgcgttccttccgcatccttgcccacctcacaggcaccgagttcatgcaagacccggatgaggagcacctgaagaaatcaagccaggtgcccaggacagaagccccagccccagcctcatctacaccccaggagccctggcctggccctaccgcccccagccctaccagccgcccgccctgggctgtggaccctgcgtttgccgagcgctatgccccggacaaaacgagcacagtgctgacccggcacagccagccggccacgcccacgccgctgcagagccgcacctccattgtgcaggcagctgccggaggggtgccaggagggggcagcaacaacggcaagactcccgtgtgtcaccagtgccacaaggtcatccggggccgctacctggtggcgctgggccacgcgtaccacccggaggagtttgtgtgtagccagtgtgggaaggtcctggaagagggtggcttctttgaggagaagggcgccatcttctgcccaccatgctatgacgtgcgctatgcacccagctgtgccaagtgcaagaagaagattacaggcgagatcatgcacgccctgaagatgacctggcacgtgcactgctttacctgtgctgcctgcaagacgcccatccggaacagggccttctacatggaggagggcgtgccctattgcgagcgagactatgagaagatgtttggcacgaaatgccatggctgtgacttcaagatcgacgctggggaccgcttcctggaggccctgggcttcagctggcatgacacctgcttcgtctgtgcgatatgtcagatcaacctggaaggaaagaccttctactccaagaaggacaggcctctctgcaagagccatgccttctctcatgtgtgagccccttctgcccacagctgccgcggtggcccctagcctgaggggcctggagtcgtggccctgcatttctgggtagggctggcaatggttgccttaaccctggctcctggcccgagcctggggctccctgggccctgccccacccaccttatcctcccaccccactccctccaccaccacagcacaccggtgctggccacaccagccccctttcacctccagtgccacaataaacctgtacccagctg

SEQ ID NO: 3036 - DNA, 1647 bp, Homo sapiens
agaacactggcggccgatcccaacgaggctccctggagcccgacgcagagcagcgccctggccgggccaagcaggagccggcatcatggattccttcaaagtagtgctggaggggccagcaccttggggcttccggctgcaagggggcaaggacttcaatgtgcccctctccatttcccggctcactcctgggggcaaagcggcgcaggccggagtggccgtgggtgactgggtgctgagcatcgatggcgagaatgcgggtagcctcacacacatcgaagctcagaacaagatccgggcctgcggggagcgcctcagcctgggcctcagcagggcccagccggttcagagcaaaccgcagaaggcctccgcccccgccgcggaccctccgcggtacacctttgcacccagcgtctccctcaacaagacggcccggccctttggggcgcccccgcccgctgacagcgccccgcagcagaatggacagccgctccgaccgctggtcccagatgccagcaagcagcggctgatggagaacacagaggactggcggccgcggccggggacaggccagtcgcgttccttccgcatccttgcccacctcacaggcaccgagttcatgcaagacccggatgaggagcacctgaagaaatcaaggccctaccgcccccagccctaccagccgcccgccctgggctgtggaccctgcgtttgccgagcgctatgccccggacaaaacgagcacagtgctgacccggcacagccagccggccacgcccacgccgctgcagagccgcacctccattgtgcaggcagctgccggaggggtgccaggagggggcagcaacaacggcaagactcccgtgtgtcaccagtgccacaaggtcatccggggccgctacctggtggcgctgggccacgcgtaccacccggaggagtttgtgtgtagccagtgtgggaaggtcctggaagagggtggcttctttgaggagaagggcgccatcttctgcccaccatgctatgacgtgcgctatgcacccagctgtgccaagtgcaagaagaagattacaggcgagatcatgcacgccctgaagatgacctggcacgtgcactgctttacctgtgctgcctgcaagacgcccatccggaacagggccttctacatggaggagggcgtgccctattgcgagcgagactatgagaagatgtttggcacgaaatgccatggctgtgacttcaagatcgacgctggggaccgcttcctggaggccctgggcttcagctggcatgacacctgcttcgtctgtgcgatatgtcagatcaacctggaaggaaagaccttctactccaagaaggacaggcctctctgcaagagccatgccttctctcatgtgtgagccccttctgcccacagctgccgcggtggcccctagcctgaggggcctggagtcgtggccctgcatttctgggtagggctggcaatggttgccttaaccctggctcctggcccgagcctggggctccctgggccctgccccacccaccttatcctcccaccccactccctccaccaccacagcacaccggtgctggccacaccagccccctttcacctccagtgccacaataaacctgtacccagctgtg

SEQ ID NO: 3037 - DNA, 1567 bp, Homo sapiens
cgacgcagagcagcgccctggccgggccaagcaggagccggcatcatggattccttcaaagtagtgctggaggggccagcaccttggggcttccggctgcaagggggcaaggacttcaatgtgcccctctccatttcccggctcactcctgggggcaaagcggcgcaggccggagtggccgtgggtgactgggtgctgagcatcgatggcgagaatgcgggtagcctcacacacatcgaagctcagaacaagatccgggcctgcggggagcgcctcagcctgggcctcagcagggcccagccggttcagagcaaaccgcagaaggtgcagacccctgacaaacagccgctccgaccgctggtcccagatgccagcaagcagcggctgatggagaacacagaggactggcggccgcggccggggacaggccagtcgcgttccttccgcatccttgcccacctcacaggcaccgagttcatgcaagacccggatgaggagcacctgaagaaatcaagccaggtgcccaggacagaagccccagccccagcctcatctacaccccaggagccctggcctggccctaccgcccccagccctaccagccgcccgccctgggctgtggaccctgcgtttgccgagcgctatgccccggacaaaacgagcacagtgctgacccggcacagccagccggccacgcccacgccgctgcagagccgcacctccattgtgcaggcagctgccggaggggtgccaggagggggcagcaacaacggcaagactcccgtgtgtcaccagtgccacaaggtcatccggggccgctacctggtggcgctgggccacgcgtaccacccggaggagtttgtgtgtagccagtgtgggaaggtcctggaagagggtggcttctttgaggagaagggcgccatcttctgcccaccatgctatgacgtgcgctatgcacccagctgtgccaagtgcaagaagaagattacaggcgagatcatgcacgccctgaagatgacctggcacgtgcactgctttacctgtgctgcctgcaagacgcccatccggaacagggccttctacatggaggagggcgtgccctattgcgagcgagactatgagaagatgtttggcacgaaatgccatggctgtgacttcaagatcgacgctggggaccgcttcctggaggccctgggcttcagctggcatgacacctgcttcgtctgtgcgatatgtcagatcaacctggaaggaaagaccttctactccaagaaggacaggcctctctgcaagagccatgccttctctcatgtgtgagccccttctgcccacagctgccgcggtggcccctagcctgaggggcctggagtcgtggccctgcatttctgggtagggctggcaatggttgccttaaccctggctcctggcccgagcctggggctccctgggccctgccccacccaccttatcctcccaccccactccctccaccaccacagcacaccggtgctggccacaccagccccctttcacctccagtgccacaataaacctgtacccagctgtg

SEQ ID NO: 3038 - DNA, 759 bp, Homo sapiens
ggggaggccgcgccagtttagtccctcggcccacccctggttgcaaagaacctcaagcctggattcaggcacccctcaccgttccagtcccaaggggaggggggctgctcctgtctttccaaagtgaggtccgccagccagcagcccaggccagcctgacaaaatacctgcctcctatggcttgggcgtgctcaggggctgcccgtgcctgcctggcccctgtccaaggagccggcatcatggattccttcaaagtagtgctggaggggccagcaccttggggcttccggctgcaagggggcaaggacttcaatgtgcccctctccatttcccggctcactcctgggggcaaagcggcgcaggccggagtggccgtgggtgactgggtgctgagcatcgatggcgagaatgcgggtagcctcacacacatcgaagctcagaacaagatccgggcctgcggggagcgcctcagcctgggcctcagcagggcccagccggttcagagcaaaccgcagaaggcctccgcccccgccgcggaccctccgcggtacacctttgcacccagcgtctccctcaacaagacggcccggccctttggggcgcccccgcccgctgacagcgccccgcagcagaatggacagccgctccgaccgctggtcccagatgccagcaagcagcggctgatggagaacacagaggactggcggccgcggccggggacaggccagtcgcgttccttccgcatccttgcccacctca

SEQ ID NO: 3039 - DNA, 636 bp, Homo sapiens
ccggcccctgactcacccggccgcccgaggctccaggctggcttggggggaggccgcgccagtttagtccctcggcccacccctggttgcaaagaacctcaagcctggattcaggcacccctcaccgttccagtcccaaggggaggggggctgctcctgtctttccaaagtgaggtccgccagccagcagcccaggccagcctgacaaaatacctgcctcctatggcttgggcgtgctcaggggctgcccgtgcctgcctggcccctgtccaaggctggtatcctgagctggcccggcctgcctgcctgcccgcccaccatgctggccactcaccttctcttctctcctctcaggagccggcatcatggattccttcaaagtagtgctggaggggccagcaccttggggcttccggctgcaagggggcaaggacttcaatgtgcccctctccatttcccggctcactcctgggggcaaagcggcgcaggccggagtggccgtgggtgactgggtgctgagcatcgatggcgagaatgcgggtagcctcacacacatcgaagctcagaacaagatccgggcctgcggggagcgcctcagcctgggcctcagcagggcccagccggttcagagcaaac

SEQ ID NO: 3040 - DNA, 997 bp, Homo sapiens
aggcgctgcggcaggagggaagatggcggacgaggagaagctgccgcccggctgggagaagcgcatgagccgcagctcaggccgagtgtactacttcaaccacatcactaacgccagccagtgggagcggcccagcggcaacagcagcagtggtggcaaaaacgggcagggggagcctgccagggtccgctgctcgcacctgctggtgaagcacagccagtcacggcggccctcgtcctggcggcaggagaagatcacccggaccaaggaggaggccctggagctgatcaacggctacatccagaagatcaagtcgggagaggaggactttgagtctctggcctcacagttcagcgactgcagctcagccaaggccaggggagacctgggtgccttcagcagaggtcagatgcagaagccatttgaagacgcctcgtttgcgctgcggacgggggagatgagcgggcccgtgttcacggattccggcatccacatcatcctccgcactgagtgagggtggggagcccaggcctggcctcggggcagggcagggcggctaggccggccagctcccccttgcccgccagccagtggccgaaccccccactccctgccaccgtcacacagtatttattgttcccacaatggctgggagggggcccttccagattgggggccctggggtccccactccctgtccatccccagttggggctgcgaccgccagattctcccttaaggaattgacttcagcaggggtgggaggctcccagacccagggcagtgtggtgggaggggtgttccaaagagaaggcctggtcagcagagccgccccgtgtccccccaggtgctggaggcagactcgagggccgaattgtttctagttaggccacgctcctctgttcagtcgcaaaggtgaacactcatgcggcccagccatgggccctctgagcaactgtgcagcaccctttcacccccaattaaacccagaaccact

SEQ ID NO: 3041 - DNA, 1672 bp, Homo sapiens
cgcgtaagcagggctcgagctcgccccttgggcgcggcggcagcgctgcctccctcccatggggtcctggctcttccgcgtcgtccccggggtaacggccccggcccgccctgttgtggggactgcgagcctcaggagccgccgggaagcctgaggaagctgaggcagggggctgggcgggtgagggtccggggagtccggggcgatggccctggccctgccggcccggctgatacctctcggcctaatgcacctgacaccccgggggacgtctctgcaccttgctgggcccgggggcacccctgggagggagacaccccagtaccctgcaaagggcgtagggtgttgcccggcctcgggtccacaacctacccctgctaacacccctactgtgtacacctaatgctgagtctgcgacatcgcccgtgacattctgccagacgatggcccctgtgcttaggcccgatttaagggttagccacaatgataatattgccagtaacagggcatgtttttctctgtgtcaagcgctttaagttctctctgaattgccgcaactctgggagccagatgagaaaactgaggtgcagggagattagagcccattgccaaggttttagagtgagtcagtagctcagctgcatttgcacctggaacccgcgctctcgcccaccctgctctagccctggcctgtggctgggacctccagcataaaccggatgctctgcccagctctgggcccatttctgctgtttctgctcagttcaaccctgatggcttcctttatgggtgacactccatgtcacccaggcgaactgtcagcctttggagtggcacccagtagggtctttacttccagtttcttgttcacagtcttcactccttcatacccctcactccctgggtaacatcgggccaccagtaatgctggttcctagctctgcaacaccatgcacggtgtagtagctaagagcagagctttcgggtgtgaagtacctgagtacagttcctgccttcccctgtgtgtgcctggaacagagtaaacactcaggaagcgttacccactgctgccattcccagagatgcaaaaggccgagtgtactacttcaaccacatcactaacgccagccagtgggagcggcccagcggcaacagcagcagtggtggcaaaaacgggcagggggagcctgccagggtccgctgctcgcacctgctggtgaagcacagccagtcacggcggccctcgtcctggcggcaggagaagatcacccggaccaaggaggaggccctggagctgatcaacggctacatccagaagatcaagtcgggagaggaggactttgagtctctggcctcacagttcagcgactgcagctcagccaaggccaggggagacctgggtgccttcagcagaggtcagatgcagaagccatttgaagacgcctcgtttgcgctgcggacgggggagatgagcgggcccgtgttcacggattccggcatccacatcatcctccgcactgagtgctggaggcagactcgagggccgaattgtttctagttaggccacgctcctctgttcagtcgcaaaggtgaacactcatgcggcccagccatgggccctctgagcaactgtgcagcaccctttcacccccaattaaacccagaaccactg

SEQ ID NO: 3042 - DNA, 1656 bp, Homo sapiens
aggcgctgcggcaggagggaagatggcggacgaggagaagctgccgcccggctgggagaagcgcatgagccgcagctcaggccgagtgtactacttcaaccacatcactaacgccagccagtgggagcggcccagcggcaacagcagcagtggtggcaaaaacgggcagggggagcctgccagggtccgctgctcgcacctgctggtgaagcacagccagtcacggcggccctcgtcctggcggcaggagaagatcacccggaccaaggaggaggccctggagctgatcaacggctacatccagaagatcaagtcgggagaggaggactttgagtctctggcctcacagttcagcgactgcagctcagccaaggccaggggagacctgggtgccttcagcagaggtgcgcaaggaatgggcctcaccaggttgggggacccttaccaccctgaggggtagaggccaggagggtctgggcattgggctcccaggtgccacaccggccttcggggtccagcaggtggcagcacagccccttcctcaggcttcagaggctgctctgctgggcagggccagggccacacagggaggggggctgcagcactttcttcctggcatcatctctaccctggggggcatggtctcttgtgtgtctgtgcacgtgtcttagtggggtggggcggcagcatggggccagcagctgcccacctcctccgaggaggctggtgggacagatgacatggcagggctgggaaccaggcccagggagacgagttcactaccgaagtggcccctaaatgcacggcggcggccgtagccctgcctgctatccttcatgctgtcctcgggcttcccagggcctccttaatggccctgccacccccagctgggccgccgctcagcactggcaataaacatggtgacggatgagtgtggacgagtgtgaggctcagcgcaggcaggagccccatctgtcgcggctgccacccgccctgcctcatcctggcctctgccagcccagccctgacacccccaccgcccctcctggctcccaggtcagatgcagaagccatttgaagacgcctcgtttgcgctgcggacgggggagatgagcgggcccgtgttcacggattccggcatccacatcatcctccgcactgagtgagggtggggagcccaggcctggcctcggggcagggcagggcggctaggccggccagctcccccttgcccgccagccagtggccgaaccccccactccctgccaccgtcacacagtatttattgttcccacaatggctgggagggggcccttccagattgggggccctggggtccccactccctgtccatccccagttggggctgcgaccgccagattctcccttaaggaattgacttcagcaggggtgggaggctcccagacccagggcagtgtggtgggaggggtgttccaaagagaaggcctggtcagcagagccgccccgtgtccccccaggtgctggaggcagactcgagggccgaattgtttctagttaggccacgctcctctgttcagtcgcaaaggtgaacactcatgcggcccagccatgggccctctgagcaactgtgcagcaccctttcacccccaattaaacccagaaccactgctctgc

SEQ ID NO: 3043 - DNA, 1329 bp, Homo sapiens
atgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgaggaactacaaaaggatagttattagattgccaaatcctgcagaacctccagcaggcacaagttggtttttctccctcaagaaagagaagtgagccaagcgtggtggtgcatgcctgtggtcccagctactcaggaggctgagccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccgtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagccttttggtgactttatggagcccaagtttgagtttgctgtgaagttcaatgcactggaattagatgacagcgacttggcaatatttattgctgtcattattctcagtggag

SEQ ID NO: 3044 - DNA, 1988 bp, Homo sapiens
ctagtcggctcctcaacgtggagcgatgggaggccttgagaagaagaagtatgaacgaggctcggccaccaactacatcacccggaacaaagcccggaagaagctccagctgagcttggctgactttaggcggctgtgcattctgaagggcatttatccccatgaacccaaacacaagaagaaggttaacaagggttctacagcagcccgaacgttttaccttatcaaagacatcaggtttctcctccacgaacccattgtcaacaagttccgtgaatacaaggtgttcgtccggaagctccggaaggcttatgggaagagcgagtggaacactgtagagcgtttaaaggacaataagcccaactacaaactcgaccacatcatcaaggaacggtatcccacgttcatcgatgccctgcgggacctggacgatgccctctccatgtgcttcctgttttccaccttcccgcggactggcaagtgccacgtgcagaccattcagctgtgccgccggctcactgtggagttcatgcactacattatcgctgcccgtgccctgcgcaaggtcttcctgtccatcaaaggcatttactaccaggccgaggtactggggcagcccatcgtgtggatcactccctatgccttctcccatgaccacccgacagacgtggactacagggtcatggccaccttcaccgagttctacaccacgctgctgggctttgtcaacttccgcctttaccagttgctcaacctccactatcccccgaagctcgagggtcaggcccaagcagaggcaaaggccggtgagggcacctacgcgttggactccgagagttgtatggagaaactggcagccctcagtgccagcctggcccgcgtggtggtgcctgccacagaggaggaggccgaggtggatgagtttcccaccgatggggaggaagaccgcaggaaggagctggaggcgcaggagaagcacaagaagctttttgagggcctgaagttcttcctgaaccgagaggtgccccgtgaggccctggccttcatcatcaggagttttggtggggaagtgtcctgggacaaatctttgtgcattggggccacctatgacgtcacagactcccgcatcacccatcagattgtcgaccggcctgggcagcagacctcagtcattggcaggtgctacgtgcagccccagtgggtgtttgactcagtgaacgccaggctccttctccccgtggcagagtacttctctggggtgcagctgcccccacacctttcaccctttgtgaccgagaaggaaggagattacgttccacctgagaagctgaagctgctggctctgcagcggggagaggacccaggaaacctgaatgagtcagaagaggaggaggaagaggacgacaacaacgaaggtgatggtgatgaagagggagaaaatgaggaggaggaggaagatgcagaggctggttcagaaaaggaggaagaggcccggctggcagccctggaagagcagaggatggaggggaagaagcccagggtgatggcaggcaccttgaagctggaggataagcagcggctggcccaggaggaggagagtgaggccaagcgcctggccattatgatgatgaagaagcgggagaagtacctgtaccagaagatcatgtttggcaagaggcgaaaaatccgagaggccaacaagctggcggagaagcggaaagcccacgatgaggcggtgaggtctgagaagaaggccaagaaggcaaggccggagtgagtgcctgcggcccctcacagggctgaggccagcccctagcagctggatgtggcagaggcaggccagaggacctaagtgtgatggaccagagtcacttctcctcctcctttctccagccagccctgacccctcatgctctctggctgggccagtgggcagccctcgcttcccttggatggagctgccctgctggtgcctggtcagagaagag

SEQ ID NO: 3045 - DNA, 2292 bp, Homo sapiens
agacagcgtggggtggggagggtcctcggggtccttggcagggcacgtgcgggaggaagtggagctccctgtacgcgcggccctagtcggctcctcaacgtggagcgatgggaggccttgagaagaagaagtatgaacgaggctcggccaccaactacatcacccggaacaaagcccggaagaagctccagctgagcttggctgactttaggcggctgtgcattctgaagggcatttatccccatgaacccaaacacaagaagaaggttaacaagggttctacagcagcccgaacgttttaccttatcaaagacatcaggtttctcctccacgaacccattgtcaacaagttccgtgaatacaaggtgttcgtccggaagctccggaaggcttatgggaagagcgagtggaacactgtagagcgtttaaaggacaataagcccaactacaaactcgaccacatcatcaaggaacggtatcccacgttcatcgatgccctgcgggacctggacgatgccctctccatgtgcttcctgttttccaccttcccgcggactggcaagtgccacgtgcagaccattcagctgtgccgccggctcactgtggagttcatgcactacattatcgctgcccgtgccctgcgcaaggtcttcctgtccatcaaaggcatttactaccaggccgaggtactggggcagcccatcgtgtggatcactccctatgccttctcccatgaccacccgacagacgtggactacagggtcatggccaccttcaccgagttctacaccacgctgctgggctttgtcaacttccgcctttaccagttgctcaacctccactatcccccgaagctcgagggtcaggcccaagcagaggcaaaggccggtgagggcacctacgcgttggactccgagagttgtatggagaaactggcagccctcagtgccagcctggcccgcgtggtggtgcctgccacagaggaggaggccgaggtggatgagtttcccaccgatggggagatgtcagcgcaggaggaagaccgcaggaaggagctggaggcgcaggagaagcacaagaagctttttgagggcctgaagttcttcctgaaccgagaggtgccccgtgaggccctggccttcatcatcaggagttttggtggggaagtgtcctgggacaaatctttgtgcattggggccacctatgacgtcacagactcccgcatcacccatcagattgtcgaccggcctgggcagcagacctcagtcattggcaggtgctacgtgcagccccagtgggtgtttgactcagtgaacgccaggctccttctccccgtggcagagtacttctctggggtgcagctgcccccacacctttcaccctttgtgaccgagaaggaaggagattacgttccacctgagaagctgaagctgctggctctgcagcggggagaggacccaggaaacctgaatgagtcagaagaggaggaggaagaggacgacaacaacgaaggtgatggtgatgaagagggagaaaatgaggaggaggaggaagatgcagaggctggttcagaaaaggaggaagaggcccggctggcagccctggaagagcagaggatggaggggaagaagcccagggtgatggcaggcaccttgaagctggaggataagcagcggctggcccaggaggaggagagtgaggccaagcgcctggccattatgatgatgaagaagcgggagaagtacctgtaccagaagatcatgtttggcaagaggcgaaaaatccgagaggccaacaagctggcggagaagcggaaagcccacgatgaggcggtgaggtctgagaagaaggccaagaaggcaaggccggagtgagtgcctgcggcccctcacagggctgaggccagcccctagcagctggatgtggcagaggcaggccagaggacctaagtgtgatggaccagagtcacttctcctcctcctttctccagccagccctgacccctcatgctctctggctgggccagtgggcagccctcgcttcccttggatggagctgccctgctggtgcctggtcagagaagaggcctctgtgcccagcctgattctctgctcccaggagccagtgacatgaggtgcagaggcccacccagccccctacctactgcccccattcatcctggctttccacagccccctcccacacagttggacccgtgattctcagggtgctgtgatggggtgagggtagggggagcatttgttattaaatgactggacttttgtgccaatt

SEQ ID NO: 3046 - DNA, 2760 bp, Homo sapiens
agggaacaaagggaggaggagggctagtgggaccatgtgagacatcttgaggccattcacgttcctgcttaaagagcccgggaccagcgcagagggcctgatgcctgatctgtcaagtctgtccgaccgtgcctgtctgctgtccccccagctgttccagtggtggattggcaggaccgggtgcctacccggtactccttaccaaaggagcccctggtagtgcccacctagcccaggacaaggagtggaacgggagctgcagctgcagtggtcacgaaggcagcctggaggaggtggccatggaggatagccttcgttatcgtcagcctctgccgcataaccgcgaatgaaccaaagagaacccgaagccggtgggaactcagcgcagtctcaccctgcccctcgggaaccgcttctcagcagcggcagccgaagtctgacgacgcttagcaaccgttaccttgacaacgcaatcctatcgcgcaccatggagtgcggcgcccctctgcatcccagaaggcaccgcgctgtccctaagccttccgcccctctccgtcccaacatgcaacgaggctcacagtcaatgaatcgtcatcaggtatgaacgaggctcggccaccaactacatcacccggaacaaagcccggaagaagctccagctgagcttggctgactttaggcggctgtgcattctgaagggcatttatccccatgaacccaaacacaagaagaaggttaacaagggttctacagcagcccgaacgttttaccttatcaaagacatcaggtttctcctccacgaacccattgtcaacaagttccgtgaatacaaggtgttcgtccggaagctccggaaggcttatgggaagagcgagtggaacactgtagagcgtttaaaggacaataagcccaactacaaactcgaccacatcatcaaggaacggtatcccacgttcatcgatgccctgcgggacctggacgatgccctctccatgtgcttcctgttttccaccttcccgcggactggcaagtgccacgtgcagaccattcagctgtgccgccggctcactgtggagttcatgcactacattatcgctgcccgtgccctgcgcaaggtcttcctgtccatcaaaggcatttactaccaggccgaggtactggggcagcccatcgtgtggatcactccctatgccttctcccatgaccacccgacagacgtggactacagggtcatggccaccttcaccgagttctacaccacgctgctgggctttgtcaacttccgcctttaccagttgctcaacctccactatcccccgaagctcgagggtcaggcccaagcagaggcaaaggccggtgagggcacctacgcgttggactccgagagttgtatggagaaactggcagccctcagtgccagcctggcccgcgtggtggtgcctgccacagaggaggaggccgaggtggatgagtttcccaccgatggggagatgtcagcgcaggaggaagaccgcaggaaggagctggaggcgcaggagaagcacaagaagctttttgagggcctgaagttcttcctgaaccgagaggtgccccgtgaggccctggccttcatcatcaggagttttggtggggaagtgtcctgggacaaatctttgtgcattggggccacctatgacgtcacagactcccgcatcacccatcagattgtcgaccggcctgggcagcagacctcagtcattggcaggtgctacgtgcagccccagtgggtgtttgactcagtgaacgccaggctccttctccccgtggcagagtacttctctggggtgcagctgcccccacacctttcaccctttgtgaccgagaaggaaggagattacgttccacctgagaagctgaagctgctggctctgcagcggggagaggacccaggaaacctgaatgagtcagaagaggaggaggaagaggacgacaacaacgaaggtgatggtgatgaagagggagaaaatgaggaggaggaggaagatgcagaggctggttcagaaaaggaggaagaggcccggctggcagccctggaagagcagaggatggaggggaagaagcccagggtgatggcaggcaccttgaagctggaggataagcagcggctggcccaggaggaggagagtgaggccaagcgcctggccattatgatgatgaagaagcgggagaagtacctgtaccagaagatcatgtttggcaagaggcgaaaaatccgagaggccaacaagctggcggagaagcggaaagcccacgatgaggcggtgaggtctgagaagaaggccaagaaggcaaggccggagtgagtgcctgcggcccctcacagggctgaggccagcccctagcagctggatgtggcagaggcaggccagaggacctaagtgtgatggaccagagtcacttctcctcctcctttctccagccagccctgacccctcatgctctctggctgggccagtgggcagccctcgcttcccttggatggagctgccctgctggtgcctggtcagagaagaggcctctgtgcccagcctgattctctgctcccaggagccagtgacatgaggtgcagaggcccacccagccccctacctactgcccccattcatcctggctttccacagccccctcccacacagttggacccgtgattctcagggtgctgtgatggggtgagggtagggggagcatttgttattaaatgactggacttttgtgccaatt

SEQ ID NO: 3047 - DNA, 2708 bp, Homo sapiens
gcctgatgcctgatctgtcaagtctgtccgaccgtgcctgtctgctgtccccccagctgttccagtggtggattggcaggaccgggtgcctacccggtactccttaccaaaggagcccctggtagtgcccacctagcccaggacaaggagtggaacgggagctgcagctgcagtggtcacgaaggcagcctggaggaggtggccatggaggatagccttcgttatcgtcagcctctggtgagaagcagcagcatccttccagagagtcacttctgatccccaagccgcataaccgcgaatgaaccaaagagaacccgaagccggtgggaactcagcgcagtctcaccctgcccctcgggaaccgcttctcagcagcggcagccgaagtctgacgacgcttagcaaccgttaccttgacaacgcaatcctatcgcgcaccatggagtgcggcgcccctctgcatcccagaaggcaccgcgctgtccctaagccttccgcccctctccgtcccaacatgcaacgaggctcacagtcaatgaatcgtcatcaggtatgaacgaggctcggccaccaactacatcacccggaacaaagcccggaagaagctccagctgagcttggctgactttaggcggctgtgcattctgaagggcatttatccccatgaacccaaacacaagaagaaggttaacaagggttctacagcagcccgaacgttttaccttatcaaagacatcaggtttctcctccacgaacccattgtcaacaagttccgtgaatacaaggtgttcgtccggaagctccggaaggcttatgggaagagcgagtggaacactgtagagcgtttaaaggacaataagcccaactacaaactcgaccacatcatcaaggaacggtatcccacgttcatcgatgccctgcgggacctggacgatgccctctccatgtgcttcctgttttccaccttcccgcggactggcaagtgccacgtgcagaccattcagctgtgccgccggctcactgtggagttcatgcactacattatcgctgcccgtgccctgcgcaaggtcttcctgtccatcaaaggcatttactaccaggccgaggtactggggcagcccatcgtgtggatcactccctatgccttctcccatgaccacccgacagacgtggactacagggtcatggccaccttcaccgagttctacaccacgctgctgggctttgtcaacttccgcctttaccagttgctcaacctccactatcccccgaagctcgagggtcaggcccaagcagaggcaaaggccggtgagggcacctacgcgttggactccgagagttgtatggagaaactggcagccctcagtgccagcctggcccgcgtggtggtgcctgccacagaggaggaggccgaggtggatgagtttcccaccgatggggagatgtcagcgcaggaggaagaccgcaggaaggagctggaggcgcaggagaagcacaagaagctttttgagggcctgaagttcttcctgaaccgagaggtgccccgtgaggccctggccttcatcatcaggagttttggtggggaagtgtcctgggacaaatctttgtgcattggggccacctatgacgtcacagactcccgcatcacccatcagattgtcgaccggcctgggcagcagacctcagtcattggcaggtgctacgtgcagccccagtgggtgtttgactcagtgaacgccaggctccttctccccgtggcagagtacttctctggggtgcagctgcccccacacctttcaccctttgtgaccgagaaggaaggagattacgttccacctgagaagctgaagctgctggctctgcagcggggagaggacccaggaaacctgaatgagtcagaagaggaggaggaagaggacgacaacaacgaaggtgatggtgatgaagagggagaaaatgaggaggaggaggaagatgcagaggctggttcagaaaaggaggaagaggcccggctggcagccctggaagagcagaggatggaggggaagaagcccagggtgatggcaggcaccttgaagctggaggataagcagcggctggcccaggaggaggagagtgaggccaagcgcctggccattatgatgatgaagaagcgggagaagtacctgtaccagaagatcatgtttggcaagaggcgaaaaatccgagaggccaacaagctggcggagaagcggaaagcccacgatgaggcggtgaggtctgagaagaaggccaagaaggcaaggccggagtgagtgcctgcggcccctcacagggctgaggccagcccctagcagctggatgtggcagaggcaggccagaggacctaagtgtgatggaccagagtcacttctcctcctcctttctccagccagccctgacccctcatgctctctggctgggccagtgggcagccctcgcttcccttggatggagctgccctgctggtgcctggtcagagaagaggcctctgtgcccagcctgattctctgctcccaggagccagtgacatgaggtgcagaggcccacccagccccctacctactgcccccattcatcctggctttccacagccccctcccacacagttggacccgtgattctcagggtgctgtgatggggtgagggtagggggagcatttgttattaaatgactggacttttgtgcc

SEQ ID NO: 3048 - DNA, 6156 bp, Homo sapiens
atggagcccgccgccgcggccacggtacagcgactccccgagctcggcagggaggaccgagcttcggctccggcggccgccgctgcggcagcagcagcagcagcggcggccgcggcggctctggcggcggcggccgggggcggccggagtccggagcccgcgctgaccccggcggccccgagcggcgggaacggcagcggcagcggggcgcgggaagaggccccaggcgaggcgccgccggggccgctgccgggcagagcggggggtgccgggcgcaggaggcggcgcggggcgccccagcccattgccggcggggctgcccccgtacccggggccggcggcggcgccaactccctcctgctgaggagagggcggctgaagaggaatctgtccgcggccgccgcggccgcctcctcgtcgtcgtcgtcctcggccgctgctgcctcgcactcccccggcgctgccggcctccccgcctcctgctcggcctcggcgtcgctgtgcacccggagcctggacaggaagacgctgcttctgaagcaccggcagacgctgcagctgcagccgtcggaccgggactgggtgaggcaccagctccagcgcggctgcgtgcacgtcttcgaccgccacatggcctcgacctacctgcgcccggtgctctgcacactggacaccacggccggcgaggtggccgcccgcctgctgcagctgggccacaaaggcggcggcgtggtgaaggtgctgggccaggggcccggagccgccgccgcccgggagcccgctgaaccgccccccgaggccggcccccggctggcgcccccggagccgcgggactcggaggtaccgcccgcgaggagcgcgccgggtgccttcggggggcctccgcgcgcgccccccgccgacctacccctgcccgtcggcggcccgggcgggtggtcgcgccgcgccagcccagcgccctcggactccagccccggcgagccgttcgttgggggccctgtctcttcgccccgcgccccacggcctgtggtctccgacaccgagagcttcagtctgagtcccagcgccgagagcgtgtctgaccggttggacccctacagcagcggcggcggctcctcgtcgtcgtcggaagagctcgaggccgacgcagcctcggccccgacgggggtcccgggccagccccgccgtcccggccaccccgcgcagcccctcccgcttccccagacggcttcctcgcctcagccgcagcagaaagccccgagggccattgacagcccgggcggggccgtccgcgaggggtcgtgcgaggagaaggcagcggcagccgtggccccgggaggcctccagtctacccccgggaggagcggggtgaccgcggagaaggcgcctccgccgcccccgccgcccaccctgtacgtgcagctccacggagagaccacccggcgcttggaggcggaggagaagccattgcagatccaaaatgactacctcttccaactgggatttggggagctgtggagggtgcaggaggaaggcatggactcggagattggctgcctcatccgcttctatgcaggaaaacctcacagcacgggtagctctgaacggattcagctctcaggaatgtataatgtccgtaaaggcaagatgcagttgccagtgaaccgatggacaagacgccaagtcatcctatgtgggacctgcctgatagtatcatctgtgaaagacagcttgaccggaaagatgcatgttctgccactaattggtggaaaagtagaagaagtgaaaaagcaccaacactgtttagcatttagctcctctggaccccaaagccagacttactacatttgctttgatactttcacagaatacttaaggtggctgcgacaagtctccaaggttgcatcccagcgcattagctcagtggacctctcgtgttgtagcctggaacatctgcctgccaacctcttctacagccaagacctcactcatctcaatttaaaacaaaacttcctaaggcagaaccctagccttccagctgccagggggcttaatgaactgcaaaggttcaccaagttgaagagtcttaacctttccaataatcatttaggggacttcccactggcagtctgcagtattccaaccctggcagagctgaacgtgtcctgcaatgccctgcgatcagtcccggcagccgttggagtgatgcacaacttacagacatttttgttggatggaaactttctccaatcccttcctgctgagttggagaacatgaagcagcttagttatctgggtctttctttcaatgaatttactgacattcccgaagtattggagaaattgactgctgtggataaactttgtatgtctggaaactgtgtggagacccttaggctacaggctttaagaaaaatgcctcacattaaacatgtggatctaaggttgaacgtaattaggaagctgatagcagatgaagtggactttctacagcatgttactcagcttgacctacgagacaataagcttggtgatctagatgctatgattttcaacaacattgaagttttacactgtgaaaggaatcaactggtcacattagacatctgtggctatttcctaaaagcgctctatgcctcttctaatgaacttgttcaacttgatgtttacccagttccaaattatctgtcctacatggatgtttcaaggaaccgcttagaaaatgtgcctgagtgggtatgtgaaagccgaaagctagaagttttggatattggccataatcaaatatgtgaacttcctgcccgcttattttgtaatagcagtctccggaaactactggcaggacacaaccagttggcaaggctgcctgaaaggctagaaagaacctcggtggaggtcttggatgtgcaacacaaccagctccttgagctcccacctaaccttctgatgaaggctgacagcctgagattcctgaacgcctctgcgaacaaactggaaagccttcctccagccacgctttccgaagagacaaacagtatcttacaagagttgtatttgacaaataacagcctcacagacaaatgtgtgcccttgttaacgggacacccccatttgaagatccttcacatggcctataaccgacttcagagttttccagcaagtaaaatggcgaaactggaggaacttgaagaaattgatctcagtgggaataagctgaaagccatcccaacaacgatcatgaattgcaggcgcatgcacaccgtgattgctcactccaactgcatcgaggtctttcccgaagttatgcagctcccagagatcaagtgtgtggacctgagctgtaatgagctaagtgaagtcacattaccagaaaacctgcctcccaaactgcaggagctagacctgactggaaacccgcgccttgtccttgatcacaaaaccctggaactactgaataatatccgctgtttcaagattgatcagccttctacaggagacgcttccggagccccagctgtatggagtcatggttacactgaagcttcgggggtaaaaaacaagttgtgtgtcgcagccctgtcggtgaataacttctgtgacaaccgcgaagccctgtatggtgtgtttgacggagaccggaatgtggaggtgccctaccttctccagtgcactatgagtgacattttggctgaagagctgcaaaaaacaaaaaacgaagaagaatacatggtcaatacattcattgtcatgcaaaggaaacttggaactgctgggcagaagcttggtggtgccgctgtcctttgtcatatcaagcatgaccctgtggatccaggaggatccttcaccttgacctctgctaatgtgggcaagtgccaaacagttctctgtcgaaatggaaagccgctgcctctgtccagatcttacatcatgagctgtgaagaagagctgaagaggattaaacagcacaaggccattatcactgaggatggcaaggtgaacggagtgactgagtccacgcgcatcctgggctacaccttcctccatcccagtgtggtgcctcgcccccacgtgcagtccgtgctcctgactccccaggatgagttcttcatcctaggcagtaaggggttgtgggacagcctgtccgtcgaggaggccgtggaagccgtgcgcaacgtgcccgatgccctggctgctgccaagaagctgtgtaccctggcccagagctacggctgccacgacagcatcagcgctgtggtggtgcagctcagtgtcactgaggacagcttctgctgctgcgagctcagcgccggtggggctgtgccaccacccagtcctggcatctttcctccctcagtgaacatggtgatcaaggatcggccctcagatgggctgggcgtgccgtcctccagcagcggcatggcttccgagattagcagtgagctctccacttctgagatgagcagcgaggtggggtcaacagcctccgatgagcccccgcccggagccctaagcgagaacagccctgcctaccccagtgagcagcgctgcatgctccaccccatctgtctgtccaactccttccagcgccagctatccagcgccacgttctctagcgccttctccgacaacggccttgacagtgacgatgaggagcccatcgagggcgtcttcaccaacggcagccgggtggaggtggaggtggacatccactgcagccgggccaaggagaaggagaaacagcagcacctgcttcaggtgccagcagaggccagtgatgagggcattgtcatcagcgccaacgaggatgagccaggtctgcccaggaaggcagacttctctgccgttgggaccattgggcgccggagggccaatggctctgttgcgccccaggaaaggagccacaatgtgatagaggtggctacagacgcacctcttcgaaagcctggaggctattttgctgccccggctcagccggatcctgatgatcagtttatcatacccccggagctggaagaggaggtcaaagaaatcatgaagcatcaccaggagcaacagcagcagcagcagccgccaccaccccctcagctccagccgcagctgccgcggcactaccagctggaccagctgccagattattacgacacgccactatgacccagccgagctgtttaacaaataaactaaccacaaaagactgagttgcaagagtctcccaggctcacattaaaccaggggttttactccacatccttcccccagacactgttcccaacctgtcatcgcagctaatctgtaggttctctttctttgggttatttttttaagtaatcaccactttcttctagtgatgctttaccaatatgatttacatttgttaacttctccccctaacatatcagatatgtaaagacaaagaacaaaaggtttaatatattacagagaaacagttaatgataatgtaatattttttaaaatggctttttgttgtttgtttggaaggcagggcaggctgccgttgctaaatgatttaataatattgtaattctgtatttctttggggggaaaaggcttttgttttgttttgttttgttttgttttgtttttgtcttgaaaataatagacatttgtagaatatggagactaactcctaggagttgctttactctgtcaggtgacttaagtcactgggattcactaattttctctgagagaacagctgattgagaatttccattgtaaatagctcagtgttgtatagtgaggcttacgatgttttgtagtcttggcgtaaggacacagcccaagtaactgacgtttcccctccccctcccctctgaggagcctgcctgcctcacaactcaccctcacttcactgaatgaggaggctgagcagctgcagtgtttctgtccggaggaaatggatcttaggccactggacaagaacctgcacccaagggccctgaacccattttcctcccctgtcccagccttcccactttgacagacacttttaactgtgttccttactgctgccacaatcagcatggttgtatagtgccccattaggccatttacatacccagagttatactcaagcagaatgcacaaatggacatgtcataatttttgttacaataaatatgaaatttacaagta

SEQ ID NO: 3049 - DNA, 6401 bp, Homo sapiens
ccgcgacccgggcggggagggcgtgtgtcgggggggcggtggcggcgaggcgggcgcgcgggatggaacactgagacaccgacggaatgctccgaatcgccacataatcccctggaacggccgcgcacaacgccattggcttctcccttctccgcgcgccgccgccgtctcccacctccgcctcatcgcctccctctccgcccgctgcctccggagctgggggggaaacgcgaagccccactgcaatggagcccgccgccgcggccacggtacagcgactccccgagctcggcagggaggaccgagcttcggctccggcggccgccgctgcggcagcagcagcagcagcggcggccgcggcggctctggcggcggcggccgggggcggccggagtccggagcccgcgctgaccccggcggccccgagcggcgggaacggcagcggcagcggggcgcgggaagaggccccaggcgaggcgccgccggggccgctgccgggcagagcggggggtgccgggcgcaggaggcggcgcggggcgccccagcccattgccggcggggctgcccccgtacccggggccggcggcggcgccaactccctcctgctgaggagagggcggctgaagaggaatctgtccgcggccgccgcggccgcctcctcgtcgtcgtcgtcctcggccgctgctgcctcgcactcccccggcgctgccggcctccccgcctcctgctcggcctcggcgtcgctgtgcacccggagcctggacaggaagacgctgcttctgaagcaccggcagacgctgcagctgcagccgtcggaccgggactgggtgaggcaccagctccagcgcggctgcgtgcacgtcttcgaccgccacatggcctcgacctacctgcgcccggtgctctgcacactggacaccacggccggcgaggtggccgcccgcctgctgcagctgggccacaaaggcggcggcgtggtgaaggtgctgggccaggggcccggagccgccgccgcccgggagcccgctgaaccgccccccgaggccggcccccggctggcgcccccggagccgcgggactcggaggtaccgcccgcgaggagcgcgccgggtgccttcggggggcctccgcgcgcgccccccgccgacctacccctgcccgtcggcggcccgggcgggtggtcgcgccgcgccagcccagcgccctcggactccagccccggcgagccgttcgttgggggccctgtctcttcgccccgcgccccacggcctgtggtctccgacaccgagagcttcagtctgagtcccagcgccgagagcgtgtctgaccggttggacccctacagcagcggcggcggctcctcgtcgtcgtcggaagagctcgaggccgacgcagcctcggccccgacgggggtcccgggccagccccgccgtcccggccaccccgcgcagcccctcccgcttccccagacggcttcctcgcctcagccgcagcagaaagccccgagggccattgacagcccgggcggggccgtccgcgaggggtcgtgcgaggagaaggcagcggcagccgtggccccgggaggcctccagtctacccccgggaggagcggggtgaccgcggagaaggcgcctccgccgcccccgccgcccaccctgtacgtgcagctccacggagagaccacccggcgcttggaggcggaggagaagccattgcagatccaaaatgactacctcttccaactgggatttggggagctgtggagggtgcaggaggaaggcatggactcggagattggctgcctcatccgcttctatgcaggaaaacctcacagcacgggtagctctgaacggattcagctctcaggaatgtataatgtccgtaaaggcaagatgcagttgccagtgaaccgatggacaagacgccaagtcatcctatgtgggacctgcctgatagtatcatctgtgaaagacagcttgaccggaaagatgcatgttctgccactaattggtggaaaagtagaagaagtgaaaaagcaccaacactgtttagcatttagctcctctggaccccaaagccagacttactacatttgctttgatactttcacagaatacttaaggtggctgcgacaagtctccaaggttgcatcccagcgcattagctcagtggacctctcgtgttgtagcctggaacatctgcctgccaacctcttctacagccaagacctcactcatctcaatttaaaacaaaacttcctaaggcagaaccctagccttccagctgccagggggcttaatgaactgcaaaggttcaccaagttgaagagtcttaacctttccaataatcatttaggggacttcccactggcagtctgcagtattccaaccctggcagagctgaacgtgtcctgcaatgccctgcgatcagtcccggcagccgttggagtgatgcacaacttacagacatttttgttggatggaaactttctccaatcccttcctgctgagttggagaacatgaagcagcttagttatctgggtctttctttcaatgaatttactgacattcccgaagtattggagaaattgactgctgtggataaactttgtatgtctggaaactgtgtggagacccttaggctacaggctttaagaaaaatgcctcacattaaacatgtggatctaaggttgaacgtaattaggaagctgatagcagatgaagtggactttctacagcatgttactcagcttgacctacgagacaataagcttggtgatctagatgctatgattttcaacaacattgaagttttacactgtgaaaggaatcaactggtcacattagacatctgtggctatttcctaaaagcgctctatgcctcttctaatgaacttgttcaacttgatgtttacccagttccaaattatctgtcctacatggatgtttcaaggaaccgcttagaaaatgtgcctgagtgggtatgtgaaagccgaaagctagaagttttggatattggccataatcaaatatgtgaacttcctgcccgcttattttgtaatagcagtctccggaaactactggcaggacacaaccagttggcaaggctgcctgaaaggctagaaagaacctcggtggaggtcttggatgtgcaacacaaccagctccttgagctcccacctaaccttctgatgaaggctgacagcctgagattcctgaacgcctctgcgaacaaactggaaagccttcctccagccacgctttccgaagagacaaacagtatcttacaagagttgtatttgacaaataacagcctcacagacaaatgtgtgcccttgttaacgggacacccccatttgaagatccttcacatggcctataaccgacttcagagttttccagcaagtaaaatggcgaaactggaggaacttgaagaaattgatctcagtgggaataagctgaaagccatcccaacaacgatcatgaattgcaggcgcatgcacaccgtgattgctcactccaactgcatcgaggtctttcccgaagttatgcagctcccagagatcaagtgtgtggacctgagctgtaatgagctaagtgaagtcacattaccagaaaacctgcctcccaaactgcaggagctagacctgactggaaacccgcgccttgtccttgatcacaaaaccctggaactactgaataatatccgctgtttcaagattgatcagccttctacaggagacgcttccggagccccagctgtatggagtcatggttacactgaagcttcgggggtaaaaaacaagttgtgtgtcgcagccctgtcggtgaataacttctgtgacaaccgcgaagccctgtatggtgtgtttgacggagaccggaatgtggaggtgccctaccttctccagtgcactatgagtgacattttggctgaagagctgcaaaaaacaaaaaacgaagaagaatacatggtcaatacattcattgtcatgcaaaggaaacttggaactgctgggcagaagcttggtggtgccgctgtcctttgtcatatcaagcatgaccctgtggatccaggaggatccttcaccttgacctctgctaatgtgggcaagtgccaaacagttctctgtcgaaatggaaagccgctgcctctgtccagatcttacatcatgagctgtgaagaagagctgaagaggattaaacagcacaaggccattatcactgaggatggcaaggtgaacggagtgactgagtccacgcgcatcctgggctacaccttcctccatcccagtgtggtgcctcgcccccacgtgcagtccgtgctcctgactccccaggatgagttcttcatcctaggcagtaaggggttgtgggacagcctgtccgtcgaggaggccgtggaagccgtgcgcaacgtgcccgatgccctggctgctgccaagaagctgtgtaccctggcccagagctacggctgccacgacagcatcagcgctgtggtggtgcagctcagtgtcactgaggacagcttctgctgctgcgagctcagcgccggtggggctgtgccaccacccagtcctggcatctttcctccctcagtgaacatggtgatcaaggatcggccctcagatgggctgggcgtgccgtcctccagcagcggcatggcttccgagattagcagtgagctctccacttctgagatgagcagcgaggtggggtcaacagcctccgatgagcccccgcccggagccctaagcgagaacagccctgcctaccccagtgagcagcgctgcatgctccaccccatctgtctgtccaactccttccagcgccagctatccagcgccacgttctctagcgccttctccgacaacggccttgacagtgacgatgaggagcccatcgagggcgtcttcaccaacggcagccgggtggaggtggaggtggacatccactgcagccgggccaaggagaaggagaaacagcagcacctgcttcaggtgccagcagaggccagtgatgagggcattgtcatcagcgccaacgaggatgagccaggtctgcccaggaaggcagacttctctgccgttgggaccattgggcgccggagggccaatggctctgttgcgccccaggaaaggagccacaatgtgatagaggtggctacagacgcacctcttcgaaagcctggaggctattttgctgccccggctcagccggatcctgatgatcagtttatcatacccccggagctggaagaggaggtcaaagaaatcatgaagcatcaccaggagcaacagcagcagcagcagccgccaccaccccctcagctccagccgcagctgccgcggcactaccagctggaccagctgccagattattacgacacgccactatgacccagccgagctgtttaacaaataaactaaccacaaaagactgagttgcaagagtctcccaggctcacattaaaccaggggttttactccacatccttcccccagacactgttcccaacctgtcatcgcagctaatctgtaggttctctttctttgggttatttttttaagtaatcaccactttcttctagtgatgctttaccaatatgatttacatttgttaacttctccccctaacatatcagatatgtaaagacaaagaacaaaaggtttaatatattacagagaaacagttaatgataatgtaatattttttaaaatggctttttgttgtttgtttggaaggcagggcaggctgccgttgctaaatgatttaataatattgtaattctgtatttctttggggggaaaaggcttttgttttgttttgttttgttttgttttgtttttgtcttgaaaataatagacatttgtagaatatggagactaactcctaggagttgctttactctgtcaggtgacttaagtcactgggattcactaattttctctgagagaacagctgattgagaatttccattgtaaatagctcagtgttgtatagtgaggcttacgatgttttgtagtcttggcgtaaggacacagcccaagtaactgacgtttcccctccccctcccctctgaggagcctgcctgcctcacaactcaccctcacttcactgaatgaggaggctgagcagctgcagtgtttctgtccggaggaaatggatcttaggccactggacaagaacctgcacccaagggccctgaacccattttcctcccctgtcccagccttcccactttgacagacacttttaactgtgttccttactgctgccacaatcagcatggttgtatagtgccccattaggccatttacatacccagagttatactcaagcagaatgcacaaatggacatgtcataatttttgttacaataaatatgaaatttacaagta

SEQ ID NO: 3050 - DNA, 2964 bp, Homo sapiens
agaaatatgaaacgcaatgggagcagaaattgtttgaataggagaagtaggtttggttctcgagaaagagactggctaagagaagatgtaaagagaggctgtgtttacctttatggagcagacactaccactgccactacaaccaccaccacctcctcttcctcttcctcctcctcctcttcctctgacttacatctcgtcctttgcactgtagagacaccagcatcagaaatatgtgctggagagggaagagaaagtctttatttacagcttcatggagacctggtcaggagactggaacctactgaacgacctcttcagatcgtttatgattacttatccaggctgggatttgatgatcctgtgcgcatacaggaggaggctacaaatcctgacctcggctgtatgattcgattttatggtgaaaaaccatgccacatggatcgtttggatcgaatcctattgtctggcatctataatgtacgcaagggaaagacccagctgcataagtgggctgagcgcctagttgtcctctgtggtacctgccttatcgtttcctcagtgaaggattgtcaaactggaaagatgcacattttgcctctggttggtggaaagatagaagaagtgaagcgacggcaatactcccttgctttcagctcagcaggagcccaagctcagacctatcatgtcagcttcgagactttggccgagtaccagcgatggcaacggcaagcatccaaggtggtgtcccagcgaatcagtaccgtggatctctcgtgttacagcctcgaggaggttcctgagcatctcttctatagtcaagatattacctacctcaacttgcgacacaacttcatgcagttagaaagacccggaggcctcgatacactctacaaattttctcaactgaagggcctgaacttgtcccataataaacttgggttgtttcctatattgttatgcgagatctctaccctgactgagctcaacctttcctgtaatggatttcatgacctaccaagtcaaattggcaatctgctaaatcttcaaaccctctgtcttgatggcaactttctgactactttacctgaagaattgggaaatctacaacagctttcctccttgggaatttccttcaacaactttagtcaaattcctgaggtttatgagaaactcactatgttagatagagtggttatggcaggaaattgcctggaagtcctgaacttaggggtgctgaataggatgaaccatatcaagcatgtggatttaaggatgaaccatttgaaaaccatggttattgaaaatctggagggaaataaacacatcacccacgtggatctgcgggacaaccgactgactgacttggatcttagctccttatgcagcttggaacagctgcactgtgggcggaatcagctgagggagctaacactcagtggcttttcccttcggaccctctatgccagttccaacaggctgacagcagtgaacgtctatccagtacccagcctgctcactttcttggatctctcccgaaacctgctagagtgtgtccctgactgggcctgtgaagcaaagaagatagaagtattagatgtgagctataatcttctcacagaggttcccgtgagaattctgagtagcttgagtcttagaaaactgatgctgggacacaatcatgtgcaaaaccttccaacactggtagagcacatccccctcgaggtgctggatcttcagcataatgcactcacgaggctgccagacaccctcttctccaaggccttaaatctcagatacttgaatgcatctgcaaatagtctggagtctttaccatccgcctgcactggagaggagagtttgagtatgctgcagctgctttatctgaccaacaatctcctgacggatcagtgcatacctgtcctggtagggcacctgcacctgcgaatcttgcaccttgcaaacaatcagttacagacctttcctgcaagcaaactaaataaattggagcaattggaggaactgaacctaagtggcaacaagcttaaaaccattcccacaaccatagcaaactgtaaaaggctgcacacccttgttgcacactccaacaacatcagcattttcccagaaatactgcagttgcctcagatccagtttgtagacctaagttgcaacgacttgacagaaatcctgattccagaggctttgcctgctacattacaagaccttgacctgactggaaatacaaatctggttctggaacacaagacactggacatatttagccatatcacaaccctgaaaattgatcagaaacctttgccaaccacagattctacagttacgtcaaccttctggagccatggactggctgagatggcagggcagagaaataagctgtgtgtctcagcacttgctatggatagctttgcagagggggtgggagctgtgtatggcatgtttgatggagaccgaaatgaggagctcccgcgcctgctgcagtgtacgatggcagatgtgcttttagaagaggtacagcagtcaactaatgacacagttttcatggctaacaccttcttggtatctcacaggaaattaggaatggctggccagaagttgggctcctccgctctcctgtgctacatccgccctgacactgccgatccagcaagtagctttagcttgactgtagccaatgttggcacgtgccaagcagtcctgtgccgaggtgggaagccagtgcccctctctaaagtcttcagcctggagcaggacccagaggaggctcaaagggtgaaggaccaaaaagccatcatcacagaggttccggaagatctcaaagagttccagaccacagatattccggtgcatcactgtaacttccgggctgttctcggctgcctttgtagcgcttctgttctcggtagctacgcagggccagcaccacgctggcgccgtacatga

SEQ ID NO: 3051 - DNA, 7919 bp, Homo sapiens
agaaatatgaaacgcaatgggagcagaaattgtttgaataggagaagtaggtttggttctcgagaaagagactggctaagagaagatgtaaagagaggctgtgtttacctttatggagcagacactaccactgccactacaaccaccaccacctcctcttcctcttcctcctcctcctcttcctctgacttacatctcgtcctttgcactgtagagacaccagcatcagaaatatgtgctggagagggaagagaaagtctttatttacagcttcatggagacctggtcaggagactggaacctactgaacgacctcttcagatcgtttatgattacttatccaggctgggatttgatgatcctgtgcgcatacaggaggaggctacaaatcctgacctcggctgtatgattcgattttatggtgaaaaaccatgccacatggatcgtttggatcgaatcctattgtctggcatctataatgtacgcaagggaaagacccagctgcataagtgggctgagcgcctagttgtcctctgtggtacctgccttatcgtttcctcagtgaaggattgtcaaactggaaagatgcacattttgcctctggttggtggaaagatagaagaagtgaagcgacggcaatactcccttgctttcagctcagcaggagcccaagctcagacctatcatgtcagcttcgagactttggccgagtaccagcgatggcaacggcaagcatccaaggtggtgtcccagcgaatcagtaccgtggatctctcgtgttacagcctcgaggaggttcctgagcatctcttctatagtcaagatattacctacctcaacttgcgacacaacttcatgcagttagaaagacccggaggcctcgatacactctacaaattttctcaactgaagggcctgaacttgtcccataataaacttgggttgtttcctatattgttatgcgagatctctaccctgactgagctcaacctttcctgtaatggatttcatgacctaccaagtcaaattggcaatctgctaaatcttcaaaccctctgtcttgatggcaactttctgactactttacctgaagaattgggaaatctacaacagctttcctccttgggaatttccttcaacaactttagtcaaattcctgaggtttatgagaaactcactatgttagatagagtggttatggcaggaaattgcctggaagtcctgaacttaggggtgctgaataggatgaaccatatcaagcatgtggatttaaggatgaaccatttgaaaaccatggttattgaaaatctggagggaaataaacacatcacccacgtggatctgcgggacaaccgactgactgacttggatcttagctccttatgcagcttggaacagctgcactgtgggcggaatcagctgagggagctaacactcagtggcttttcccttcggaccctctatgccagttccaacaggctgacagcagtgaacgtctatccagtacccagcctgctcactttcttggatctctcccgaaacctgctagagtgtgtccctgactgggcctgtgaagcaaagaagatagaagtattagatgtgagctataatcttctcacagaggttcccgtgagaattctgagtagcttgagtcttagaaaactgatgctgggacacaatcatgtgcaaaaccttccaacactggtagagcacatccccctcgaggtgctggatcttcagcataatgcactcacgaggctgccagacaccctcttctccaaggccttaaatctcagatacttgaatgcatctgcaaatagtctggagtctttaccatccgcctgcactggagaggagagtttgagtatgctgcagctgctttatctgaccaacaatctcctgacggatcagtgcatacctgtcctggtagggcacctgcacctgcgaatcttgcaccttgcaaacaatcagttacagacctttcctgcaagcaaactaaataaattggagcaattggaggaactgaacctaagtggcaacaagcttaaaaccattcccacaaccatagcaaactgtaaaaggctgcacacccttgttgcacactccaacaacatcagcattttcccagaaatactgcagttgcctcagatccagtttgtagacctaagttgcaacgacttgacagaaatcctgattccagaggctttgcctgctacattacaagaccttgacctgactggaaatacaaatctggttctggaacacaagacactggacatatttagccatatcacaaccctgaaaattgatcagaaacctttgccaaccacagattctacagttacgtcaaccttctggagccatggactggctgagatggcagggcagagaaataagctgtgtgtctcagcacttgctatggatagctttgcagagggggtgggagctgtgtatggcatgtttgatggagaccgaaatgaggagctcccgcgcctgctgcagtgtacgatggcagatgtgcttttagaagaggtacagcagtcaactaatgacacagttttcatggctaacaccttcttggtatctcacaggaaattaggaatggctggccagaagttgggctcctccgctctcctgtgctacatccgccctgacactgccgatccagcaagtagctttagcttgactgtagccaatgttggcacgtgccaagcagtcctgtgccgaggtgggaagccagtgcccctctctaaagtcttcagcctggagcaggacccagaggaggctcaaagggtgaaggaccaaaaagccatcatcacagaggacaacaaagtgaatggggtaacctgctgtacccggatgctgggctgtacatacctctacccttggatcctccccaagccccacatatcttccactccgctgaccattcaagatgagttgctgattctgggaaacaaagcattgtgggaacacttgtcctacacagaagctgtcaatgctgtacgtcacgtacaagacccattagcagctgctaagaagctgtgcacattagcgcagagctatggctgtcaggacaatgtaggggcgatggtagtttatttgaatattggtgaggaaggctgcacttgtgaaatgaatgggctcaccctcccaggtcctgtgggatttgcttcaaccaccactatcaaggatgcccctaagccagccactccatcctctagcagtgggattgcctctgagttcagcagtgagatgtccacctcagaggtgagcagtgaagtggggtccactgcttctgatgagcataatgctgggggcctggacactgccttgcttccgaggccagagcggcgctgcagcctccacccaacacccacctctgggctgtttcagcgccagccttcttctgctaccttctccagtaaccagtctgacaacggcctggacagtgatgatgaccagcccgttgagggggtcataaccaatggcagcaaggtagaggtggaagtagacatccactgctgcagggggagggatctggagaactcaccccctctcatagagagttctcctaccctgtgttctgaggaacatgctagagggtcgtgttttgggatccgaagacagaacagtgtgaatagtggcatgctcctgccaatgagcaaggacaggatggagttacagaagtctccctccacctcctgcctctatgggaagaaactctccaatggctctattgtgcccctagaggacagcctgaacctcattgaagtggccacagaagtgcccaagaggaaaactggctattttgctgcccccactcagatggaaccagaggaccagtttgttgtgcctcatgacctggaagaagaagtgaaggaacaaatgaaacagcaccaggacagccggctcgagcctgagccccatgaagaggatcggaccgagcccccggaggagttcgacacagcactatgactgccccactgggcacagtgtgggaggaggctgtgcagggttggggtagggacttgctagaggcattctgcctctacatttctttttgtttgttcgttttttttttgtttgtttgttttgagacggagtcttgctcagtcgctcaggctggagtgcaatggtggggtctcgggtcactgcagcctctgtccctgggttcaagccattctcctgtctcagcctcccgagtagctgggattacaggcacctgccattatgcccggctaagttttattttttttttttagagacggggtttcaccatgttggccaggctggtgttgaactcttgacctcaggtgatccaccctcctctgcctcccaaagtgctgtgattacaggcctcagccaccatgcccagccctgcgtctacatttctaaaccatagctgtgtggggttgaactcggagccaaaaagtgtgagagccatcaggggctggctctggataaactggtagccactatcagtgttaagtttcacatttaacctgcattggaattcccaggggtactgggaagaaagcagctgttctgtatcagtcctaccacctgccattaaccctttctctcctaggatcattttgagaatttgcctgcctgggcaggaaagggactatttctgtggaggaaaaaagtgaagattgattctctttactagttgctgctgatggatctctgtgacagagaaatcaccttatctcagactaatggggtgtgatgtgactagtcacatggcttttcattcttctctacgagaatacagcctatcaaaatgatgtctgttggaaatgtagaaccaatcaaacagataatttatgtatgtaatgtaatgagagcacttttcattgactgtgaactttttatttttgaatctgcactcgagccaatcttcttagaggcagcccggcaccttcatccataggcagagagagaactgggtgttggagacttattcgagggtataggaagggccctgtgaagttgatttaacttttggatgtcagactgtgaaagctcctgagaaacttggggtaataggatcttcttttggggatgaaaatggggaaggcgtgaggacctagactacttctccctagatcagaaaaagagaattaccccttgacaaatatgatacctgctaggtatttcccagggaaatttagggattggcgtctttccctagcatgtggaggaattggcagacagcttcctaagggcggggagcgggggcccaaggctgacactgcttgcatccacgtgaccttaagttatggcagatgactctgaaacggactgaggccaatgagaacagatggatggagcactcaggttagacttgttccttctcctatgctggaggagagggatggttctctagaatgttggaggtgagttgagagctcgcctcttgaatgttgaacagtgtactcttctgaaaactgcatattcactttatgtggtttcagaatactgggctcaatactaacataagaaagacacttcattgagaaattcttaagcttacagaaaacctatactctttgcacattccacataaccctagcaaaatgcagtttcttcatacttctgtcactttttccattggaagatttgcttaggaaaattaattcctatttattcccacaaaatgttggcattgcttgattttacccaatggggaatgtgctttgaatttttggaacacttttacaattaaaaataaagtagggccatttttaatttgtttcatcagaaactatgttaaagagagggttaaatataaatatattttcgtgtgtatttttgggaagatttttgttcaaagcaatagtcaaaatcagatgacctgtccataataattatgtgtcttcatcttctcagaggccccatgctcatatgcacgtgtcattgggatacactcttgggggatttggtacactctaatggatgtctaatgttcaacccctcgagaatctgaacttgagtccccagattgtcaaactactggtcagctattgagaattttagaactcaggtctttgatttgaagtagggaacatagtggctcacacagagtttaggtgctgttagaaagatgggaacaagagtgttttgccaccttatttttatatgggaaattttttttaatgaagaaaaaatgaaaatgaaataacaggatgatagtgatgagtgatgtaaaacatcttacttagatggcagaaccttcgggttgtagaatagtgatgtctaaaaattaaagttattttgggaatacaccactttaatagtatagtcttataaaaattattcattatggtgaacccttcttgtctgctattcgtttcccaacctacttattggaaccacctcaaaacccagttctgaaatgaccttaccaaaagtaaatgtatttattttttagtcagcagaactctgtaattccaaatgttgttctgtgtggtagaattttttttcaggaaccattaggttgtattgaaaatctttgttataggcgataccaaaactgattattcttttttgcagtctgctttaattcatgtccttctgcagttgctctgtattaaaacagggtaaaaaggccatagcccattatgaaaaatataatacaaaactctttgacctatgaggtaacttacagacattgtgttttctaaacaggctgtcagtgaaagcccgtatctgtctccaggtgaatgtaatttacttccgagtactttacccagaggatgtgttccccaggtgggcagagtacagttgatctctagcacagacagagattctggcctctgcatattctcaggtctctgtgtgtacctcccattgagtagagaagcttaagataatttctgagagaagaacactgctgattgtgggagcagtttaggagtccatggaagaaagaaaaatacatgtgtcttggcagccatggtgtatttttgtccaaatggattggaaggatatttgaatatttgaatgttggtatgacataaagctgcagtgcactatagagtcaagtcattgaattaccactcctgatacagggctttattgtactactgtgaagtgtatgtgtgcaatacattggtgagttcatttactggtgtacggaagagccagcaggagcagcgtggtcattgctgggtgctattacagttgcttgtagtgagtgctgttttccaggagatggagccagttgggtgtggcagatctactgaatatcaaatgatgctcttcttcccatgtagaccttcagcaaaagccggtacttggaagccacaggctcaccttctctatctatccaataattattaatgaagagacctccataagggagcagctggctgttatcgataaatgtaccaattattaaataattagtctccaagccattcagtgatgtcttcagcatcactataggactgtctagtgtcactttttacttccttctgggtggaggctttccgactcccaatcatgaaggcaagttaatctttccagttagtgacttttgccccatagttggggtaagcacttcctagattgagaaaaagcagctacagtcaatcctgctctgtttgcctcatttggtgatcagtcagtcacacataagttccttgtattctaaatttcatgcacttctcccagatgctatagggttttctctcactgttgccagtggatgtcatccagacagtgggctcatatcttacggttttgtgcaatcattgtcgtattgtagtcttaagactcattatagtgtatttttgatatttttgaaatgtgttaaattttttaattcaataatatgagccagagcatgttgcagcaaatctattgtttgtaaaaataacaataacaataataaataaaataaagtggaa

SEQ ID NO: 3052 - DNA, 2877 bp, Homo sapiens
agaaatatgaaacgcaatgggagcagaaattgtttgaataggagaagtaggtttggttctcgagaaagagactggctaagagaagatgtaaagagaggctgtgtttacctttatggagcagacactaccactgccactacaaccaccaccacctcctcttcctcttcctcctcctcctcttcctctgacttacatctcgtcctttgcactgtagagacaccagcatcagaaatatgtgctggagagggaagagaaagtctttatttacagcttcatggagacctggtcaggagactggaacctactgaacgacctcttcagatcgtttatgattacttatccaggctgggatttgatgatcctgtgcgcatacaggaggaggctacaaatcctgacctcggctgtatgattcgattttatggtgaaaaaccatgccacatggatcgtttggatcgaatcctattgtctggcatctataatgtacgcaagggaaagacccagctgcataagtgggctgagcgcctagttgtcctctgtggtacctgccttatcgtttcctcagtgaaggattgtcaaactggaaagatgcacattttgcctctggttggtggaaagatagaagaagtgaagcgacggcaatactcccttgctttcagctcagcaggagcccaagctcagacctatcatgtcagcttcgagactttggccgagtaccagcgatggcaacggcaagcatccaaggtggtgtcccagcgaatcagtaccgtggatctctcgtgttacagcctcgaggaggttcctgagcatctcttctatagtcaagatattacctacctcaacttgcgacacaacttcatgcagttagaaagacccggaggcctcgatacactctacaaattttctcaactgaagggcctgaacttgtcccataataaacttgggttgtttcctatattgttatgcgagatctctaccctgactgagctcaacctttcctgtaatggatttcatgacctaccaagtcaaattggcaatctgctaaatcttcaaaccctctgtcttgatggcaactttctgactactttacctgaagaattgggaaatctacaacagctttcctccttgggaatttccttcaacaactttagtcaaattcctgaggtttatgagaaactcactatgttagatagagtggttatggcaggaaattgcctggaagtcctgaacttaggggtgctgaataggatgaaccatatcaagcatgtggatttaaggatgaaccatttgaaaaccatggttattgaaaatctggagggaaataaacacatcacccacgtggatctgcgggacaaccgactgactgacttggatcttagctccttatgcagcttggaacagctgcactgtgggcggaatcagctgagggagctaacactcagtggcttttcccttcggaccctctatgccagttccaacaggctgacagcagtgaacgtctatccagtacccagcctgctcactttcttggatctctcccgaaacctgctagagtgtgtccctgactgggcctgtgaagcaaagaagatagaagtattagatgtgagctataatcttctcacagaggttcccgtgagaattctgagtagcttgagtcttagaaaactgatgctgggacacaatcatgtgcaaaaccttccaacactggtagagcacatccccctcgaggtgctggatcttcagcataatgcactcacgaggctgccagacaccctcttctccaaggccttaaatctcagatacttgaatgcatctgcaaatagtctggagtctttaccatccgcctgcactggagaggagagtttgagtatgctgcagctgctttatctgaccaacaatctcctgacggatcagtgcatacctgtcctggtagggcacctgcacctgcgaatcttgcaccttgcaaacaatcagttacagacctttcctgcaagcaaactaaataaattggagcaattggaggaactgaacctaagtggcaacaagcttaaaaccattcccacaaccatagcaaactgtaaaaggctgcacacccttgttgcacactccaacaacatcagcattttcccagaaatactgcagttgcctcagatccagtttgtagacctaagttgcaacgacttgacagaaatcctgattccagaggctttgcctgctacattacaagaccttgacctgactggaaatacaaatctggttctggaacacaagacactggacatatttagccatatcacaaccctgaaaattgatcagaaacctttgccaaccacagattctacagttacgtcaaccttctggagccatggactggctgagatggcagggcagagaaataagctgtgtgtctcagcacttgctatggatagctttgcagagggggtgggagctgtgtatggcatgtttgatggagaccgaaatgaggagctcccgcgcctgctgcagtgtacgatggcagatgtgcttttagaagaggtacagcagtcaactaatgacacagttttcatggctaacaccttcttggtatctcacaggaaattaggaatggctggccagaagttgggctcctccgctctcctgtgctacatccgccctgacactgccgatccagcaagtagctttagcttgactgtagccaatgttggcacgtgccaagcagtcctgtgccgaggtgggaagccagtgcccctctctaaagtcttcagcctggagcaggacccagaggaggctcaaagggtgaaggaccaaaaagccatcatcacagagaattgggttcttaaccaaaagcacctgcaggattttcctggggaagataagtga

SEQ ID NO: 3053 - DNA, 7718 bp, Homo sapiens
agaaatatgaaacgcaatgggagcagaaattgtttgaataggagaagtaggtttggttctcgagaaagagactggctaagagaagatgtaaagagaggctgtgtttacctttatggagcagacactaccactgccactacaaccaccaccacctcctcttcctcttcctcctcctcctcttcctctgacttacatctcgtcctttgcactgtagagacaccagcatcagaaatatgtgctggagagggaagagaaagtctttatttacagcttcatggagacctggtcaggagactggaacctactgaacgacctcttcagatcgtttatgattacttatccaggctgggatttgatgatcctgtgcgcatacaggaggaggctacaaatcctgacctcggctgtatgattcgattttatggtgaaaaaccatgccacatggatcgtttggatcgaatcctattgtctggcatctataatgtacgcaagggaaagacccagctgcataagtgggctgagcgcctagttgtcctctgtggtacctgccttatcgtttcctcagtgaaggattgtcaaactggaaagatgcacattttgcctctggttggtggaaagatagaagaagtgaagcgacggcaatactcccttgctttcagctcagcaggagcccaagctcagacctatcatgtcagcttcgagactttggccgagtaccagcgatggcaacggcaagcatccaaggtggtgtcccagcgaatcagtaccgtggatctctcgtgttacagcctcgaggaggttcctgagcatctcttctatagtcaagatattacctacctcaacttgcgacacaacttcatgcagttagaaagacccggaggcctcgatacactctacaaattttctcaactgaagggcctgaacttgtcccataataaacttgggttgtttcctatattgttatgcgagatctctaccctgactgagctcaacctttcctgtaatggatttcatgacctaccaagtcaaattggcaatctgctaaatcttcaaaccctctgtcttgatggcaactttctgactactttacctgaagaattgggaaatctacaacagctttcctccttgggaatttccttcaacaactttagtcaaattcctgaggtttatgagaaactcactatgttagatagagtggttatggcaggaaattgcctggaagtcctgaacttaggggtgctgaataggatgaaccatatcaagcatgtggatttaaggatgaaccatttgaaaaccatggttattgaaaatctggagggaaataaacacatcacccacgtggatctgcgggacaaccgactgactgacttggatcttagctccttatgcagcttggaacagctgcactgtgggcggaatcagctgagggagctaacactcagtggcttttcccttcggaccctctatgccagttccaacaggctgacagcagtgaacgtctatccagtacccagcctgctcactttcttggatctctcccgaaacctgctagagtgtgtccctgactgggcctgtgaagcaaagaagatagaagtattagatgtgagctataatcttctcacagaggttcccgtgagaattctgagtagcttgagtcttagaaaactgatgctgggacacaatcatgtgcaaaaccttccaacactggtagagcacatccccctcgaggtgctggatcttcagcataatgcactcacgaggctgccagacaccctcttctccaaggccttaaacaaactaaataaattggagcaattggaggaactgaacctaagtggcaacaagcttaaaaccattcccacaaccatagcaaactgtaaaaggctgcacacccttgttgcacactccaacaacatcagcattttcccagaaatactgcagttgcctcagatccagtttgtagacctaagttgcaacgacttgacagaaatcctgattccagaggctttgcctgctacattacaagaccttgacctgactggaaatacaaatctggttctggaacacaagacactggacatatttagccatatcacaaccctgaaaattgatcagaaacctttgccaaccacagattctacagttacgtcaaccttctggagccatggactggctgagatggcagggcagagaaataagctgtgtgtctcagcacttgctatggatagctttgcagagggggtgggagctgtgtatggcatgtttgatggagaccgaaatgaggagctcccgcgcctgctgcagtgtacgatggcagatgtgcttttagaagaggtacagcagtcaactaatgacacagttttcatggctaacaccttcttggtatctcacaggaaattaggaatggctggccagaagttgggctcctccgctctcctgtgctacatccgccctgacactgccgatccagcaagtagctttagcttgactgtagccaatgttggcacgtgccaagcagtcctgtgccgaggtgggaagccagtgcccctctctaaagtcttcagcctggagcaggacccagaggaggctcaaagggtgaaggaccaaaaagccatcatcacagaggacaacaaagtgaatggggtaacctgctgtacccggatgctgggctgtacatacctctacccttggatcctccccaagccccacatatcttccactccgctgaccattcaagatgagttgctgattctgggaaacaaagcattgtgggaacacttgtcctacacagaagctgtcaatgctgtacgtcacgtacaagacccattagcagctgctaagaagctgtgcacattagcgcagagctatggctgtcaggacaatgtaggggcgatggtagtttatttgaatattggtgaggaaggctgcacttgtgaaatgaatgggctcaccctcccaggtcctgtgggatttgcttcaaccaccactatcaaggatgcccctaagccagccactccatcctctagcagtgggattgcctctgagttcagcagtgagatgtccacctcagaggtgagcagtgaagtggggtccactgcttctgatgagcataatgctgggggcctggacactgccttgcttccgaggccagagcggcgctgcagcctccacccaacacccacctctgggctgtttcagcgccagccttcttctgctaccttctccagtaaccagtctgacaacggcctggacagtgatgatgaccagcccgttgagggggtcataaccaatggcagcaaggtagaggtggaagtagacatccactgctgcagggggagggatctggagaactcaccccctctcatagagagttctcctaccctgtgttctgaggaacatgctagagggtcgtgttttgggatccgaagacagaacagtgtgaatagtggcatgctcctgccaatgagcaaggacaggatggagttacagaagtctccctccacctcctgcctctatgggaagaaactctccaatggctctattgtgcccctagaggacagcctgaacctcattgaagtggccacagaagtgcccaagaggaaaactggctattttgctgcccccactcagatggaaccagaggaccagtttgttgtgcctcatgacctggaagaagaagtgaaggaacaaatgaaacagcaccaggacagccggctcgagcctgagccccatgaagaggatcggaccgagcccccggaggagttcgacacagcactatgactgccccactgggcacagtgtgggaggaggctgtgcagggttggggtagggacttgctagaggcattctgcctctacatttctttttgtttgttcgttttttttttgtttgtttgttttgagacggagtcttgctcagtcgctcaggctggagtgcaatggtggggtctcgggtcactgcagcctctgtccctgggttcaagccattctcctgtctcagcctcccgagtagctgggattacaggcacctgccattatgcccggctaagttttattttttttttttagagacggggtttcaccatgttggccaggctggtgttgaactcttgacctcaggtgatccaccctcctctgcctcccaaagtgctgtgattacaggcctcagccaccatgcccagccctgcgtctacatttctaaaccatagctgtgtggggttgaactcggagccaaaaagtgtgagagccatcaggggctggctctggataaactggtagccactatcagtgttaagtttcacatttaacctgcattggaattcccaggggtactgggaagaaagcagctgttctgtatcagtcctaccacctgccattaaccctttctctcctaggatcattttgagaatttgcctgcctgggcaggaaagggactatttctgtggaggaaaaaagtgaagattgattctctttactagttgctgctgatggatctctgtgacagagaaatcaccttatctcagactaatggggtgtgatgtgactagtcacatggcttttcattcttctctacgagaatacagcctatcaaaatgatgtctgttggaaatgtagaaccaatcaaacagataatttatgtatgtaatgtaatgagagcacttttcattgactgtgaactttttatttttgaatctgcactcgagccaatcttcttagaggcagcccggcaccttcatccataggcagagagagaactgggtgttggagacttattcgagggtataggaagggccctgtgaagttgatttaacttttggatgtcagactgtgaaagctcctgagaaacttggggtaataggatcttcttttggggatgaaaatggggaaggcgtgaggacctagactacttctccctagatcagaaaaagagaattaccccttgacaaatatgatacctgctaggtatttcccagggaaatttagggattggcgtctttccctagcatgtggaggaattggcagacagcttcctaagggcggggagcgggggcccaaggctgacactgcttgcatccacgtgaccttaagttatggcagatgactctgaaacggactgaggccaatgagaacagatggatggagcactcaggttagacttgttccttctcctatgctggaggagagggatggttctctagaatgttggaggtgagttgagagctcgcctcttgaatgttgaacagtgtactcttctgaaaactgcatattcactttatgtggtttcagaatactgggctcaatactaacataagaaagacacttcattgagaaattcttaagcttacagaaaacctatactctttgcacattccacataaccctagcaaaatgcagtttcttcatacttctgtcactttttccattggaagatttgcttaggaaaattaattcctatttattcccacaaaatgttggcattgcttgattttacccaatggggaatgtgctttgaatttttggaacacttttacaattaaaaataaagtagggccatttttaatttgtttcatcagaaactatgttaaagagagggttaaatataaatatattttcgtgtgtatttttgggaagatttttgttcaaagcaatagtcaaaatcagatgacctgtccataataattatgtgtcttcatcttctcagaggccccatgctcatatgcacgtgtcattgggatacactcttgggggatttggtacactctaatggatgtctaatgttcaacccctcgagaatctgaacttgagtccccagattgtcaaactactggtcagctattgagaattttagaactcaggtctttgatttgaagtagggaacatagtggctcacacagagtttaggtgctgttagaaagatgggaacaagagtgttttgccaccttatttttatatgggaaattttttttaatgaagaaaaaatgaaaatgaaataacaggatgatagtgatgagtgatgtaaaacatcttacttagatggcagaaccttcgggttgtagaatagtgatgtctaaaaattaaagttattttgggaatacaccactttaatagtatagtcttataaaaattattcattatggtgaacccttcttgtctgctattcgtttcccaacctacttattggaaccacctcaaaacccagttctgaaatgaccttaccaaaagtaaatgtatttattttttagtcagcagaactctgtaattccaaatgttgttctgtgtggtagaattttttttcaggaaccattaggttgtattgaaaatctttgttataggcgataccaaaactgattattcttttttgcagtctgctttaattcatgtccttctgcagttgctctgtattaaaacagggtaaaaaggccatagcccattatgaaaaatataatacaaaactctttgacctatgaggtaacttacagacattgtgttttctaaacaggctgtcagtgaaagcccgtatctgtctccaggtgaatgtaatttacttccgagtactttacccagaggatgtgttccccaggtgggcagagtacagttgatctctagcacagacagagattctggcctctgcatattctcaggtctctgtgtgtacctcccattgagtagagaagcttaagataatttctgagagaagaacactgctgattgtgggagcagtttaggagtccatggaagaaagaaaaatacatgtgtcttggcagccatggtgtatttttgtccaaatggattggaaggatatttgaatatttgaatgttggtatgacataaagctgcagtgcactatagagtcaagtcattgaattaccactcctgatacagggctttattgtactactgtgaagtgtatgtgtgcaatacattggtgagttcatttactggtgtacggaagagccagcaggagcagcgtggtcattgctgggtgctattacagttgcttgtagtgagtgctgttttccaggagatggagccagttgggtgtggcagatctactgaatatcaaatgatgctcttcttcccatgtagaccttcagcaaaagccggtacttggaagccacaggctcaccttctctatctatccaataattattaatgaagagacctccataagggagcagctggctgttatcgataaatgtaccaattattaaataattagtctccaagccattcagtgatgtcttcagcatcactataggactgtctagtgtcactttttacttccttctgggtggaggctttccgactcccaatcatgaaggcaagttaatctttccagttagtgacttttgccccatagttggggtaagcacttcctagattgagaaaaagcagctacagtcaatcctgctctgtttgcctcatttggtgatcagtcagtcacacataagttccttgtattctaaatttcatgcacttctcccagatgctatagggttttctctcactgttgccagtggatgtcatccagacagtgggctcatatcttacggttttgtgcaatcattgtcgtattgtagtcttaagactcattatagtgtatttttgatatttttgaaatgtgttaaattttttaattcaataatatgagccagagcatgttgcagcaaatctattgtttgtaaaaataacaataacaataataaataaaataaagtggaa

SEQ ID NO: 3054 - DNA, 3485 bp, Homo sapiens
aagcgcccgcgagccgccggccgggagggatccgggtcctgaagagaaatatgaaacgcaatgggagcagaaattgtttgaataggagaagtaggtttggttctcgagaaagagactggctaagagaagatgtaaagagaggctgtgtttacctttatggagcagacactaccactgccactacaaccaccaccacctcctcttcctcttcctcctcctcctcttcctctgacttacatctcgtcctttgcactgtagagacaccagcatcagaaatatgtgctggagagggaagagaaagtctttatttacagcttcatggagacctggtcaggagactggaacctactgaacgacctcttcagatcgtttatgattacttatccaggctgggatttgatgatcctgtgcgcatacaggaggaggctacaaatcctgacctcggctgtatgattcgattttatggtgaaaaaccatgccacatggatcgtttggatcgaatcctattgtctggcatctataatgtacgcaagggaaagacccagctgcataagtgggctgagcgcctagttgtcctctgtggtacctgccttatcgtttcctcagtgaaggattgtcaaactggaaagatgcacattttgcctctggttggtggaaagatagaagaagtgaagcgacggcaatactcccttgctttcagctcagcaggagcccaagctcagacctatcatgtcagcttcgagactttggccgagtaccagcgatggcaacggcaagcatccaaggtggtgtcccagcgaatcagtaccgtggatctctcgtgttacagcctcgaggaggttcctgagcatctcttctatagtcaagatattacctacctcaacttgcgacacaacttcatgcagttagaaagacccggaggcctcgatacactctacaaattttctcaactgaagggcctgaacttgtcccataataaacttgggttgtttcctatattgttatgcgagatctctaccctgactgagctcaacctttcctgtaatggatttcatgacctaccaagtcaaattggcaatctgctaaatcttcaaaccctctgtcttgatggcaactttctgactactttacctgaagaattgggaaatctacaacagctttcctccttgggaatttccttcaacaactttagtcaaattcctgaggtttatgagaaactcactatgttagatagagtggttatggcaggaaattgcctggaagtcctgaacttaggggtgctgaataggatgaaccatatcaagcatgtggatttaaggtaaggttattctttaccacaccttcctttaaattgactctggtggacctttatgtcttctgtttatgaagatttgtttaaaacattagggtttttaaaattttgttgttgttttgagacaaggtctcactttgtcacccaagctggcatacagtggcacgatctcggcccactgcagtcttgacctcccgttctcaggcgattctcccacctcagcctcccgagtagttgggacttcaggtgcgcaccacgaggcctggctaatttttttctacttttagtagagatgaggtttcaccatgttgtgcaggcaggtctcgaactcctggactcgagcagtccacccacctcagcctcccaaagtgctgggattacagccaccgcacctggcccataactttaggttttttgaatagtgtagaaatatatgttttcaaaggtatagtaagactttatttatcactcagtagcagagagattaaggatcaggtagttgtaccatgtgatagagactatcaaattgcctttgacaaagattgttctcacttaccctcccatcagtgtatattttttattttaaaaattttttatagagatggggtcttgctgtgttgcccaggctggtcttgaactccctggctcaagtaatcctcctgccttggcctcctaaagtgttgggattacaggtgtgagccagtgtgcccgacccctccaccattttatgagaattcccattttctcatatctttgtcagtattggattttagcatttctttttatttatcatcagtctagtaggttgaaaaaagtatttcattgttttaatcaacgtttatttacatagcagtgaggttgaacatctttttatatgtatattagtagtttgtagatttccataaatgaccatttttctgttgagtcattgggtttcttcttgatacccattgtattacaattaaaatgttaagggtttcattactaagaactttttatgagagttttattttctagtcataatattttcctaaaggaagctggtaaaaagacacctactggatgttctgttatttacagtaagccattgatgtagcttgtaaagacagtaagagagtttttttttttttttaaaccacactggagacttaagagagagatttatagaaatacaggaaagtgagaatagacctgcataaattaaatcatacacctgtgtagaaaaaacccagaggtcattttctataatttgcctttgaactcttccatatatatatatatatatatatatatatatatatatatatgtgcagattatttccttgtctgttaattaattttatgtttgaaccttagctctagagatagagcaggcatagcaacaggaagaagtatggctccatccttatactctggacatggtactgttgtgactgctttgctactcactgactcaaaaggttgtgttcatcttcctgttcctttgtcctacttagtgcccacctgacattattaggtatttggatataagtgtttaactgttcgtagatatggcctcttttttccttctctttattaatttgtatacgtatttgccaatttggattgtctaacttagctgtaccttgagttattcatcaactaattatttatatagtaccttgcaaaatgaggcgagtagtgaaattcttaagttgtttaggaaacagagaaagggggccgggcacggtggctcatgcctgtaatcccagcactttgggaggccgaggcaggcagatcatctgaggttaggagttcaagcctggccaacatggtgaaaccccagctctactaaaaatacaaaaaattagcctggcatggtgggggtgattctaatcccagcaacttgggaggctgaagcaggagaatcgctttaacctgggaggcagaggttgcagtgaaccgagatcacgccattgcactccagcctgcgcaacacagtgaaactccatctcaaaaaaaaaaagtaaacagagaaagggatcatacctgtcctattttttatttttattctggtaagcacatttaatagactcttatttatgattattttcttgtttctgcgtattaaggatgaaccatttgaaaaccatggttattgaaaatctggagggaaataaacacatcacccacg

SEQ ID NO: 3055 - DNA, 2077 bp, Homo sapiens
ctgtcctggtagggcacctgcacctgcgaatcttgcaccttgcaaacaatcagttacagacctttcctgcaagcaaactaaataaattggagcaattggaggaactgaacctaagtggcaacaagcttaaaaccattcccacaaccatagcaaactgtaaaaggctgcacacccttgttgcacactccaacaacatcagcattttcccagaaatactgcagttgcctcagatccagtttgtagacctaagttgcaacgacttgacagaaatcctgattccagaggctttgcctgctacattacaagaccttgacctgactggaaatacaaatctggttctggaacacaagacactggacatatttagccatatcacaaccctgaaaattgatcagaaacctttgccaaccacagattctacagttacgtcaaccttctggagccatggactggctgagatggcagggcagagaaataagctgtgtgtctcagcacttgctatggatagctttgcagagggggtgggagctgtgtatggcatgtttgatggagaccgaaatgaggagctcccgcgcctgctgcagtgtacgatggcagatgtgcttttagaagaggtacagcagtcaactaatgacacagttttcatggctaacaccttcttggtatctcacaggaaattaggaatggctggccagaagttgggctcctccgctctcctgtgctacatccgccctgacactgccgatccagcaagtagctttagcttgactgtagccaatgttggcacgtgccaagcagtcctgtgccgaggtgggaagccagtgcccctctctaaagtcttcagcctggagcaggacccagaggaggctcaaagggtgaaggaccaaaaagccatcatcacagagaattgggttcttaaccaaaagcacctgcaggattttcctggggaagataagtgagaacaaacacatgaaaccacattccctgacactgcaaagctatgagttaaggttccggaagatctcaaagagttccagaccacagatattccggtgcatcactgtaacttccgggctgttctcggctgcctttgtagcgcttctgttctcggtagctacgcagggccagcaccacgctggcgccgtacatgatcacgagaagacaagcaaaggtggctgctgctccgtcggtgcctgccagctggcagtccatccaggtgagacccttgcgggcatagagcctctctcttgttttgcaagtgtcggtgctattgatctgcagagccacgtggaggtaaacaccaatgcctgtgcagtagcccactgccgctaggaggctgaaggcggcctccgtgaggagccacttccctgacaacattgttcgactcttggctccttggagtaaaacacccatggtgaggacccccagacccagagaaacagccacgccaccgtatatcaggggcgagcggaggatcgtgtactgctggtccagctgccgaacctgctctagctcagtgccctcgaacgatgttttcagatcagttcctacaagaggagccacattttgttaagtggccttcgacttcattgtatggatggatttgtctattcaaccaggaccttactgatagatatttggactgaaaggaacccacaaatggcacgaggcagaggaagccaacaggccaacagactgaagatcttcttgtccgaggtcagcttttatttgttactgacagaggccccaaatccttcttaggtgtccttctgggagagggtctcctgccattcccgtggtgttcagggatgagcatgaagagaaatacaaatgaaccgagagcaggaccaccaggttcaagtccccgctttttactgccttgtcatcttggccaagccattcagtccttctaagcctcagacaatatgacaaatgaagctaagtctgccaatcttcacccacagggatgtggggaggctcaaatgaaagcaaccgtgtgatactgtgggaagttaacaacaacaacaaaaaagcaagtatgtgaaaatactctaaaaataaaataatgtacaaatgg

SEQ ID NO: 3056 - DNA, 8317 bp, Homo sapiens
gcacaggggtatagatctaaagaagggcagaggggagatctggaaacaggctggctgactccaaatttggcccattggcaacaaaactactatcactgcgagaacgaaaagaaaaacaaaacaaagaaaagaaaagaagttaacttttaaaagtttttttctgaatcagccttgcaaataaatcataaaccgggtcacaggccatattactgcttgaagcagagcaccgaattctgataattttgctccaggaggaggcaagggaattaaaacatggctgggaggtgagcggacgttttgtacgaggttgggttgaatttgcttaagaaggtcgcacgcatctctgataaggaagagaaaaggccttgccaagagaaatatgaaacgcaatgggagcagaaattgtttgaataggagaagtaggtttggttctcgagaaagagactggctaagagaagatgtaaagagaggctgtgtttacctttatggagcagacactaccactgccactacaaccaccaccacctcctcttcctcttcctcctcctcctcttcctctgacttacatctcgtcctttgcactgtagagacaccagcatcagaaatatgtgctggagagggaagagaaagtctttatttacagcttcatggagacctggtcaggagactggaacctactgaacgacctcttcagatcgtttatgattacttatccaggctgggatttgatgatcctgtgcgcatacaggaggaggctacaaatcctgacctcggctgtatgattcgattttatggtgaaaaaccatgccacatggatcgtttggatcgaatcctattgtctggcatctataatgtacgcaagggaaagacccagctgcataagtgggctgagcgcctagttgtcctctgtggtacctgccttatcgtttcctcagtgaaggattgtcaaactggaaagatgcacattttgcctctggttggtggaaagatagaagaagtgaagcgacggcaatactcccttgctttcagctcagcaggagcccaagctcagacctatcatgtcagcttcgagactttggccgagtaccagcgatggcaacggcaagcatccaaggtggtgtcccagcgaatcagtaccgtggatctctcgtgttacagcctcgaggaggttcctgagcatctcttctatagtcaagatattacctacctcaacttgcgacacaacttcatgcagttagaaagacccggaggcctcgatacactctacaaattttctcaactgaagggcctgaacttgtcccataataaacttgggttgtttcctatattgttatgcgagatctctaccctgactgagctcaacctttcctgtaatggatttcatgacctaccaagtcaaattggcaatctgctaaatcttcaaaccctctgtcttgatggcaactttctgactactttacctgaagaattgggaaatctacaacagctttcctccttgggaatttccttcaacaactttagtcaaattcctgaggtttatgagaaactcactatgttagatagagtggttatggcaggaaattgcctggaagtcctgaacttaggggtgctgaataggatgaaccatatcaagcatgtggatttaaggatgaaccatttgaaaaccatggttattgaaaatctggagggaaataaacacatcacccacgtggatctgcgggacaaccgactgactgacttggatcttagctccttatgcagcttggaacagctgcactgtgggcggaatcagctgagggagctaacactcagtggcttttcccttcggaccctctatgccagttccaacaggctgacagcagtgaacgtctatccagtacccagcctgctcactttcttggatctctcccgaaacctgctagagtgtgtccctgactgggcctgtgaagcaaagaagatagaagtattagatgtgagctataatcttctcacagaggttcccgtgagaattctgagtagcttgagtcttagaaaactgatgctgggacacaatcatgtgcaaaaccttccaacactggtagagcacatccccctcgaggtgctggatcttcagcataatgcactcacgaggctgccagacaccctcttctccaaggccttaaatctcagatacttgaatgcatctgcaaatagtctggagtctttaccatccgcctgcactggagaggagagtttgagtatgctgcagctgctttatctgaccaacaatctcctgacggatcagtgcatacctgtcctggtagggcacctgcacctgcgaatcttgcaccttgcaaacaatcagttacagacctttcctgcaagcaaactaaataaattggagcaattggaggaactgaacctaagtggcaacaagcttaaaaccattcccacaaccatagcaaactgtaaaaggctgcacacccttgttgcacactccaacaacatcagcattttcccagaaatactgcagttgcctcagatccagtttgtagacctaagttgcaacgacttgacagaaatcctgattccagaggctttgcctgctacattacaagaccttgacctgactggaaatacaaatctggttctggaacacaagacactggacatatttagccatatcacaaccctgaaaattgatcagaaacctttgccaaccacagattctacagttacgtcaaccttctggagccatggactggctgagatggcagggcagagaaataagctgtgtgtctcagcacttgctatggatagctttgcagagggggtgggagctgtgtatggcatgtttgatggagaccgaaatgaggagctcccgcgcctgctgcagtgtacgatggcagatgtgcttttagaagaggtacagcagtcaactaatgacacagttttcatggctaacaccttcttggtatctcacaggaaattaggaatggctggccagaagttgggctcctccgctctcctgtgctacatccgccctgacactgccgatccagcaagtagctttagcttgactgtagccaatgttggcacgtgccaagcagtcctgtgccgaggtgggaagccagtgcccctctctaaagtcttcagcctggagcaggacccagaggaggctcaaagggtgaaggaccaaaaagccatcatcacagaggacaacaaagtgaatggggtaacctgctgtacccggatgctgggctgtacatacctctacccttggatcctccccaagccccacatatcttccactccgctgaccattcaagatgagttgctgattctgggaaacaaagcattgtgggaacacttgtcctacacagaagctgtcaatgctgtacgtcacgtacaagacccattagcagctgctaagaagctgtgcacattagcgcagagctatggctgtcaggacaatgtaggggcgatggtagtttatttgaatattggtgaggaaggctgcacttgtgaaatgaatgggctcaccctcccaggtcctgtgggatttgcttcaaccaccactatcaaggatgcccctaagccagccactccatcctctagcagtgggattgcctctgagttcagcagtgagatgtccacctcagaggtgagcagtgaagtggggtccactgcttctgatgagcataatgctgggggcctggacactgccttgcttccgaggccagagcggcgctgcagcctccacccaacacccacctctgggctgtttcagcgccagccttcttctgctaccttctccagtaaccagtctgacaacggcctggacagtgatgatgaccagcccgttgagggggtcataaccaatggcagcaaggtagaggtggaagtagacatccactgctgcagggggagggatctggagaactcaccccctctcatagagagttctcctaccctgtgttctgaggaacatgctagagggtcgtgttttgggatccgaagacagaacagtgtgaatagtggcatgctcctgccaatgagcaaggacaggatggagttacagaagtctccctccacctcctgcctctatgggaagaaactctccaatggctctattgtgcccctagaggacagcctgaacctcattgaagtggccacagaagtgcccaagaggaaaactggctattttgctgcccccactcagatggaaccagaggaccagtttgttgtgcctcatgacctggaagaagaagtgaaggaacaaatgaaacagcaccaggacagccggctcgagcctgagccccatgaagaggatcggaccgagcccccggaggagttcgacacagcactatgactgccccactgggcacagtgtgggaggaggctgtgcagggttggggtagggacttgctagaggcattctgcctctacatttctttttgtttgttcgttttttttttgtttgtttgttttgagacggagtcttgctcagtcgctcaggctggagtgcaatggtggggtctcgggtcactgcagcctctgtccctgggttcaagccattctcctgtctcagcctcccgagtagctgggattacaggcacctgccattatgcccggctaagttttattttttttttttagagacggggtttcaccatgttggccaggctggtgttgaactcttgacctcaggtgatccaccctcctctgcctcccaaagtgctgtgattacaggcctcagccaccatgcccagccctgcgtctacatttctaaaccatagctgtgtggggttgaactcggagccaaaaagtgtgagagccatcaggggctggctctggataaactggtagccactatcagtgttaagtttcacatttaacctgcattggaattcccaggggtactgggaagaaagcagctgttctgtatcagtcctaccacctgccattaaccctttctctcctaggatcattttgagaatttgcctgcctgggcaggaaagggactatttctgtggaggaaaaaagtgaagattgattctctttactagttgctgctgatggatctctgtgacagagaaatcaccttatctcagactaatggggtgtgatgtgactagtcacatggcttttcattcttctctacgagaatacagcctatcaaaatgatgtctgttggaaatgtagaaccaatcaaacagataatttatgtatgtaatgtaatgagagcacttttcattgactgtgaactttttatttttgaatctgcactcgagccaatcttcttagaggcagcccggcaccttcatccataggcagagagagaactgggtgttggagacttattcgagggtataggaagggccctgtgaagttgatttaacttttggatgtcagactgtgaaagctcctgagaaacttggggtaataggatcttcttttggggatgaaaatggggaaggcgtgaggacctagactacttctccctagatcagaaaaagagaattaccccttgacaaatatgatacctgctaggtatttcccagggaaatttagggattggcgtctttccctagcatgtggaggaattggcagacagcttcctaagggcggggagcgggggcccaaggctgacactgcttgcatccacgtgaccttaagttatggcagatgactctgaaacggactgaggccaatgagaacagatggatggagcactcaggttagacttgttccttctcctatgctggaggagagggatggttctctagaatgttggaggtgagttgagagctcgcctcttgaatgttgaacagtgtactcttctgaaaactgcatattcactttatgtggtttcagaatactgggctcaatactaacataagaaagacacttcattgagaaattcttaagcttacagaaaacctatactctttgcacattccacataaccctagcaaaatgcagtttcttcatacttctgtcactttttccattggaagatttgcttaggaaaattaattcctatttattcccacaaaatgttggcattgcttgattttacccaatggggaatgtgctttgaatttttggaacacttttacaattaaaaataaagtagggccatttttaatttgtttcatcagaaactatgttaaagagagggttaaatataaatatattttcgtgtgtatttttgggaagatttttgttcaaagcaatagtcaaaatcagatgacctgtccataataattatgtgtcttcatcttctcagaggccccatgctcatatgcacgtgtcattgggatacactcttgggggatttggtacactctaatggatgtctaatgttcaacccctcgagaatctgaacttgagtccccagattgtcaaactactggtcagctattgagaattttagaactcaggtctttgatttgaagtagggaacatagtggctcacacagagtttaggtgctgttagaaagatgggaacaagagtgttttgccaccttatttttatatgggaaattttttttaatgaagaaaaaatgaaaatgaaataacaggatgatagtgatgagtgatgtaaaacatcttacttagatggcagaaccttcgggttgtagaatagtgatgtctaaaaattaaagttattttgggaatacaccactttaatagtatagtcttataaaaattattcattatggtgaacccttcttgtctgctattcgtttcccaacctacttattggaaccacctcaaaacccagttctgaaatgaccttaccaaaagtaaatgtatttattttttagtcagcagaactctgtaattccaaatgttgttctgtgtggtagaattttttttcaggaaccattaggttgtattgaaaatctttgttataggcgataccaaaactgattattcttttttgcagtctgctttaattcatgtccttctgcagttgctctgtattaaaacagggtaaaaaggccatagcccattatgaaaaatataatacaaaactctttgacctatgaggtaacttacagacattgtgttttctaaacaggctgtcagtgaaagcccgtatctgtctccaggtgaatgtaatttacttccgagtactttacccagaggatgtgttccccaggtgggcagagtacagttgatctctagcacagacagagattctggcctctgcatattctcaggtctctgtgtgtacctcccattgagtagagaagcttaagataatttctgagagaagaacactgctgattgtgggagcagtttaggagtccatggaagaaagaaaaatacatgtgtcttggcagccatggtgtatttttgtccaaatggattggaaggatatttgaatatttgaatgttggtatgacataaagctgcagtgcactatagagtcaagtcattgaattaccactcctgatacagggctttattgtactactgtgaagtgtatgtgtgcaatacattggtgagttcatttactggtgtacggaagagccagcaggagcagcgtggtcattgctgggtgctattacagttgcttgtagtgagtgctgttttccaggagatggagccagttgggtgtggcagatctactgaatatcaaatgatgctcttcttcccatgtagaccttcagcaaaagccggtacttggaagccacaggctcaccttctctatctatccaataattattaatgaagagacctccataagggagcagctggctgttatcgataaatgtaccaattattaaataattagtctccaagccattcagtgatgtcttcagcatcactataggactgtctagtgtcactttttacttccttctgggtggaggctttccgactcccaatcatgaaggcaagttaatctttccagttagtgacttttgccccatagttggggtaagcacttcctagattgagaaaaagcagctacagtcaatcctgctctgtttgcctcatttggtgatcagtcagtcacacataagttccttgtattctaaatttcatgcacttctcccagatgctatagggttttctctcactgttgccagtggatgtcatccagacagtgggctcatatcttacggttttgtgcaatcattgtcgtattgtagtcttaagactcattatagtgtatttttgatatttttgaaatgtgttaaattttttaattcaataatatgagccagagcatgttgcagcaaatctattgtttgtaaaaataacaataacaataataaataaaataaagtggaatctttttcatggctttgttttaaaa

SEQ ID NO: 3057 - DNA, 9027 bp, Homo sapiens
ggtaacctcagactcgagtcagtgacactgctcaacgcacccatctcagctttcatcatcagtcctccacccccgccccacaacagcctaccctgcctccggctgggtttctgggcagaggccgaggcttagctcgttatcctcgcctcgcgttgctgcaaaagccgcagcaagtgcagctgcaggctggcggctgggaaccggcccgagcaagccccaggcagctacactgggcatgctcagtagagcctgcggcttggggactctgcgctcgcacccagagctaccgctctgccccctcctaccgccccctgccctgccctgccctcccctcgcccggcgcggtcccgtccgcctctcgctcgcctcccgcctcccctcggtcttccgaggcgcccgggctcccggcgcggcggcggagggggcgggcaggccggcgggcggtgatgtggcgggactctttatgcgctgcggcaggatacgcgctcggcgctgggacgcgactgcgctcagttctctcctctcggaagctgcagccatgatggaagtttgagagttgagccgctgtgaggcgaggccgggctcaggcgagggagatgagagacggcggcggccgcggcccggagcccctctcagcgcctgtgagcagccgcgggggcagcgccctcggggagccggccggcctgcggcggcggcagcggcggcgtttctcgcctcctcttcgtcttttctaaccgtgcagcctcttcctcggcttctcctgaaagggaaggtggaagccgtgggctcgggcgggagccggctgaggcgcggcggcggcggcggcacctcccgctcctggagcgggggggagaagcggcggcggcggcggccgcggcggctgcagctccagggagggggtctgagtcgcctgtcaccatttccagggctgggaacgccggagagttggtctctccccttctactgcctccaacacggcggcggcggcggctggcacatccagggacccgggccggttttaaacctcccgtgcgccgccgccgcaccccccgtggcccgggctccggaggccgccggcggaggcagccgttcggaggattattcgtcttctccccattccgctgccgccgctgccaggcctctggctgctgaggagaagcaggcccagtcgctgcaaccatccagcagccgccgcagcagccattacccggctgcggtccagagccaagcggcggcagagcgaggggcatcagctaccgccaagtccagagccatttccatcctgcagaagaagccccgccaccagcagcttctgccatctctctcctcctttttcttcagccacaggctcccagacatgacagccatcatcaaagagatcgttagcagaaacaaaaggagatatcaagaggatggattcgacttagacttgacctatatttatccaaacattattgctatgggatttcctgcagaaagacttgaaggcgtatacaggaacaatattgatgatgtagtaaggtttttggattcaaagcataaaaaccattacaagatatacaatctttgtgctgaaagacattatgacaccgccaaatttaattgcagagttgcacaatatccttttgaagaccataacccaccacagctagaacttatcaaacccttttgtgaagatcttgaccaatggctaagtgaagatgacaatcatgttgcagcaattcactgtaaagctggaaagggacgaactggtgtaatgatatgtgcatatttattacatcggggcaaatttttaaaggcacaagaggccctagatttctatggggaagtaaggaccagagacaaaaagggagtaactattcccagtcagaggcgctatgtgtattattatagctacctgttaaagaatcatctggattatagaccagtggcactgttgtttcacaagatgatgtttgaaactattccaatgttcagtggcggaacttgcaatcctcagtttgtggtctgccagctaaaggtgaagatatattcctccaattcaggacccacacgacgggaagacaagttcatgtactttgagttccctcagccgttacctgtgtgtggtgatatcaaagtagagttcttccacaaacagaacaagatgctaaaaaaggacaaaatgtttcacttttgggtaaatacattcttcataccaggaccagaggaaacctcagaaaaagtagaaaatggaagtctatgtgatcaagaaatcgatagcatttgcagtatagagcgtgcagataatgacaaggaatatctagtacttactttaacaaaaaatgatcttgacaaagcaaataaagacaaagccaaccgatacttttctccaaattttaaggtgaagctgtacttcacaaaaacagtagaggagccgtcaaatccagaggctagcagttcaacttctgtaacaccagatgttagtgacaatgaacctgatcattatagatattctgacaccactgactctgatccagagaatgaaccttttgatgaagatcagcatacacaaattacaaaagtctgaatttttttttatcaagagggataaaacaccatgaaaataaacttgaataaactgaaaatggacctttttttttttaatggcaataggacattgtgtcagattaccagttataggaacaattctcttttcctgaccaatcttgttttaccctatacatccacagggttttgacacttgttgtccagttgaaaaaaggttgtgtagctgtgtcatgtatatacctttttgtgtcaaaaggacatttaaaattcaattaggattaataaagatggcactttcccgttttattccagttttataaaaagtggagacagactgatgtgtatacgtaggaattttttccttttgtgttctgtcaccaactgaagtggctaaagagctttgtgatatactggttcacatcctacccctttgcacttgtggcaacagataagtttgcagttggctaagagaggtttccgaagggttttgctacattctaatgcatgtattcgggttaggggaatggagggaatgctcagaaaggaaataattttatgctggactctggaccatataccatctccagctatttacacacacctttctttagcatgctacagttattaatctggacattcgaggaattggccgctgtcactgcttgttgtttgcgcatttttttttaaagcatattggtgctagaaaaggcagctaaaggaagtgaatctgtattggggtacaggaatgaaccttctgcaacatcttaagatccacaaatgaagggatataaaaataatgtcataggtaagaaacacagcaacaatgacttaaccatataaatgtggaggctatcaacaaagaatgggcttgaaacattataaaaattgacaatgatttattaaatatgttttctcaattgtaacgacttctccatctcctgtgtaatcaaggccagtgctaaaattcagatgctgttagtacctacatcagtcaacaacttacacttattttactagttttcaatcataatacctgctgtggatgcttcatgtgctgcctgcaagcttcttttttctcattaaatataaaatattttgtaatgctgcacagaaattttcaatttgagattctacagtaagcgttttttttctttgaagatttatgatgcacttattcaatagctgtcagccgttccacccttttgaccttacacattctattacaatgaattttgcagttttgcacattttttaaatgtcattaactgttagggaattttacttgaatactgaatacatataatgtttatattaaaaaggacatttgtgttaaaaaggaaattagagttgcagtaaactttcaatgctgcacacaaaaaaaagacatttgatttttcagtagaaattgtcctacatgtgctttattgatttgctattgaaagaatagggtttttttttttttttttttttttttttttaaatgtgcagtgttgaatcatttcttcatagtgctcccccgagttgggactagggcttcaatttcacttcttaaaaaaaatcatcatatatttgatatgcccagactgcatacgattttaagcggagtacaactactattgtaaagctaatgtgaagatattattaaaaaggtttttttttccagaaatttggtgtcttcaaattataccttcaccttgacatttgaatatccagccattttgtttcttaatggtataaaattccattttcaataacttattggtgctgaaattgttcactagctgtggtctgacctagttaatttacaaatacagattgaataggacctactagagcagcatttatagagtttgatggcaaatagattaggcagaacttcatctaaaatattcttagtaaataatgttgacacgttttccataccttgtcagtttcattcaacaatttttaaatttttaacaaagctcttaggatttacacatttatatttaaacattgatatatagagtattgattgattgctcataagttaaattggtaaagttagagacaactattctaacacctcaccattgaaatttatatgccaccttgtctttcataaaagctgaaaattgttacctaaaatgaaaatcaacttcatgttttgaagatagttataaatattgttctttgttacaatttcgggcaccgcatattaaaacgtaactttattgttccaatatgtaacatggagggccaggtcataaataatgacattataatgggcttttgcactgttattatttttcctttggaatgtgaaggtctgaatgagggttttgattttgaatgtttcaatgtttttgagaagccttgcttacattttatggtgtagtcattggaaatggaaaaatggcattatatatattatatatataaatatatattatacatactctccttactttatttcagttaccatccccatagaatttgacaagaattgctatgactgaaaggttttcgagtcctaattaaaactttatttatggcagtattcataattagcctgaaatgcattctgtaggtaatctctgagtttctggaatattttcttagactttttggatgtgcagcagcttacatgtctgaagttacttgaaggcatcacttttaagaaagcttacagttgggccctgtaccatcccaagtcctttgtagctcctcttgaacatgtttgccatacttttaaaagggtagttgaataaatagcatcaccattctttgctgtggcacaggttataaacttaagtggagtttaccggcagcatcaaatgtttcagctttaaaaaataaaagtagggtacaagtttaatgtttagttctagaaattttgtgcaatatgttcataacgatggctgtggttgccacaaagtgcctcgtttacctttaaatactgttaatgtgtcatgcatgcagatggaaggggtggaactgtgcactaaagtgggggctttaactgtagtatttggcagagttgccttctacctgccagttcaaaagttcaacctgttttcatatagaatatatatactaaaaaatttcagtctgttaaacagccttactctgattcagcctcttcagatactcttgtgctgtgcagcagtggctctgtgtgtaaatgctatgcactgaggatacacaaaaataccaatatgatgtgtacaggataatgcctcatcccaatcagatgtccatttgttattgtgtttgttaacaaccctttatctcttagtgttataaactccacttaaaactgattaaagtctcattcttgtcattgtgtgggtgttttattaaatgagagtttataattcaaattgcttaagtccattgaagttttaattaatgggcagccaaatgtgaatacaaagttttcagtttttttttttcctgctgtccttcaaagcctactgtttaaaaaaaaaaaaaaaaaaaaacatggcctgagagtagagtatctgtctactcatgtttaattaaggaaaaacacttatttttagggctttagtcatcacttcataaattgtataagcacattaaatagcgttctagtcctgaaaaagtccaagattcttagaaaattgtgcatatttttattatgacagatgtttgaagataattccccagaatggatttgatactttagatttcaattttgtggcttttgtctattattctgtactctgccatcagcatatggaaagcttcatttactcatcatgacttgtgccatataaaaattgatatttcggaatagtctaaaggactttttgtacttgaatttaatcatgttgtttctaatattcttaaaagcttgaagactaaagcatatcctttcaacaaagcatagtaaggtaataagaaagtgtagtttgtacaagtgttaaaaaaataaagtagacaatgttacagtgggacttattatttcaagtttacattttctccatgtaattttttaaaaagtaaatgaaaaaatgtgcaataatgtaaaatatgaagtgtatgtgtacacacattttatttttcggtatcttgggtatacgtatggttgaaaactatactggagtctaaaagtattctaatttataagaagacattttggtgatgtttgaaaaatagaaatgtgctagttttgtttttatatcatgtcctttgtacgttgtaatatgagctggcttggttcagtaaatgccatcaccatttccattgagaatttaaaactcaccagtgtttaatatgcaggcttccaaaggcttatgaaaaaaatcaagacccttaaatctagttaatttgctgctaacatgaaactctttggttcttttatttttgccagataattagacacacatctaaagcttagtcttaaatggcttaagtgtagctattgattagtgctgttgctagttcagaaagaaatgtttgtgaatggaaacaagaatattcagtccaaactgttgtaaggacagtacctgaaaaccaggaaacaggataatggaaaaagtcttttaaagatgaaatgttggagccaactttcttatagaattaattgtatgtggctatagaaagcctaatgattgttgcttatttttgagagcatattattcttttatgaccataatcttgctgtttttccatcttccaaaagatcttccttctaatatgtatatcagaatgtgggtagccagtcagacaaattcatattggttggtagctttaaaaagtttgtaatgtgaagacaggaaaggacaaaatagtttgctttggtggtagtactctggttgttaagctaggtattttgagactacttccccatcacaacaacaataaaataatcactcataatcctatcacctggagacatagccatcgttaatatgttagtgactatacaatcatgttttcttctgtatatccatgtatattctttaaaaatgaaatttatactgtacctgatctcaaagctttttagcttagtatatctgtcatgaatttgtaggatgttccattgcatcagaaaacggacagtgatttgattactttctaatgccacagatgcagattacatgtagttattgagaatcctttcgaattcagtggcttaatcatgaatgtctaaatattgttgacattaggatgatacatgtaaattaaagttacatttgtttagcatagacaagcttaacattgtagatgtttctcttcaaaaatcatcttaaacatttgcatttggaattgtgttaaatagaatgtgtgaaacactgtattagtaaacttcatcacctttctacttccttatagtttgaacttttcagtttttgtagttcccaaacagttgctcaatttagagcaaattaatttaacacctgccaaaaaaaggctgctgttggcttatcagttgtctttaaattcaaatgctcatgtgacttttatcacatcaaaaaatatttcattaatgattcacctttagctctgaaaattaccgcgtttagtaattatagtgggcttataaaaacatgcaactctttttgatagttatttgagaattttggtgaaaaatatttagctgagggcagtatagaacttataaaccaatatattgatatttttaaaacatttttacatataagtaaactgccatctttgagcataactacatttaaaaataaagctgcatatttttaaatcaagtgtttaacaagaatttatattttttattttttaaaattaaaaataatttatatttcctctgttgcatgaggattctcatctgtgcttataatggttagagattttatttgtgtggaatgaagtgaggcttgtagtcatggttctagtgtttcagtttgccaagtctgtttactgcagtgaaattcatcaaatgtttcagtgtggttttctgtagcctatcatttactggctatttttttatgtacacctttaggattttctgcctactctatccagttgtccaaatgatatcctacattttacaaatgccctttcagtttctattttctttttccattaaattgccctcatgtcctaatgtgcagtttgtaagtgtgtgtgtgtgtgtctgtgtgtgtgtgaatttgattttcaagagtgctagacttccaatttgagagattaaataatttaattcaggcaaacatttttcattggaatttcacagttcattgtaatgaaaatgttaatcctggatgacctttgacatacagtaatgaatcttggatattaatgaatttgttagtagcatcttgatgtgtgttttaatgagttattttcaaagttgtgcattaaaccaaagttggcatactggaagtgtttatatcaagttccatttggctactgatggacaaaaaatagaaatgccttcctatggagagtatttttcctttaaaaaattaaaaaggttaattattttgacta

SEQ ID NO: 3058 - DNA, 794 bp, Homo sapiens
gaggtggccacgtcagcgcagcgtcgctcggagctcgcggccggatggggaaggcggcggcggcggtggcctttggggccgaagtgggcgtgcggctcgcgctgttcgcggccttcctggtgacggagctgctccccccgttccagagactcatccagccggaggagatgtggctctaccggaacccctacgtggaggcggagtatttccccaccaagccgatgtttgttattgcatttctctctccactgtctctgatcttcctggccaaatttctcaagaaggcagacacaagagacagcagacaagcctgcctggctgccagccttgccctggctctgaatggcgtctttaccaacacaataaaactgatcgtagggaggccacgcccagatttcttctaccgctgcttccctgatgggctagcccattctgacttgatgtgtacaggggataaggacgtggtgaatgagggccgaaagagcttccccagtggacattcttcctgtatgaatatcatatggactctaccctatgcttgttttcacatcattgaatttaacctagaaagctagtagggatgggaaaatctgactactcttgtttctacaatttggaaaatccccccttctttagtaactccacagtttaacaagtctgagccttgactatttgggtaaatattacagaacagaaaggtagtttaccttcatgagatttgcacatttaattgttatattatttgcctagatcctgcaatcttgtactagcaataaaaatacctttaacgaaga

SEQ ID NO: 3059 - DNA, 853 bp, Homo sapiens
gcggccggatggggaaggcggcggcggcggtggcctttggggccgaagtgggcgtgcggctcgcgctgttcgcggccttcctggtgacggagctgctccccccgttccagagactcatccagccggaggagatgtggctctaccggaacccctacgtggaggcggagtatttccccaccaagccgatgtttgttattgcatttctctctccactgtctctgatcttcctggccaaatttctcaagaaggcagacacaagagacagcagacaagcctgcctggctgccagccttgccctggctctgaatggcgtctttaccaacacaataaaactgatcgtagggaggccacgcccagatttcttctaccgctgcttccctgatgggctagcccattctgacttgatgtgtacaggggataaggacgtggtgaatgagggccgaaagagcttccccagtggacattcttcctttgcatttgctggtctggcctttgcgtccttctacctggcagggaagttacactgcttcacaccacaaggccgtgggaaatcttggaggttctgtgcctttctgtcacctctactttttgcagctgtgattgcactgtcccgcacatgtgactacaagcatcactggcaaggaccctttaaatggtgaaaatgggcagatgaatagcaataagtggacctttgttactcttctgagttagaaaaattctaatttagtacactctgaacaaagcttattatacttacttaagatgtgttttgatttggtgttcagaaagcaacctgacaatgataatactgtaactatgataaaattgagaataaaaagattttatttagaaa

SEQ ID NO: 3060 - DNA, 2130 bp, Homo sapiens
tcgctcggagctcgcggccggatggggaaggcggcggcggcggtggcctttggggccgaagtgggcgtgcggctcgcgctgttcgcggccttcctggtgacggagctgctccccccgttccagagactcatccagccggaggagatgtggctctaccggaacccctacgtggaggcggagtatttccccaccaagccgatgtttgttattgcatttctctctccactgtctctgatcttcctggccaaatttctcaagaaggcagacacaagagacagcagacaagcctgcctggctgccagccttgccctggctctgaatggcgtctttaccaacacaataaaactgatcgtagggaggccacgcccagatttcttctaccgctgcttccctgatgggctagcccattctgacttgatgtgtacaggggataaggacgtggtgaatgagggccgaaagagcttccccagtggacattcttcctttgcatttgctggtctggcctttgcgtccttctacctggcagggaagttacactgcttcacaccacaaggccgtgggaaatcttggaggttctgtgcctttctgtcacctctactttttgcagctgtgattgcactgtcccgcacatgtgactacaagcatcactggcaagatgtactagttggatccatgattggaatgacatttgcctatgtctgctatcggcagtattatcctcctctgactgatgcagaatgccataaaccatttcaagacaaacttgtactttccactgcacagaagcctggggattcttattgttttgatatttaaaaattgaatctggccgggcgtggtggctcatgcctgtaatcccaacactttgggaggctgaggagggtggatcacctgaggtcaggaccagcctggccaacatggtgaaccctgtctctactaaaaatacaaaaattagccaggagttgtgtgccgtaatcccagctacctgggaggctgaggtaggagaattgcttgaacctgggagctggaggttccagtgagccgagatcgcaccactgcactccagcctaggcaacagagtgagaccccatctcaaaaaaaaaaaaaattgaatctatctcaatagagaacaggtgaactagccctcctaaccggaccatgcacaagacaagaaattctagcctttttttccccttccaaggtgcaagtgaggacataagccacactgtattctgcctccaaatgattacacacttttgcccctgctcatctatcttgaggagttacggttcttttccactactgtatgccacatgttctagtaaaaggatctttcaaaggtgtccaacaccttatgaatctggtctatcagattaatatctgaagatctacagtgtttttacatttaatttaaatgccattcttagaaggatcttgtcacaaagaagcctttacatagccccaccttgtctcagaagctagagttcattatcaaaacttaatttccatttcatatagctcaaaatcttaaaatctagggcatggccaactaaattactttgattctgtttaccttctctgatgacaattccatcaagccttaaataggaaaatgtcgaatctagggtaatttatcacttttgtgtgcatcttatctgagtccagccatctggtactgctgtgcattttgaacaccgtgggcataaacaatttgttgaattactaagtgaaaacaataataaagaagaaaatggtcaggagtgtggtttcagcactactaacagatgactgtttctacctcatttgaccataactgtacttgtgagcttctttccttccattcatgactgaagatctgctcaaatgcaccaacactgccaagtgactaaggtagaaaagaaaaatgacaggtatcgtcatctgaaggacagatgaatctttttctgccccttcttcacaatggaatataaggaacaattatgggatgtcatcagaatggatgccataggacctacagctccctttctctttattgtgattatactttaaatatgacattgtcttttatgtgtatgttcctatattttcaatgtatctttttccttcagtaaacctgatattcaaataaaa

SEQ ID NO: 3061 - DNA, 2473 bp, Homo sapiens
attattgacagagatgtcagtgaagtgccagagtgaagtggcactgcctaagaacagagtgtgaaggcactctatctattaagcacaactctaagaattcttgccttaaacacaataagaaaacaatgccattttatgttagctttgggaagggggagtaagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactgaagaccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagtaaaaaaaaaaaatggcttcagaattaaaactatgaaatattttacagtttttcttgtacagagtacttggctgttagcccaaggttaaaaagttcataacagattttttttggactgttttgttgggcagtgcctgataagcttcaaagctgctttattcaataaaaaaaagaaatgaaaaagat

SEQ ID NO: 3062 - DNA, 9093 bp, Homo sapiens
tctccctcggcgccgccgccgccgcccgcggggctgggacccgatgcggttagagccgcggagcctggaagagccccgagcgtttctgctttgggacaaccatacatctaattccttaaagtagttttatatgtaaaacttgcaaagaatcagaacaatgcctccacgaccatcatcaggtgaactgtggggcatccacttgatgcccccaagaatcctagtagaatgtttactaccaaatggaatgatagtgactttagaatgcctccgtgaggctacattaataaccataaagcatgaactatttaaagaagcaagaaaataccccctccatcaacttcttcaagatgaatcttcttacattttcgtaagtgttactcaagaagcagaaagggaagaattttttgatgaaacaagacgactttgtgaccttcggctttttcaaccctttttaaaagtaattgaaccagtaggcaaccgtgaagaaaagatcctcaatcgagaaattggttttgctatcggcatgccagtgtgtgaatttgatatggttaaagatccagaagtacaggacttccgaagaaatattctgaacgtttgtaaagaagctgtggatcttagggacctcaattcacctcatagtagagcaatgtatgtctatcctccaaatgtagaatcttcaccagaattgccaaagcacatatataataaattagataaagggcaaataatagtggtgatctgggtaatagtttctccaaataatgacaagcagaagtatactctgaaaatcaaccatgactgtgtaccagaacaagtaattgctgaagcaatcaggaaaaaaactcgaagtatgttgctatcctctgaacaactaaaactctgtgttttagaatatcagggcaagtatattttaaaagtgtgtggatgtgatgaatacttcctagaaaaatatcctctgagtcagtataagtatataagaagctgtataatgcttgggaggatgcccaatttgatgttgatggctaaagaaagcctttattctcaactgccaatggactgttttacaatgccatcttattccagacgcatttccacagctacaccatatatgaatggagaaacatctacaaaatccctttgggttataaatagtgcactcagaataaaaattctttgtgcaacctacgtgaatgtaaatattcgagacattgataagatctatgttcgaacaggtatctaccatggaggagaacccttatgtgacaatgtgaacactcaaagagtaccttgttccaatcccaggtggaatgaatggctgaattatgatatatacattcctgatcttcctcgtgctgctcgactttgcctttccatttgctctgttaaaggccgaaagggtgctaaagaggaacactgtccattggcatggggaaatataaacttgtttgattacacagacactctagtatctggaaaaatggctttgaatctttggccagtacctcatggattagaagatttgctgaaccctattggtgttactggatcaaatccaaataaagaaactccatgcttagagttggagtttgactggttcagcagtgtggtaaagttcccagatatgtcagtgattgaagagcatgccaattggtctgtatcccgagaagcaggatttagctattcccacgcaggactgagtaacagactagctagagacaatgaattaagggaaaatgacaaagaacagctcaaagcaatttctacacgagatcctctctctgaaatcactgagcaggagaaagattttctatggagtcacagacactattgtgtaactatccccgaaattctacccaaattgcttctgtctgttaaatggaattctagagatgaagtagcccagatgtattgcttggtaaaagattggcctccaatcaaacctgaacaggctatggaacttctggactgtaattacccagatcctatggttcgaggttttgctgttcggtgcttggaaaaatatttaacagatgacaaactttctcagtatttaattcagctagtacaggtcctaaaatatgaacaatatttggataacttgcttgtgagatttttactgaagaaagcattgactaatcaaaggattgggcactttttcttttggcatttaaaatctgagatgcacaataaaacagttagccagaggtttggcctgcttttggagtcctattgtcgtgcatgtgggatgtatttgaagcacctgaataggcaagtcgaggcaatggaaaagctcattaacttaactgacattctcaaacaggagaagaaggatgaaacacaaaaggtacagatgaagtttttagttgagcaaatgaggcgaccagatttcatggatgctctacagggctttctgtctcctctaaaccctgctcatcaactaggaaacctcaggcttgaagagtgtcgaattatgtcctctgcaaaaaggccactgtggttgaattgggagaacccagacatcatgtcagagttactgtttcagaacaatgagatcatctttaaaaatggggatgatttacggcaagatatgctaacacttcaaattattcgtattatggaaaatatctggcaaaatcaaggtcttgatcttcgaatgttaccttatggttgtctgtcaatcggtgactgtgtgggacttattgaggtggtgcgaaattctcacactattatgcaaattcagtgcaaaggcggcttgaaaggtgcactgcagttcaacagccacacactacatcagtggctcaaagacaagaacaaaggagaaatatatgatgcagccattgacctgtttacacgttcatgtgctggatactgtgtagctaccttcattttgggaattggagatcgtcacaatagtaacatcatggtgaaagacgatggacaactgtttcatatagattttggacactttttggatcacaagaagaaaaaatttggttataaacgagaacgtgtgccatttgttttgacacaggatttcttaatagtgattagtaaaggagcccaagaatgcacaaagacaagagaatttgagaggtttcaggagatgtgttacaaggcttatctagctattcgacagcatgccaatctcttcataaatcttttctcaatgatgcttggctctggaatgccagaactacaatcttttgatgacattgcatacattcgaaagaccctagccttagataaaactgagcaagaggctttggagtatttcatgaaacaaatgaatgatgcacatcatggtggctggacaacaaaaatggattggatcttccacacaattaaacagcatgcattgaactgaaaagataactgagaaaatgaaagctcactctggattccacactgcactgttaataactctcagcaggcaaagaccgattgcataggaattgcacaatccatgaacagcattagaatttacagcaagaacagaaataaaatactatataatttaaataatgtaaacgcaaacagggtttgatagcacttaaactagttcatttcaaaattaagctttagaataatgcgcaatttcatgttatgccttaagtccaaaaaggtaaactttgaagattgtttgtatctttttttaaaaaacaaaacaaaacaaaaatccccaaaatatatagaaatgatggagaaggaaaaagtgatggttttttttgtcttgcaaatgttctatgttttgaaatgtggacacaacaaaggctgttattgcattaggtgtaagtaaactggagtttatgttaaattacattgattggaaaagaatgaaaatttcttatttttccattgctgttcaatttatagtttgaagtgggtttttgactgcttgtttaatgaagaaaaatgcttggggtggaagggactcttgagatttcaccagagactttttctttttaataaatcaaaccttttgatgatttgaggttttatctgcagttttggaagcagtcacaaatgagacctgttataaggtggtatttttttttttcttctggacagtatttaaaggatcttattcttatttcccagggaaattctgggctcccacaaagtaaaaaaaaaaaaaaatcatagaaaaagaatgagcaggaatagttcttattccagaattgtacagtattcaccttaagttgattttttttctccttctgcaattgaactgaatacatttttcatgcatgttttccagaaaatagaagtattaatgttattaaaaagattattttttttattaaaggctatttatattatagaaactatcattaatatatattctttatttacatgatctgtcccatagtcatgcattgttttgcaccccaaattttttattgttcatagcagcatggtcagctttcttcttgatctatagatgaggctcaggcactatcccatttataccaataaccagtgtataactacttaaggaaaacataaaaacttcatcttctttccttttatttcttatgtgaatctcccgtcttccattctcttttataattgagaatgtctcaatcatatgaaattagttaccagaattaacacaatttagactatcttcctgattccttaaacccctttactgaagtatactcatgaataatactttaaaatatgggggaatagaaaccatgaactttttacctttttaaactatttatccatatctccaaagtagaacattaaaccattttaagatatgtctcattcccaagtagtcagagctcactctccaactttattaaatactatttgagcacaggacacattcttaaacattttgaaaaacattaacccaagatgtagaggctactgctagtcgtcattctagaatctgatattttactctgtatttgaaatgaatgattaatgtcctaggaaattagctttagcagatgtccaggtgccacatcaaaaaagtgcaataattattgacagttttttagattaggcatattattggaaaacaactttataaagagtgaacattgtatactctagtaaaacagcatcactttaaaaatattcatttatgaaatctgttacctatagttgaagtcttgagtagtgaacaagggactctaataccaatactcttaatatctggctattttagatcccttaaagggcataattattggaaatttaggtatttcactaaagcatgtatataatattgccaacaagaaaagtaaatttgaagattaagggaacttacttctgcaaactgtcttgcgatagttaagcagaatttaaactctgttttaagcaggaaaccagaaagattattttgcagttgtagaagatttcataacttattaaaacttattaacattttgtgttgtttagatataggcagttgatacatactaacatcccagccttttcaatatcagggttaaattataggaaaactcagtaaaatggtacaaatctgaaagtttgatggtagaaactgaagatttaacagagaactgtgttttacccgagtgccaaaaatgctgtgagcctccttgcacaaaatttataccacttttgcatttttatctatcagtccagatagttgtctcccctccttctcccaggacctctccaccattaaaatgcacaaaccacatggccgatttcaccatttacatttattttcaaaagttactacaaccaaattaattctattagaagaaatgtagacaaattctataaagactatagattgtgacctaagaaagaaatgaggcaaagaaccaaacattgaattaaatgctacatgggtgactaagatctgtttcaagtcagtgataatatagccacttctgggtacttcagtatcagagatcagttctcgtggtttagacagttcctatctatagctgactatccttgtccttgaatatggtgtaactgactattggctctacagttttattgggccacttaagaaatatttccttgaataattattttgagaaaaagtctaaaagtaataaaaataattttaaacacactgtagtaagaaatgactgttggaaaattatgctttcactttctaccatattctcagctatacaaaaccatttattttgaagatttttagactactgttaatttgaaatctgttactcttattgtggaatttgtttttttaaaaaagatgtttctaattggatttttaaaagaagaatggaatttggttgctattttacaatagaacctaagctttttgtggttcttagtgtcctatgtaaaacttagtgtcaaagtaatcaactttgagattttcccttctattctgctttatattaaaagcccattagaaaatgggaacctggtgaatatataatgaattgtaaaatattttaatgtgtaactttttcaactgtgaaactgacttgattttttgatgaaaacagctgctgataaagtattttgtgtaaagtgtagttcttattaatcaggaaaatgatgacttgattagactgtatatgccctcttggattttattttaaatggattggtgactttcacataggtaaaacacagtccatctgtattcttttttccatcaaaaatcgagtgatttggaattataaaaaaattgtgagcagcctatttgaaaggcatcatggaaatttcacagcacaataacacggatttgttttttcttaatgatgtaaatccgtttaattcatactttgatcaatagcccatgcttgccaactctgaagaaatttaatttccagcagtattttaaagctagcctgttaactttttctgaatatttaaagttcctcttttttctatgtctgcacaaactgcagacctgggctggacccacatactcaagagtccaccttaagaaattattttgatgtccaagacatcactaaaatatttaagtttaaagataatatgtggtgttaatagattgtggtgcttttactatttaaagacaactttcatacttcagatgtttttgagaagaggggaatgtgaggggagggggcagaacagggaggagttgtttgaatgaattacattctttatatccatcctgctcatttggggcatgtctttaagagaaggctgaaagttgtgagagtatattgtataccgtaagagaatcaactcttcatcatggatgggattgtgaaggctgaactataaaattcagcattgacagcatcctcaattaataattcttggtgacagaataatacagctgggctgttttttaaaatataaacaataccatttttaattattacattaaaaattgtaaatatatctatgtgccatggcctgggaagcctgctttcttttttcataaaaattatttttactgtatgaaaagatcatggggtttagctcaaaatatctgtggtcctgataaaattggattggtaactctacctcagaaggaaaatgggaaaaaaaaatagatgagtcacaattcaatacttcaagctcagaaactgtgcagatcactgaattttagatttataaagtcagagttggcatgccttgtttttaatgatatggaagaccttaagaaaaaaacttggctgaagtttaatcgttggtccagccatttgaaaaaggcaatagtttgaggaggttcccgaattcggcatttgaaattcattttgttctctcttcttcattattagtgcatttggtgtgtgtatacttgcacacaattctgtttgtgtacacactgcttgcttagccctagtcaagaggcatcttttataaaaggtgtaaagaaatatcaaggttctaaaattcggaagagtttagaatttattaggagtttcccaagttgggatgttagtctttaaataaacttcatgcacctattccacttaaggttttgcacctcctttttattagtgcagtgccatttcttctgcttgattttaggtatgttaatattccagccttgctagttagcataaagtgacaggtgtgagccatgaggaaattttctgacttaatttgtacacaactacatataagagttttagtggaggaaaaaaattagtcccttgtgcgtatacagtagttaggtaaatgatttttctaccaacagtatactccattcctcatgtaggtaagtacagaaaaggtttttaaatgtatttttttagccagttaaagtctatgaatctatctgcaaccttatttaatctgtcactataataattttgtggttatgctaagaaccatgtatacttttaggtattcttatttttgtcaatttttctaggttggcaaggaggcagaaaaccttcattgtttcatattaaaatataattagactaaacttaattctagtatgaatttccaaaatcattatctatttatttcatttttatttaattttgtttttatttcatttttaaaagtcccttgttcaatttaacttatgttcctaagagaggttggagaacttggccttcatctgatttcaaaaatgttttgagtttcaaatgaagttaatggtttcagtgtgattcagtcctcagacctaattgggttgaataaaatctaaaagaatatacccttttggagcataacattttaataccttggggaatgtggcactaccaaaagaagactactaacacgtcagatgttcacctggaagctttatcaagaaattcgaaccacccttttggccccattaattgtagcaagtttatttctctatattttgtcattcagtgaattgaagtcctgtggtatactgcattcattagaagaaaaacgtttttaatgtccttttaatgatggcccagaaagcatttgacacagcaagatgcatgtgttactatattgagaatatagaataataacagtatcactaaatttaagacctcttcccagtcttgctgttcctagcaagaagtttggcctgtgactgcacttactgtttatgctcatcagaaactgtcaatgtctgcttttctttaactctgcagtctgtaacatcacgctgtttattaaaaaaaaaaagaaaaatta

SEQ ID NO: 3063 - DNA, 620 bp, Homo sapiens
ggagcgcaacaagagggtctttctagaaaacagtctgcatattctttaatgaattagagttgtgatttcatcttggtgaagcttcctcattccagcactgcgcctttgtgcacatgcaggacctgggttttcggaacgatgttttgaatcatagtttgtgtggccggggagaaccccttagaatacttgggtttctgctttgggacaaccatacatctaattccttaaagtagttttatatgtaaaacttgcaaagaatcagaacaatgcctccacgaccatcatcaggtgaactgtggggcatccacttgatgcccccaagaatcctagtagaatgtttactaccaaatggaatgatagtgactttagaatgcctccgtgaggctacattaataaccataaagcatgaactatttaaagaagcaagaaaataccccctccatcaacttcttcaagatgaatcttcttacattttcgtaagtgttactcaagaagcagaaagggaagaattttttgatgaaacaagacgactttgtgaccttcggctttttcaaccctttttaaaagtaattgaaccagtaggcaaccgtgaagaaaagatcctcaatcgagaaattggt

SEQ ID NO: 3064 - DNA, 245 bp, Homo sapiens
ttccgggggattgtaggctctgcccctcctcagctcttaccctcttctgccggaggagggggggggccgagggggtggggaagagttcgttgtttgtttacacgatgtttctgctttgggacaaccatacatctaattccttaaagtagttttatatgtaaaacttgcaaagaatcagaacaatgcctccacgaccatcatcaggtgaactgtggggcatccacttgatgcccccaagaatccta

SEQ ID NO: 3065 - DNA, 3213 bp, Homo sapiens
atgtgcttcagtttcataatgcctcctgctatggcagacatccttgacatctgggcggtggattcacagatagcatctgatggctccatacctgtggatttccttttgcccactgggatttatatccagttggaggtacctcgggaagctaccatttcttatattaagcagatgttatggaagcaagttcacaattacccaatgttcaacctccttatggatattgactcctatatgtttgcatgtgtgaatcagactgctgtatatgaggagcttgaagatgaaacacgaagactctgtgatgtcagaccttttcttccagttctcaaattagtgacaagaagttgtgacccaggggaaaaattagactcaaaaattggagtccttataggaaaaggtctgcatgaatttgattccttgaaggatcctgaagtaaatgaatttcgaagaaaaatgcgcaaattcagcgaggaaaaaatcctgtcacttgtgggattgtcttggatggactggctaaaacaaacatatccaccagagcatgaaccatccatccctgaaaacttagaagataaactttatgggggaaagctcatcgtagctgttcattttgaaaactgccaggacgtgtttagctttcaagtgtctcctaatatgaatcctatcaaagtaaatgaattggcaatccaaaaacgtttgactattcatgggaaggaagatgaagttagcccctatgattatgtgttgcaagtcagcgggagagtagaatatgtttttggtgatcatccactaattcagttccagtatatccggaactgtgtgatgaacagagccctgccccattttatacttgtggaatgctgcaagatcaagaaaatgtatgaacaagaaatgattgccatagaggctgccataaatcgaaattcatctaatcttcctcttccattaccaccaaagaaaacacgaattatttctcatgtttgggaaaataacaaccctttccaaattgtcttggttaagggaaataaacttaacacagaggaaactgtaaaagttcatgtcagggctggtctttttcatggtactgagctcctgtgtaaaaccatcgtaagctcagaggtatcagggaaaaatgatcatatttggaatgaaccactggaatttgatattaatatttgtgacttaccaagaatggctcgattatgttttgctgtttatgcagttttggataaagtaaaaacgaagaaatcaacgaaaactattaatccctctaaatatcagaccatcaggaaagctggaaaagtgcattatcctgtagcgtgggtaaatacgatggtttttgactttaaaggacaattgagaactggagacataatattacacagctggtcttcatttcctgatgaactcgaagaaatgttgaatccaatgggaactgttcaaacaaatccatatactgaaaatgcaacagctttgcatgttaaatttccagagaataaaaaacaaccttattattaccctcccttcgataagattattgaaaaggcagctgagattgcaagcagtgatagtgctaatgtgtcaagtcgaggtggaaaaaagtttcttcctgtattgaaagaaatcttggacagggatcccttgtctcaactgtgtgaaaatgaaatggatcttatttggactttgcgacaagactgccgagagattttcccacaatcactgccaaaattactgctgtcaatcaagtggaataaacttgaggatgttgctcagcttcaggcgctgcttcagatttggcctaaactgcccccccgggaggccctagagcttctggatttcaactatccagaccagtacgttcgagaatatgctgtaggctgcctgcgacagatgagtgatgaagaactttctcaatatcttttacaactggtgcaagtgttaaaatatgagccttttcttgattgtgccctctctagattcctattagaaagagcacttggtaatcggaggatagggcagtttctattttggcatcttaggtcagaagtgcacattcctgctgtctcagtacaatttggtgtcatccttgaagcatactgccggggaagtgtggggcacatgaaagtgctttctaagcaggttgaagcactcaataagttaaaaactttaaatagtttaatcaaactgaatgccgtgaagttaaacagagccaaagggaaggaggccatgcatacctgtttaaaacagagtgcttaccgggaagccctctctgacctgcagtcacccctgaacccatgtgttatcctctcagaactctatgttgaaaagtgcaaatacatggattccaaaatgaagcctttgtggctggtatacaataacaaggtatttggtgaggattcagttggagtgatttttaaaaatggtgatgatttacgacaggatatgttgacactccaaatgttgcgcttgatggatttactctggaaagaagctggtttggatcttcggatgttgccttatggctgtttagcaacaggagatcgctctggcctcattgaagttgtgagcacctctgaaacaattgctgacattcagctgaacagtagcaatgtggctgctgcagcagccttcaacaaagatgcccttctgaactggcttaaagaatacaactctggggatgacctggaccgagccattgaggaatttacactgtcctgtgctggctactgtgtagcttcttatgtccttgggattggtgacagacatagtgacaacatcatggtcaaaaaaactggccagctcttccacattgactttggacatattcttggaaatttcaaatctaagtttggcattaaaagggagcgagtgccttttattcttacctatgatttcatccatgtcattcaacaaggaaaaacaggaaatacagaaaagtttggccggttccgccagtgttgtgaggatgcatatctgattttacgacggcatgggaatctcttcatcactctctttgcgctgatgttgactgcagggcttcctgaactcacatcagtcaaagatatacagtatcttaaggactctcttgcattagggaagagtgaagaagaagcactcaaacagtttaagcaaaaatttgatgaggcgctcagggaaagctggactactaaagtgaactggatggcccacacagttcggaaagactacagatcttaa

SEQ ID NO: 3066 - DNA, 667 bp, Homo sapiens
tggcgcgcgcgcacacgggcgcgggttcggcggcggcgcgcgcgtgctctgtcggcctgtgcggcgctgcggcggagcgggccatggcagtggggagggggcgagtgtagtgctgcgcggggcaggcgggaggtgatcgagagaggcagggatgggggcgccggagtggagcggttgcggcggcctgggctgctgactgcgcacttggaatagtagcaggcggcggcggcggaacgccaggcagtgtatgttttaactggaaaaagtcttccatgaaaacgtcacttttaaaaaataagtaatgccatctgttttcctaaaagactgaaatgggggcgaccattcttagggccccgtggttatgaatgtgcttcagtttcataatgcctcctgctatggcagacatccttgacatctgggcggtggattcacagatagcatctgatggctccatacctgtggatttccttttgcccactgggatttatatccagttggaggtacctcgggaagctaccatttcttatattaagcagatgttatggaagcaagttcacaattacccaatgttcaacctccttatggatattgactcctatatgtttgcatgtgtgaatcagactgctgtatatgaggagcttgaagatgaaacacgaagactctgtga

SEQ ID NO: 3067 - DNA, 690 bp, Homo sapiens
tgtattttttagtagagatggggtttcactgtgttagccaggatggtcacgatctcctgacctcgtgatccgtccacctcagccccccagagtgctgggattacaggcatgagccactgtgcccggccaaaaaaaatctctttttaaatatctcctatgattttggttgaatttgttcacctatagaacaaatttatgttgttttctgcttatcattagatgtaaaggagtaaagtccagtgggttctgctggcacattggtggggaagctgagaacttttaaactctttcccctttctccagtgaacaatcgacaggatatgggttatagttacagttaaagggtttattgaactaattgtcactgctgaagttcctgtgccctctgatagcttccttgaaaagttttcatagtttaaaaactctgcttgtccttagcctttgatctcttgctttgatgctcaaacagaagaatgatacaagactgaggatcttgccaggcaagggccccgtggttatgaatgtgcttcagtttcataatgcctcctgctatggcagacatccttgacatctgggcggtggattcacagatagcatctgatggctccatacctgtggatttccttttgcccactgggatttatatccagttggaggtacctcgggaagctaccatttcttatattaagc

SEQ ID NO: 3068 - DNA, 4658 bp, Homo sapiens
gggctgctgactgcgcacttggaatagtagcaggcggcggcggcggaacgccaggcagggccccgtggttatgaatgtgcttcagtttcataatgcctcctgctatggcagacatccttgacatctgggcggtggattcacagatagcatctgatggctccatacctgtggatttccttttgcccactgggatttatatccagttggaggtacctcgggaagctaccatttcttatattaagcagatgttatggaagcaagttcacaattacccaatgttcaacctccttatggatattgactcctatatgtttgcatgtgtgaatcagactgctgtatatgaggagcttgaagatgaaacacgaagactctgtgatgtcagaccttttcttccagttctcaaattagtgacaagaagttgtgacccaggggaaaaattagactcaaaaattggagtccttataggaaaaggtctgcatgaatttgattccttgaaggatcctgaagtaaatgaatttcgaagaaaaatgcgcaaattcagcgaggaaaaaatcctgtcacttgtgggattgtcttggatggactggctaaaacaaacatatccaccagagcatgaaccatccatccctgaaaacttagaagataaactttatgggggaaagctcatcgtagctgttcattttgaaaactgccaggacgtgtttagctttcaagtgtctcctaatatgaatcctatcaaagtaaatgaattggcaatccaaaaacgtttgactattcatgggaaggaagatgaagttagcccctatgattatgtgttgcaagtcagcgggagagtagaatatgtttttggtgatcatccactaattcagttccagtatatccggaactgtgtgatgaacagagccctgccccattttatacttgtggaatgctgcaagatcaagaaaatgtatgaacaagaaatgattgccatagaggctgccataaatcgaaattcatctaatcttcctcttccattaccaccaaagaaaacacgaattatttctcatgtttgggaaaataacaaccctttccaaattgtcttggttaagggaaataaacttaacacagaggaaactgtaaaagttcatgtcagggctggtctttttcatggtactgagctcctgtgtaaaaccatcgtaagctcagaggtatcagggaaaaatgatcatatttggaatgaaccactggaatttgatattaatatttgtgacttaccaagaatggctcgattatgttttgctgtttatgcagttttggataaagtaaaaacgaagaaatcaacgaaaactattaatccctctaaatatcagaccatcaggaaagctggaaaagtgcattatcctgtagcgtgggtaaatacgatggtttttgactttaaaggacaattgagaactggagacataatattacacagctggtcttcatttcctgatgaactcgaagaaatgttgaatccaatgggaactgttcaaacaaatccatatactgaaaatgcaacagctttgcatgttaaatttccagagaataaaaaacaaccttattattaccctcccttcgataagattattgaaaaggcagctgagattgcaagcagtgatagtgctaatgtgtcaagtcgaggtggaaaaaagtttcttcctgtattgaaagaaatcttggacagggatcccttgtctcaactgtgtgaaaatgaaatggatcttatttggactttgcgacaagactgccgagagattttcccacaatcactgccaaaattactgctgtcaatcaagtggaataaacttgaggatgttgctcagcttcaggcgctgcttcagatttggcctaaactgcccccccgggaggccctagagcttctggatttcaactatccagaccagtacgttcgagaatatgctgtaggctgcctgcgacagatgagtgatgaagaactttctcaatatcttttacaactggtgcaagtgttaaaatatgagccttttcttgattgtgccctctctagattcctattagaaagagcacttggtaatcggaggatagggcagtttctattttggcatcttaggtcagaagtgcacattcctgctgtctcagtacaatttggtgtcatccttgaagcatactgccggggaagtgtggggcacatgaaagtgctttctaagcaggttgaagcactcaataagttaaaaactttaaatagtttaatcaaactgaatgccgtgaagttaaacagagccaaagggaaggaggccatgcatacctgtttaaaacagagtgcttaccgggaagccctctctgacctgcagtcacccctgaacccatgtgttatcctctcagaactctatgttgaaaagtgcaaatacatggattccaaaatgaagcctttgtggctggtatacaataacaaggtatttggtgaggattcagttggagtgatttttaaaaatggtgatgatttacgacaggatatgttgacactccaaatgttgcgcttgatggatttactctggaaagaagctggtttggatcttcggatgttgccttatggctgtttagcaacaggagatcgctctggcctcattgaagttgtgagcacctctgaaacaattgctgacattcagctgaacagtagcaatgtggctgctgcagcagccttcaacaaagatgcccttctgaactggcttaaagaatacaactctggggatgacctggaccgagccattgaggaatttacactgtcctgtgctggctactgtgtagcttcttatgtccttgggattggtgacagacatagtgacaacatcatggtcaaaaaaactggccagctcttccacattgactttggacatattcttggaaatttcaaatctaagtttggcattaaaagggagcgagtgccttttattcttacctatgatttcatccatgtcattcaacaaggaaaaacaggaaatacagaaaagtttggccggttccgccagtgttgtgaggatgcatatctgattttacgacggcatgggaatctcttcatcactctctttgcgctgatgttgactgcagggcttcctgaactcacatcagtcaaagatatacagtatcttaaggactctcttgcattagggaagagtgaagaagaagcactcaaacagtttaagcaaaaatttgatgaggcgctcagggaaagctggactactaaagtgaactggatggcccacacagttcggaaagactacagatcttaacgatcagccttcgctcctaatgtatttgttggtttcatttcattttcattttgcacttgcactaaattgaacatgaccctgttagagatgttataaagggaatgaaatcctggaactcagagttaaattaagaacaaggcatcccacagaacctaatctgaacaatccccgatgattccctctgctttttgaatgcttccaagacttatcatgaaaactgtcaatggataatcatttcctgctgactttgcacgccaaggaatgctactagggattgtttccgtttttgtttgttttttctaatatttggtacttcccagaatggtgtaaatacttcttttcaatgttgtgaccaagtattgtcactcagccaacaacttttccacacctgggggttggtggctgttcttactgtccaaatgaagctaaaaagaaaggcatctttcttcccttttaaaattgtgtaaactgcaaattataatataatttgaatttatgattattttccagaagaaatcttgtaaacctgtggatactcattaattcttttgttaatatttatttccatgatagcatcattccagccagacttgctgaaaatctactggtgaggcaaatataatatatataaatatgctacatatatatttataaaatttctagtgggagttctatataaatgtttctttggtattcttcagcctgtgatttaaagttttacaaaaagcagagctttttcctaagttacttttcagttaggtaactgtgtgatccagttcttccagctgcttctataatgaggcacatattaatacagtttttatatggtatctatgaaagagttcacttcatagagaataatacttgagcaaatgtatccaagaaagcaagcaaatgaaaagaaacctatttatggaataaactccagatctgaaattcagtattttagaaaaatgccagctcttcttactgtatttattaaaacttgtaataatgtgatttttttcaaggatattagttcaaattgaaatggtttcacgccacacggaaatctttaagttatttgttgaggtaccatatatttagggtgctaggggcaagtaatgttaatatgtgcaataggaactactggtttgaatgtgtaaatgggtgatctctctgagtcctggcaacatccagcaaaactactgcttattctccaaagaatattgggagctctcaatcctcggtgatatgggaaagagaactgagtatttgccctatgactgagctttctataggaattttattaaagaatgtttaattttgttgtccttcttaatgttctcagtcaaataaatgagtgagctggtttcggctgctcttggaatg

SEQ ID NO: 3069 - DNA, 721 bp, Homo sapiens
tgtagtgctgcgcggggcaggcgggaggtgatcgagagaggcagggatgggggcgccggagtggagcggttgcggcggcctgggctgctgactgcgcacttggaatagtagcaggcggcggcggcggaacgccaggcagtgtatgttttaactggaaaaagtcttccatgaaaacgtcacttttaaaaaataagtaatgccatctgttttcctaaaagactgaaatgggggcgaccattcttagcctttgatctcttgctttgatgctcaaacagaagaatgatacaagactgaggatcttgccaggcaagggccccgtggttatgaatgtgcttcagtttcataatgcctcctgctatggcagacatccttgacatctgggcggtggattcacagatagcatctgatggctccatacctgtggatttccttttgcccactgggatttatatccagttggaggtacctcgggaagctaccatttcttatattaagcagatgttatggaagcaagttcacaattacccaatgttcaacctccttatggatattgactcctatatgtttgcatgtgtgaatcagactgctgtatatgaggagcttgaagatgaaacacgaagactctgtgatgtcagaccttttcttccagttctcaaattagtgacaagaagttgtgacccaggggaaaaattagactcaaaaattggagtccttataggaa

SEQ ID NO: 3070 - DNA, 2347 bp, Homo sapiens
atgtcagggctggtctttttcatggtactgagctcctgtgtaaaaccatcgtaagctcagaggtatcagggaaaaatgatcatatttggaatgaaccactggaatttgatattaatatttgtgacttaccaagaatggctcgattatgttttgctgtttatgcagttttggataaagtaaaaacgaagaaatcaacgaaaactattaatccctctaaatatcagaccatcaggaaagctggaaaagtgcattatcctgtagcgtgggtaaatacgatggtttttgactttaaaggacaattgagaactggagacataatattacacagctggtcttcatttcctgatgaactcgaagaaatgttgaatccaatgggaactgttcaaacaaatccatatactgaaaatgcaacagctttgcatgttaaatttccagagaataaaaaacaaccttattattaccctcccttcgataagagtcgaggtggaaaaaagtttcttcctgtattgaaagaaatcttggacagggatcccttgtctcaactgtgtgaaaatgaaatggatcttatttggactttgcgacaagactgccgagagattttcccacaatcactgccaaaattactgctgtcaatcaagtggaataaacttgaggatgttgctcagcttcaggcgctgcttcagatttggcctaaactgcccccccgggaggccctagagcttctggatttcaactatccagaccagtacgttcgagaatatgctgtaggctgcctgcgacagatgagtgatgaagaactttctcaatatcttttacaactggtgcaagtgttaaaatatgagccttttcttgattgtgccctctctagattcctattagaaagagcacttggtaatcggaggatagggcagtttctattttggcatcttaggtcagaagtgcacattcctgctgtctcagtacaatttggtgtcatccttgaagcatactgccggggaagtgtggggcacatgaaagtgctttctaagcaggttgaagcactcaataagttaaaaactttaaatagtttaatcaaactgaatgccgtgaagttaaacagagccaaagggaaggaggccatgcatacctgtttaaaacagagtgcttaccgggaagccctctctgacctgcagtcacccctgaacccatgtgttatcctctcagaactctatgttgaaaagtgcaaatacatggattccaaaatgaagcctttgtggctggtatacaataacaaggtatttggtgaggattcagttggagtgatttttaaaaatggtgatgatttacgacaggatatgttgacactccaaatgttgcgcttgatggatttactctggaaagaagctggtttggatcttcggatgttgccttatggctgtttagcaacaggagatcgctctggcctcattgaagttgtgagcacctctgaaacaattgctgacattcagctgaacagtagcaatgtggctgctgcagcagccttcaacaaagatgcccttctgaactggcttaaagaatacaactctggggatgacctggaccgagccattgaggaatttacactgtcctgtgctggctactgtgtagcttcttatgtccttgggattggtgacagacatagtgacaacatcatggtcaaaaaaactggccagctcttccacattgactttggacatattcttggaaatttcaaatctaagtttggcattaaaagggagcgagtgccttttattcttacctatgatttcatccatgtcattcaacaaggaaaaacaggaaatacagaaaagtttggccggttccgccagtgttgtgaggatgcatatctgattttacgacggcatgggaatctcttcatcactctctttgcgctgatgttgactgcagggcttcctgaactcacatcagtcaaagatatacagtatcttaaggactctcttgcattagggaagagtgaagaagaagcactcaaacagtttaagcaaaaatttgatgaggcgctcagggaaagctggactactaaagtgaactggatggcccacacagttcggaaagactacagatcttaacgatcagccttcgctcctaatgtatttgttggtttcatttcattttcattttgcacttgcactaaattgaacatgaccctgttagagatgttataaagggaatgaaatcctggaactcagagttaaattaagaacaaggcatcccacagaacctaatctgaacaatccccgatgattccctctgctttttgaatgcttccaagacttatcatgaaaactgtcaatggataatcatttcc

SEQ ID NO: 3071 - DNA, 3181 bp, Homo sapiens
caggaaagctggaaaagtgcattatcctgtagcgtgggtaaatacgatggtttttgactttaaaggacaattgagaactggagacataatattacacagctggtcttcatttcctgattattgaaaaggcagctgagattgcaagcagtgatagtgctaatgtgtcaagtcgaggtggaaaaaagtttcttcctgtattgaaagaaatcttggacagggatcccttgtctcaactgtgtgaaaatgaaatggatcttatttggactttgcgacaagactgccgagagattttcccacaatcactgccaaaattactgctgtcaatcaagtggaataaacttgaggatgttgctcagcttcaggcgctgcttcagatttggcctaaactgcccccccgggaggccctagagcttctggatttcaactatccagaccagtacgttcgagaatatgctgtaggctgcctgcgacagatgagtgatgaagaactttctcaatatcttttacaactggtgcaagtgttaaaatatgagccttttcttgattgtgccctctctagattcctattagaaagagcacttggtaatcggaggatagggcagtttctattttggcatcttaggtcagaagtgcacattcctgctgtctcagtacaatttggtgtcatccttgaagcatactgccggggaagtgtggggcacatgaaagtgctttctaagcaggttgaagcactcaataagttaaaaactttaaatagtttaatcaaactgaatgccgtgaagttaaacagagccaaagggaaggaggccatgcatacctgtttaaaacagagtgcttaccgggaagccctctctgacctgcagtcacccctgaacccatgtgttatcctctcagaactctatgttgaaaagtgcaaatacatggattccaaaatgaagcctttgtggctggtatacaataacaaggtatttggtgaggattcagttggagtgatttttaaaaatggtgatgtttgttttcccttagatttacgacaggatatgttgacactccaaatgttgcgcttgatggatttactctggaaagaagctggtttggatcttcggatgttgccttatggctgtttagcaacaggagatcgctctggcctcattgaagttgtgagcacctctgaaacaattgctgacattcagctgaacagtagcaatgtggctgctgcagcagccttcaacaaagatgcccttctgaactggcttaaagaatacaactctggggatgacctggaccgagccattgaggaatttacactgtcctgtgctggctactgtgtagcttcttatgtccttgggattggtgacagacatagtgacaacatcatggtcaaaaaaactggccagctcttccacattgactttggacatattcttggaaatttcaaatctaagtttggcattaaaagggagcgagtgccttttattcttacctatgatttcatccatgtcattcaacaaggaaaaacaggaaatacagaaaagtttggccggttccgccagtgttgtgaggatgcatatctgattttacgacggcatgggaatctcttcatcactctctttgcgctgatgttgactgcagggcttcctgaactcacatcagtcaaagatatacagtatcttaaggactctcttgcattagggaagagtgaagaagaagcactcaaacagtttaagcaaaaatttgatgaggcgctcagggaaagctggactactaaagtgaactggatggcccacacagttcggaaagactacagatcttaacgatcagccttcgctcctaatgtatttgttggtttcatttcattttcattttgcacttgcactaaattgaacatgaccctgttagagatgttataaagggaatgaaatcctggaactcagagttaaattaagaacaaggcatcccacagaacctaatctgaacaatccccgatgattccctctgctttttgaatgcttccaagacttatcatgaaaactgtcaatggataatcatttcctgctgactttgcacgccaaggaatgctactagggattgtttccgtttttgtttgttttttctaatatttggtacttcccagaatggtgtaaatacttcttttcaatgttgtgaccaagtattgtcactcagccaacaacttttccacacctgggggttggtggctgttcttactgtccaaatgaagctaaaaagaaaggcatctttcttcccttttaaaattgtgtaaactgcaaattataatataatttgaatttatgattattttccagaagaaatcttgtaaacctgtggatactcattaattcttttgttaatatttatttccatgatagcatcattccagccagacttgctgaaaatctactggtgaggcaaatataatatatataaatatgctacatatatatttataaaatttctagtgggagttctatataaatgtttctttggtattcttcagcctgtgatttaaagttttacaaaaagcagagctttttcctaagttacttttcagttaggtaactgtgtgatccagttcttccagctgcttctataatgaggcacatattaatacagtttttatatggtatctatgaaagagttcacttcatagagaataatacttgagcaaatgtatccaagaaagcaagcaaatgaaaagaaacctatttatggaataaactccagatctgaaattcagtattttagaaaaatgccagctcttcttactgtatttattaaaacttgtaataatgtgatttttttcaaggatattagttcaaattgaaatggtttcacgccacacggaaatctttaagttatttgttgaggtaccatatatttagggtgctaggggcaagtaatgttaatatgtgcaataggaactactggtttgaatgtgtaaatgggtgatctctctgagtcctggcaacatccagcaaaactactgcttattctccaaagaatattgggagctctcaatcctcggtgatatgggaaagagaactgagtatttgccctatgactgagctttctataggaattttattaaagaatgtttaattttgttgtccttcttaatgttctcagtcaaataaatgagtgagctggtttcggctgctcttgg

SEQ ID NO: 3072 - DNA, 3503 bp, Homo sapiens
cctgggagaagaggcagctgaggccgtggcccggagtagtaggagccacaagccaccctgggcaggacgaggccctgagggaggacaactgtcatctgggaagtaacaacgcaggatgccccctggggtggactgccccatggaattctggaccaaggaggagaatcagagcgttgtggttgacttcctgctgcccacaggggtctacctgaacttccctgtgtcccgcaatgccaacctcagcaccatcaagcagctgctgtggcaccgcgcccagtatgagccgctcttccacatgctcagtggccccgaggcctatgtgttcacctgcatcaaccagacagcggagcagcaagagctggaggacgagcaacggcgtctgtgtgacgtgcagcccttcctgcccgtcctgcgcctggtggcccgtgagggcgaccgcgtgaagaagctcatcaactcacagatcagcctcctcatcggcaaaggcctccacgagtttgactccttgtgcgacccagaagtgaacgactttcgcgccaagatgtgccaattctgcgaggaggcggccgcccgccggcagcagctgggctgggaggcctggctgcagtacagtttccccctgcagctggagccctcggctcaaacctgggggcctggtaccctgcggctcccgaaccgggcccttctggtcaacgttaagtttgagggcagcgaggagagcttcaccttccaggtgtccaccaaggacgtgccgctggcgctgatggcctgtgccctgcggaagaaggccacagtgttccggcagccgctggtggagcagccggaagactacacgctgcaggtgaacggcaggcatgagtacctgtatggcagctacccgctctgccagttccaggtccagaaaccgcgtgccaaaccacctcccattcctgcgaagaagccttcctctgtgtccctgtggtccctggagcagccgttccgcatcgagctcatccagggcagcaaagtgaacgccgacgagcggatgaagctggtggtgcaggccgggcttttccacggcaacgagatgctgtgcaagacggtgtccagctcggaggtgagcgtgtgctcggagcccgtgtggaagcagcggctggagttcgacatcaacatctgcgacctgccccgcatggcccgtctctgctttgcgctgtacgccgtgatcgagaaagccaagaaggctcgctccaccaagaagaagtccaagaaggcggactgccccattgcctgggccaacctcatgctgtttgactacaaggaccagcttaagaccggggaacgctgcctctacatgtggccctccgtcccagatgagaagggcgagctgctgaaccccacgggcactgtgcgcagtaaccccaacacggatagcgccgctgccctgctcatctgcctgcccgaggtggccccgcaccccgtgtactaccccgccctggagaagctgccaggagggatgctcttggcatctcgtgagtggaggccagagctgctgtggatgcgcctccatgcagaggacagcgccccctcaaggatgattggggtggcaatgcccggcctgggggtcctgcccgggctggtccaggcccctggggacgctgagtgcagccgtttgttgcagatcttggagctggggcgacacagcgagtgtgtgcatgtcaccgaggaggagcagctgcagctgcgggaaatcctggagcggcgggggtctggggagctgtatgagcacgagaaggacctggtgtggaagctgcggcatgaagtccaggagcacttcccggaggcgctagcccggctgctgctggtcaccaagtggaacaagcatgaggatgtggcccaagatgctctacctgctgtgtcctggccggagctgcccgtcctgagcgccctggagctgctagacttcagcttccccgattgccacgtaggctccttcgccatcaagtcgctgcggaaactgacggacgatgagctgttccagtacctgctgcagctggtgcaggtgctcaagtacgagtcctacctggactgcgagctgaccaaattcctgctggaccgggccctggccaaccgcaagatcggccacttccttttctggcacctccgctccgagatgcacgtgccgtcggtggccctgcgcttcggcctcatcctggaggcctactgcaggggcagcacccaccacatgaaggtgctgatgaagcagggggaagcactgagcaaactgaaggccctgaatgacttcgtcaagctgagctctcagaagacccccaagccccagaccaaggagctgatgcacttgtgcatgcggcaggaggcctacctagaggccctctcccacctgcagtccccactcgaccccagcaccctgctggctgaagtctgcgtggagcagtgcaccttcatggactccaagatgaagcccctgtggatcatgtacagcaacgaggaggcaggcagcggcggcagcgtgggcatcatctttaagaacggggatgacctccggcaggacatgctgaccctgcagatgatccagctcatggacgtcctgtggaagcaggaggggctggacctgaggatgaccccctatggctgcctccccaccggggaccgcacaggcctcattgaggtggtactccgttcagacaccatcgccaacatccaactcaacaagagcaacatggcagccacagccgccttcaacaaggatgccctgctcaactggctgaagtccaagaacccgggggaggccctggatcgagccattgaggagttcaccctctcctgtgctggctattgtgtggccacatatgtgctgggcattggcgatcggcacagcgacaacatcatgatccgagagagtgggcagctgttccacattgattttggccactttctggggaatttcaagaccaagtttggaatcaaccgcgagcgtgtcccattcatcctcacctacgactttgtccatgtgattcagcaggggaagactaataatagtgagaaatttgaacggttccggggctactgtgaaagggcctacaccatcctgcggcgccacgggcttctcttcctccacctctttgccctgatgcgggcggcaggcctgcctgagctcagctgctccaaagacatccagtatctcaaggactccctggcactggggaaaacagaggaggaggcactgaagcacttccgagtgaagtttaacgaagccctccgtgagagctggaaaaccaaagtgaactggctggcccacaacgtgtccaaagacaacaggcagtagtggctcctcccagccctgggcccaagaggaggcggctgcgggtcgtggggaccaagcacattggtcctaaaggggctgaagagcctgaactgcacctaacgggaaagaaccgacatggctgccttttgtttacactggttatttatttatgacttgaaatagtttaaggagctaaacagcc

SEQ ID NO: 3073 - DNA, 3508 bp, Homo sapiens
cctgggagaagaggcagctgaggccgtggcccggagtagtaggagccacaagccaccctgggcaggacgaggccctgagggaggacaactgtcatctgggaagtaacaacgcaggatgccccctggggtggactgccccatggaattctggaccaaggaggagaatcagagcgttgtggttgacttcctgctgcccacaggggtctacctgaacttccctgtgtcccgcaatgccaacctcagcaccatcaagcagctgctgtggcaccgcgcccagtatgagccgctcttccacatgctcagtggccccgaggcctatgtgttcacctgcatcaaccagacagcggagcagcaagagctggaggacgagcaacggcgtctgtgtgacgtgcagcccttcctgcccgtcctgcgcctggtggcccgtgagggcgaccgcgtgaagaagctcatcaactcacagatcagcctcctcatcggcaaaggcctccacgagtttgactccttgtgcgacccagaagtgaacgactttcgcgccaagatgtgccaattctgcgaggaggcggccgcccgccggcagcagctgggctgggaggcctggctgcagtacagtttccccctgcagctggagccctcggctcaaacctgggggcctggtaccctgcggctcccgaaccgggcccttctggtcaacgttaagtttgagggcagcgaggagagcttcaccttccaggtgtccaccaaggacgtgccgctggcgctgatggcctgtgccctgcggaagaaggccacagtgttccggcagccgctggtggagcagccggaagactacacgctgcaggtgaacggcaggcatgagtacctgtatggcagctacccgctctgccagttccaggtccagaaaccgcgtgccaaaccacctcccattcctgcgaagaagccttcctctgtgtccctgtggtccctggagcagccgttccgcatcgagctcatccagggcagcaaagtgaacgccgacgagcggatgaagctggtggtgcaggccgggcttttccacggcaacgagatgctgtgcaagacggtgtccagctcggaggtgagcgtgtgctcggagcccgtgtggaagcagcggctggagttcgacatcaacatctgcgacctgccccgcatggcccgtctctgctttgcgctgtacgccgtgatcgagaaagccaagaaggctcgctccaccaagaagaagtccaagaaggcggactgccccattgcctgggccaacctcatgctgtttgactacaaggaccagcttaagaccggggaacgctgcctctacatgtggccctccgtcccagatgagaagggcgagctgctgaaccccacgggcactgtgcgcagtaaccccaacacggatagcgccgctgccctgctcatctgcctgcccgaggtggccccgcaccccgtgtactaccccgccctggagaagctgccaggagggatgctcttggcatctcgtgagtggaggccagagctgctgtggatgcgcctccatgcagaggacagcgccccctcaaggatgattggggtggcaatgcccggcctgggggtcctgcccgggctggtccaggcccctggggacgctgagtgcagccgtttgttgcagatcttggagctggggcgacacagcgagtgtgtgcatgtcaccgaggaggagcagctgcagctgcgggaaatcctggagcggcgggggtctggggagctgtatgagcacgagaaggacctggtgtggaagctgcggcatgaagtccaggagcacttcccggaggcgctagcccggctgctgctggtcaccaagtggaacaagcatgaggatgtggcccagatgctctacctgctgtgctcctggccggagctgcccgtcctgagcgccctggagctgctagacttcagcttccccgattgccacgtaggctccttcgccatcaagtcgctgcggaaactgacggacgatgagctgttccagtacctgctgcagctggtgcaggtgctcaagtacgagtcctacctggactgcgagctgaccaaattcctgctggaccgggccctggccaaccgcaagatcggccacttccttttctggcacctccgctccgagatgcacgtgccgtcggtggccctgcgcttcggcctcatcctggaggcctactgcaggggcagcacccaccacatgaaggtgctgatgaagcagggggaagcactgagcaaactgaaggccctgaatgacttcgtcaagctgagctctcagaagacccccaagccccagaccaaggagctgatgcacttgtgcatgcggcaggaggcctacctagaggccctctcccacctgcagtccccactcgaccccagcaccctgctggctgaagtctgcgtggagcagtgcaccttcatggactccaagatgaagcccctgtggatcatgtacagcaacgaggaggcaggcagcggcggcagcgtgggcatcatctttaagaacggggatgacctccggcaggacatgctgaccctgcagatgatccagctcatggacgtcctgtggaagcaggaggggctggacctgaggatgaccccctatggctgcctccccaccggggaccgcacaggcctcattgaggtggtactccgttcagacaccatcgccaacatccaactcaacaagagcaacatggcagccacagccgccttcaacaaggatgccctgctcaactggctgaagtccaagaacccgggggaggccctggatcgagccattgaggagttcaccctctcctgtgctggctattgtgtggccacatatgtgctgggcattggcgatcggcacagcgacaacatcatgatccgagagagtgggcagctgttccacattgattttggccactttctggggaatttcaagaccaagtttggaatcaaccgcgagcgtgtcccattcatcctcacctacgactttgtccatgtgattcagcaggggaagactaataatagtgagaaatttgaacggttccggggctactgtgaaagggcctacaccatcctgcggcgccacgggcttctcttcctccacctctttgccctgatgcgggcggcaggcctgcctgagctcagctgctccaaagacatccagtatctcaaggactccctggcactggggaaaacagaggaggaggcactgaagcacttccgagtgaagtttaacgaagccctccgtgagagctggaaaaccaaagtgaactggctggcccacaacgtgtccaaagacaacaggcagtagtggctcctcccagccctgggcccaagaggaggcggctgcgggtcgtggggaccaagcacattggtcctaaaggggctgaagagcctgaactgcacctaacgggaaagaaccgacatggctgccttttgtttacactggttatttatttatgacttgaaatagtttaaggagctaaacagccataaa

SEQ ID NO: 3074 - DNA, 5203 bp, Homo sapiens
cagtcgctccgagcggccgcgagcagagccgcccagccctgccagctgcgccgggacgataaggagtcaggccagggcgggatgacactcattgattctaaagcatctttaatctgccaggcggagggggctttgctggtctttcttggactattccagagaggacaactgtcatctgggaagtaacaacgcaggatgccccctggggtggactgccccatggaattctggaccaaggaggagaatcagagcgttgtggttgacttcctgctgcccacaggggtctacctgaacttccctgtgtcccgcaatgccaacctcagcaccatcaagcagctgctgtggcaccgcgcccagtatgagccgctcttccacatgctcagtggccccgaggcctatgtgttcacctgcatcaaccagacagcggagcagcaagagctggaggacgagcaacggcgtctgtgtgacgtgcagcccttcctgcccgtcctgcgcctggtggcccgtgagggcgaccgcgtgaagaagctcatcaactcacagatcagcctcctcatcggcaaaggcctccacgagtttgactccttgtgcgacccagaagtgaacgactttcgcgccaagatgtgccaattctgcgaggaggcggccgcccgccggcagcagctgggctgggaggcctggctgcagtacagtttccccctgcagctggagccctcggctcaaacctgggggcctggtaccctgcggctcccgaaccgggcccttctggtcaacgttaagtttgagggcagcgaggagagcttcaccttccaggtgtccaccaaggacgtgccgctggcgctgatggcctgtgccctgcggaagaaggccacagtgttccggcagccgctggtggagcagccggaagactacacgctgcaggtgaacggcaggcatgagtacctgtatggcagctacccgctctgccagttccagtacatctgcagctgcctgcacagtgggttgacccctcacctgaccatggtccattcctcctccatcctcgccatgcgggatgagcagagcaaccctgccccccaggtccagaaaccgcgtgccaaaccacctcccattcctgcgaagaagccttcctctgtgtccctgtggtccctggagcagccgttccgcatcgagctcatccagggcagcaaagtgaacgccgacgagcggatgaagctggtggtgcaggccgggcttttccacggcaacgagatgctgtgcaagacggtgtccagctcggaggtgagcgtgtgctcggagcccgtgtggaagcagcggctggagttcgacatcaacatctgcgacctgccccgcatggcccgtctctgctttgcgctgtacgccgtgatcgagaaagccaagaaggctcgctccaccaagaagaagtccaagaaggcggactgccccattgcctgggccaacctcatgctgtttgactacaaggaccagcttaagaccggggaacgctgcctctacatgtggccctccgtcccagatgagaagggcgagctgctgaaccccacgggcactgtgcgcagtaaccccaacacggatagcgccgctgccctgctcatctgcctgcccgaggtggccccgcaccccgtgtactaccccgccctggagaagatcttggagctggggcgacacagcgagtgtgtgcatgtcaccgaggaggagcagctgcagctgcgggaaatcctggagcggcgggggtctggggagctgtatgagcacgagaaggacctggtgtggaagctgcggcatgaagtccaggagcacttcccggaggcgctagcccggctgctgctggtcaccaagtggaacaagcatgaggatgtggcccagatgctctacctgctgtgctcctggccggagctgcccgtcctgagcgccctggagctgctagacttcagcttccccgattgccacgtaggctccttcgccatcaagtcgctgcggaaactgacggacgatgagctgttccagtacctgctgcagctggtgcaggtgctcaagtacgagtcctacctggactgcgagctgaccaaattcctgctggaccgggccctggccaaccgcaagatcggccacttccttttctggcacctccgctccgagatgcacgtgccgtcggtggccctgcgcttcggcctcatcctggaggcctactgcaggggcagcacccaccacatgaaggtgctgatgaagcagggggaagcactgagcaaactgaaggccctgaatgacttcgtcaagctgagctctcagaagacccccaagccccagaccaaggagctgatgcacttgtgcatgcggcaggaggcctacctagaggccctctcccacctgcagtccccactcgaccccagcaccctgctggctgaagtctgcgtggagcagtgcaccttcatggactccaagatgaagcccctgtggatcatgtacagcaacgaggaggcaggcagcggcggcagcgtgggcatcatctttaagaacggggatgacctccggcaggacatgctgaccctgcagatgatccagctcatggacgtcctgtggaagcaggaggggctggacctgaggatgaccccctatggctgcctccccaccggggaccgcacaggcctcattgaggtggtactccgttcagacaccatcgccaacatccaactcaacaagagcaacatggcagccacagccgccttcaacaaggatgccctgctcaactggctgaagtccaagaacccgggggaggccctggatcgagccattgaggagttcaccctctcctgtgctggctattgtgtggccacatatgtgctgggcattggcgatcggcacagcgacaacatcatgatccgagagagtgggcagctgttccacattgattttggccactttctggggaatttcaagaccaagtttggaatcaaccgcgagcgtgtcccattcatcctcacctacgactttgtccatgtgattcagcaggggaagactaataatagtgagaaatttgaacggttccggggctactgtgaaagggcctacaccatcctgcggcgccacgggcttctcttcctccacctctttgccctgatgcgggcggcaggcctgcctgagctcagctgctccaaagacatccagtatctcaaggactccctggcactggggaaaacagaggaggaggcactgaagcacttccgagtgaagtttaacgaagccctccgtgagagctggaaaaccaaagtgaactggctggcccacaacgtgtccaaagacaacaggcagtagtggctcctcccagccctgggcccaagaggaggcggctgcgggtcgtggggaccaagcacattggtcctaaaggggctgaagagcctgaactgcacctaacgggaaagaaccgacatggctgccttttgtttacactggttatttatttatgacttgaaatagtttaaggagctaaacagccataaacggaaacgcctccttcatgcagcggcggtgctgggccccccgaggctgcacctggctctcggctgaggattgtcaccccaagtcttccagctggtggatctgggcccagcaaagactgttctcctcccgagggaaccttcttcccaggcctcccgccagactgcctgggtcctggcgcctggcggtcacctggtgcctactgtccgacaggatgccttgatcctcgtgcgacccaccctgtgtatcctccctagactgagttctggcagctccccgaggcagccggggtaccctctagattcagggatgcttgctctccacttttcaagtgggtcttgggtacgagaattccctcatctttctctactgtaaagtgattttgtttgcaggtaagaaaataatagatgactcaccacacctctacggctggggagatcaggcccagccccataaaggagaatctacgctggtcctcaggacgtgttaaagagatctgggcctcatgtagctcaccccggtcacgcatgaaggcaaaagcaggtcagaagcgaatactctgccattatctcaaaaatcttttttttttttttgagatggggtcttcctctgttgcccaggctggagtgcagtggtgcaatcttggctcactgtaacctccgcctcccaggttcaagtgattcttctgcctcagcctcctgagtagctgggattacaggtgtgcaccaccgtacccagctaatttttgtattttagtagagacgggggtttcaccatgttggctgggctggtctcgaactcctgacctcaggtgatccacccgcctgagcctcccaaagtgctgggattacaggcatgagccaccgcgcccggcccactctgccattgtctaagccacctctgaaagcaggttttaacaaaaggatgaggccagaactcttccagaaccatcacctttgggaacctgctgtgagagtgctgaggtaccagaagtgtgagaacgagggggcgtgctgggatctttctctctgactatacttagtttgaaatggtgcaggcttagtcttaagcctccaaaggcctggatttgagcagctttagaaatgcaggttctagggcttctcccagccttcagaagccaactaactctgcagatggggctaggactgtgggcttttagcagcccacaggtgatcctaacatatcaggccatggactcaggacctgcccggtgatgctgttgatttctcaaaggtcttccaaaactcaacagagccagaagtagccgcccgctcagcggctcaggtgccagctctgttctgattcaccaggggtccgtcagtagtcattgccacccgcggggcacctccctggccacacgcctgttcccagcaagtgctgaaactcactagaccgtctgcctgtttcgaaatggggaaagccgtgcgtgcgcgttatttatttaagtgcgcctgtgtgcgcgggtgtgggagcacactttgcaaagccacagcgtttctggttttgggtgtacagtcttgtgtgcctggcgagaagaatattttctatttttttaagtcatttcatgtttctgtctggggaaggcaagttagttaagtatcactgatgtgggttgagaccagcactctgtgaaaccttgaaatgagaagtaaaggcagatgaaaagaaa

SEQ ID NO: 3075 - DNA, 5483 bp, Homo sapiens
ctcgcgcccagcgcagtcgctccgagcggccgcgagcagagccgcccagccctgccagctgcgccgggacgataaggagtcaggccagggcgggatgacactcattgattctaaagcatctttaatctgccaggcggagggggctttgctggtctttcttggactattccagagaggacaactgtcatctgggaagtaacaacgcaggatgccccctggggtggactgccccatggaattctggaccaaggaggagaatcagagcgttgtggttgacttcctgctgcccacaggggtctacctgaacttccctgtgtcccgcaatgccaacctcagcaccatcaagcagctgctgtggcaccgcgcccagtatgagccgctcttccacatgctcagtggccccgaggcctatgtgttcacctgcatcaaccagacagcggagcagcaagagctggaggacgagcaacggcgtctgtgtgacgtgcagcccttcctgcccgtcctgcgcctggtggcccgtgagggcgaccgcgtgaagaagctcatcaactcacagatcagcctcctcatcggcaaaggcctccacgagtttgactccttgtgcgacccagaagtgaacgactttcgcgccaagatgtgccaattctgcgaggaggcggccgcccgccggcagcagctgggctgggaggcctggctgcagtacagtttccccctgcagctggagccctcggctcaaacctgggggcctggtaccctgcggctcccgaaccgggcccttctggtcaacgttaagtttgagggcagcgaggagagcttcaccttccaggtgtccaccaaggacgtgccgctggcgctgatggcctgtgccctgcggaagaaggccacagtgttccggcagccgctggtggagcagccggaagactacacgctgcaggtgaacggcaggcatgagtacctgtatggcagctacccgctctgccagttccaggtccagaaaccgcgtgccaaaccacctcccattcctgcgaagaagccttcctctgtgtccctgtggtccctggagcagccgttccgcatcgagctcatccagggcagcaaagtgaacgccgacgagcggatgaagctggtggtgcaggccgggcttttccacggcaacgagatgctgtgcaagacggtgtccagctcggaggtgagcgtgtgctcggagcccgtgtggaagcagcggctggagttcgacatcaacatctgcgacctgccccgcatggcccgtctctgctttgcgctgtacgccgtgatcgagaaagccaagaaggctcgctccaccaagaagaagtccaagaaggcggactgccccattgcctgggccaacctcatgctgtttgactacaaggaccagcttaagaccggggaacgctgcctctacatgtggccctccgtcccagatgagaagggcgagctgctgaaccccacgggcactgtgcgcagtaaccccaacacggatagcgccgctgccctgctcatctgcctgcccgaggtggccccgcaccccgtgtactaccccgccctggagaagctgccaggagggatgctcttggcatctcgtgagtggaggccagagctgctgtggatgcgcctccatgcagaggacagcgccccctcaaggatgattggggtggcaatgcccggcctgggggtcctgcccgggctggtccaggcccctggggacgctgagtgcagccgtttgttgcagatcttggagctggggcgacacagcgagtgtgtgcatgtcaccgaggaggagcagctgcagctgcgggaaatcctggagcggcgggggtctggggagctgtatgagcacgagaaggacctggtgtggaagctgcggcatgaagtccaggagcacttcccggaggcgctagcccggctgctgctggtcaccaagtggaacaagcatgaggatgtggcccagatgctctacctgctgtgctcctggccggagctgcccgtcctgagcgccctggagctgctagacttcagcttccccgattgccacgtaggctccttcgccatcaagtcgctgcggaaactgacggacgatgagctgttccagtacctgctgcagctggtgcaggtgctcaagtacgagtcctacctggactgcgagctgaccaaattcctgctggaccgggccctggccaaccgcaagatcggccacttccttttctggcacctccgctccgagatgcacgtgccgtcggtggccctgcgcttcggcctcatcctggaggcctactgcaggggcagcacccaccacatgaaggtgctgatgaagcagggggaagcactgagcaaactgaaggccctgaatgacttcgtcaagctgagctctcagaagacccccaagccccagaccaaggagctgatgcacttgtgcatgcggcaggaggcctacctagaggccctctcccacctgcagtccccactcgaccccagcaccctgctggctgaagtctgcgtggagcagtgcaccttcatggactccaagatgaagcccctgtggatcatgtacagcaacgaggaggcaggcagcggcggcagcgtgggcatcatctttaagaacggggatgacctccggcaggacatgctgaccctgcagatgatccagctcatggacgtcctgtggaagcaggaggggctggacctgaggatgaccccctatggctgcctccccaccggggaccgcacaggcctcattgaggtggtactccgttcagacaccatcgccaacatccaactcaacaagagcaacatggcagccacagccgccttcaacaaggatgccctgctcaactggctgaagtccaagaacccgggggaggccctggatcgagccattgaggagttcaccctctcctgtgctggctattgtgtggccacatatgtgctgggcattggcgatcggcacagcgacaacatcatgatccgagagagtgggcagctgttccacattgattttggccactttctggggaatttcaagaccaagtttggaatcaaccgcgagcgtgtcccattcatcctcacctacgactttgtccatgtgattcagcaggggaagactaataatagtgagaaatttgaacggttccggggctactgtgaaagggcctacaccatcctgcggcgccacgggcttctcttcctccacctctttgccctgatgcgggcggcaggcctgcctgagctcagctgctccaaagacatccagtatctcaaggactccctggcactggggaaaacagaggaggaggcactgaagcacttccgagtgaagtttaacgaagccctccgtgagagctggaaaaccaaagtgaactggctggcccacaacgtgtccaaagacaacaggcagtagtggctcctcccagccctgggcccaagaggaggcggctgcgggtcgtggggaccaagcacattggtcctaaaggggctgaagagcctgaactgcacctaacgggaaagaaccgacatggctgccttttgtttacactggttatttatttatgacttgaaatagtttaaggagctaaacagccataaacggaaacgcctccttcatgcagcggcggtgctgggccccccgaggctgcacctggctctcggctgaggattgtcaccccaagtcttccagctggtggatctgggcccagcaaagactgttctcctcccgagggaaccttcttcccaggcctcccgccagactgcctgggtcctggcgcctggcggtcacctggtgcctactgtccgacaggatgccttgatcctcgtgcgacccaccctgtgtatcctccctagactgagttctggcagctccccgaggcagccggggtaccctctagattcagggatgcttgctctccacttttcaagtgggtcttgggtacgagaattccctcatctttctctactgtaaagtgattttgtttgcaggtaagaaaataatagatgactcaccacacctctacggctggggagatcaggcccagccccataaaggagaatctacgctggtcctcaggacgtgttaaagagatctgggcctcatgtagctcaccccggtcacgcatgaaggcaaaagcaggtcagaagcgaatactctgccattatctcaaaaatcttttttttttttttgagatggggtcttcctctgttgcccaggctggagtgcagtggtgcaatcttggctcactgtaacctccgcctcccaggttcaagtgattcttctgcctcagcctcctgagtagctgggattacaggtgtgcaccaccgtacccagctaatttttgtattttagtagagacgggggtttcaccatgttggctgggctggtctcgaactcctgacctcaggtgatccacccgcctgagcctcccaaagtgctgggattacaggcatgagccaccgcgcccggcccactctgccattgtctaagccacctctgaaagcaggttttaacaaaaggatgaggccagaactcttccagaaccatcacctttgggaacctgctgtgagagtgctgaggtaccagaagtgtgagaacgagggggcgtgctgggatctttctctctgactatacttagtttgaaatggtgcaggcttagtcttaagcctccaaaggcctggatttgagcagctttagaaatgcaggttctagggcttctcccagccttcagaagccaactaactctgcagatggggctaggactgtgggcttttagcagcccacaggtgatcctaacatatcaggccatggactcaggacctgcccggtgatgctgttgatttctcaaaggtcttccaaaactcaacagagccagaagtagccgcccgctcagcggctcaggtgccagctctgttctgattcaccaggggtccgtcagtagtcattgccacccgcggggcacctccctggccacacgcctgttcccagcaagtgctgaaactcactagaccgtctgcctgtttcgaaatggggaaagccgtgcgtgcgcgttatttatttaagtgcgcctgtgtgcgcgggtgtgggagcacactttgcaaagccacagcgtttctggttttgggtgtacagtcttgtgtgcctggcgagaagaatattttctatttttttaagtcatttcatgtttctgtctggggaaggcaagttagttaagtatcactgatgtgggttgagaccagcactctgtgaaaccttgaaatgagaagtaaaggcagatgaaaagaaagaaaaagcctttttatgttcttttatgttctcggctcaaaaagaaacaagggagtgtaggtttaaaaccaaaacaggagagaagacaaaccccgctccggctggagttagttagaaccagaactttattgtagcggatacactttctgacctatcatgagtatacacatctgcgaagggaaaccgcgcggcgaca

SEQ ID NO: 3076 - DNA, 1458 bp, Homo sapiens
tcttaacactttcacacgctccatcgcaacagcctgcagtcatgggctttattgtcctgtttgctggacatgatacctgagtcctcagagctggtggtgcaggccgggcttttccacggcaacgagatgctgtgcaagacggtgtccagctcggaggtgagcgtgtgctcggagcccgtgtggaagcagcggctggagttcgacatcaacatctgcgacctgccccgcatggcccgtctctgctttgcgctgtacgccgtgatcgagaaagccaagaaggctcgctccaccaagaagaagtccaagaaggcggactgccccattgcctgggccaacctcatgctgtttgactacaaggaccagcttaagaccggggaacgctgcctctacatgtggccctccgtcccagatgagaagggcgagctgctgaaccccacgggcactgtgcgcagtaaccccaacacggatagcgccgctgccctgctcatctgcctgcccgaggtggccccgcaccccgtgtactaccccgccctggagaagatcttggagctggggcgacacagcgagtgtgtgcatgtcaccgaggaggagcagctgcagctgcgggaaatcctggagcggcgggggtctggggagctgtatgagcacgagaaggacctggtgtggaagctgcggcatgaagtccaggagcacttcccggaggcgctagcccggctgctgctggtcaccaagtggaacaagcatgaggatgtggcccagatgctctacctgctgtgctcctggccggagctgcccgtcctgagcgccctggagctgctagacttcagcttccccgattgccacgtaggctccttcgccatcaagtcgctgcggaaactgacggacgatgagctgttccagtacctgctgcagctggtgcaggtgctcaagtacgagtcctacctggactgcgagctgaccaaattcctgctggaccgggccctggccaaccgcaagatcggccacttccttttctggcacctccggtagcgggacttgccccagccgttctgtgggaatcccagcccctgagtctccctggaaggccactggggacgtttccagcaggcctgggtgtcctggcctcgctaggtcctgctgggcgggaggggctgcgtggtgctgcctggtgaggctcagccctcccttcaccttccagctccgagatgcacgtgccgtcggtggccctgcgcttcggcctcatcctggaggcctactgcaggggcagcacccaccacatgaaggtgctgatgaagcagggggaagcactgagcaaactgaaggccctgaatgacttcgtcaagctgagctctcagaagacccccaagccccagaccaaggagctgatgcacttgtgcatgcggcaggaggcctacctagaggccctctcccacctgcagtccccactcgaccccagca

SEQ ID NO: 3077 - DNA, 5377 bp, Homo sapiens
gcacttccttctcggctagattatctgaaactgttgtcggttcttgagatgatactaccaccgaatgtctgtgtttcattgtctagtccaacctgtattgtggatatctacaacgttccggcaatagttttgcaggtgcatcacatttttgtttttgttttgggaggaaaagggagggcacggcagccaggcttcatattcctacaagtgcatgcttcaagattactgtacttacagtgtttccaacatcttctcataaaaggggaaagcttcatagcctcaaccatgaaggaaaccagtcgcatagggcatggagctggagaactataaacagcccgtggtgctgagagaggacaactgccgaaggcgccggaggatgaagccgcgcagtgctgcggccagcctgtcctccatggagctcatccccatcgagttcgtgctgcccaccagccagcgcaaatgcaagagccccgaaacggcgctgctgcacgtggccggccacggcaacgtggagcagatgaaggcccaggtgtggctgcgagcgctggagaccagcgtggcggcggacttctaccaccggctgggaccgcatcacttcctcctgctctatcagaagaaggggcagtggtacgagatctacgacaagtaccaggtggtgcagactctggactgcctgcgctactggaaggccacgcaccggagcccgggccagatccacctggtgcagcggcacccgccctccgaggagtcccaagccttccagcggcagctcacggcgctgattggctatgacgtcactgacgtcagcaacgtgcacgacgatgagctggagttcacgcgccgtggcttggtgaccccgcgcatggcggaggtggccagccgcgaccccaagctctacgccatgcacccgtgggtgacgtccaagcccctcccggagtacctgtggaagaagattgccaacaactgcatcttcatcgtcattcaccgcagcaccaccagccagaccattaaggtctcacccgacgacacccccggcgccatcctgcagagcttcttcaccaagatggccaagaagaaatctctgatggatattcccgaaagccaaagcgaacaggattttgtgctgcgcgtctgtggccgggatgagtacctggtgggcgaaacgcccatcaaaaacttccagtgggtgaggcactgcctcaagaacggagaagagattcacgtggtactggacacgcctccagacccggccctagacgaggtgaggaaggaagagtggccactggtggatgactgcacgggagtcaccggctaccatgagcagcttaccatccacggcaaggaccacgagagtgtgttcaccgtgtccctgtgggactgcgaccgcaagttcagggtcaagatcagaggcattgatatccccgtcctgcctcggaacaccgacctcacagtttttgtagaggcaaacatccagcatgggcaacaagtcctttgccaaaggagaaccagccccaaacccttcacagaggaggtgctgtggaatgtgtggcttgagttcagtatcaaaatcaaagacttgcccaaaggggctctactgaacctccagatctactgcggtaaagctccagcactgtccagcaaggcctctgcagagtcccccagttctgagtccaagggcaaagttcagcttctctattatgtgaacctgctgctgatagaccaccgtttcctcctgcgccgtggagaatacgtcctccacatgtggcagatatctgggaagggagaagaccaaggaagcttcaatgctgacaaactcacgtctgcaactaacccagacaaggagaactcaatgtccatctccattcttctggacaattactgccacccgatagccctgcctaagcatcagcccacccctgacccggaaggggaccgggttcgagcagaaatgcccaaccagcttcgcaagcaattggaggcgatcatagccactgatccacttaaccctctcacagcagaggacaaagaattgctctggcattttagatacgaaagccttaagcacccaaaagcatatcctaagctatttagttcagtgaaatggggacagcaagaaattgtggccaaaacataccaattgttggccagaagggaagtctgggatcaaagtgctttggatgttgggttaacaatgcagctcctggactgcaacttctcagatgaaaatgtaagagccattgcagttcagaaactggagagcttggaggacgatgatgttctgcattaccttctacaattggtccaggctgtgaaatttgaaccataccatgatagcgcccttgccagatttctgctgaagcgtggtttaagaaacaaaagaattggtcactttttgttttggttcttgagaagtgagatagcccagtccagacactatcagcagaggttcgctgtgattctggaagcctatctgaggggctgtggcacagccatgctgcacgactttacccaacaagtccaagtaatcgagatgttacaaaaagtcacccttgatattaaatcgctctctgctgaaaagtatgacgtcagttcccaagttatttcacaacttaaacaaaagcttgaaaacctgcagaattctcaactccccgaaagctttagagttccatatgatcctggactgaaagcaggagcgctggcaattgaaaaatgtaaagtaatggcctccaagaaaaaaccactatggcttgagtttaaatgtgccgatcctacagccctatcaaatgaaacaattggaattatctttaaacatggtgatgatctgcgccaagacatgcttattttacagattctacgaatcatggagtctatttgggagactgaatctttggatctatgcctcctgccatatggttgcatttcaactggtgacaaaataggaatgatcgagattgtgaaagacgccacgacaattgccaaaattcagcaaagcacagtgggcaacacgggagcatttaaagatgaagtcctgaatcactggctcaaagaaaaatcccctactgaagaaaagtttcaggcagcagtggagagatttgtttattcctgtgcaggctactgtgtggcaacctttgttcttggaataggcgacagacacaatgacaatattatgatcaccgagacaggaaacctatttcatattgacttcgggcacattcttgggaattacaaaagtttcctgggcattaataaagagagagtgccatttgtgctaacccctgacttcctctttgtgatgggaacttctggaaagaagacaagcccacacttccagaaatttcaggacatctgtgttaaggcttatctagcccttcgtcatcacacaaacctactgatcatcctgttctccatgatgctgatgacaggaatgccccagttaacaagcaaagaagacattgaatatatccgggatgccctcacagtggggaaaaatgaggaggatgctaaaaagtattttcttgatcagatcgaagtttgcagagacaaaggatggactgtgcagtttaattggtttctacatcttgttcttggcatcaaacaaggagagaaacattcagcctaatactttaggctagaatcaaaaacaagttagtgttctatggtttaaattagcatagcaatcatcgaacttggatttcaaatgcaatagacattgtgaaagctggcatttcagaagtatagctcttttcctacctgaactcttccctggagaaaagatgttggcattgctgattgtttggttaagcaatgtccagtgctaggattatttgcaggtttggttttttctcatttgtctgtggcattggagaatattctcggtttaaacagactaatgacttccttattgtccctgatattttgactatcttactattgagtgcttctggaaattctttggaataattgatgacatctattttcatctgggtttagtctcaattttggttatctttgtgttcctcaagctctttaaagaaaaagatgtaatcgttgtaacctttgtctcattccttaaatgatgcttccaaacatctccttagtgtctgcaggtgttagtggtgtgctaaaagcaaggaaagcgagttagtcttttcagtgtcttttgcaattcaattcttttgtcatgtataactgagacacacaaacacagcaggagaaatctaaaccgttgtgccttgaccttcctctgctggtcttgttccagggttatgaatatgaaaaaatagagatgagactttttgtgtcaactctgtccacaagagtgagttatctagtatgattagtatagctttctccagcatggcagcaggaagtaactacagggcctcttttatgcctgacatttcttcccttcctttttccctgcctccctttttcatcaattgcgatgctcccacaactctttacagacttgtgaaatcttcaagaacacctttactctataactcaaaaattagttgaaaaataattacttctcaaggattattagaatcttaggtacttatttgtaaagatgtttagtgacttttttttcaagtatcttattaaaggaggcattctagaaaatatgaattagtttccaaatgccttaattttaaactttggcctgaacagttttttctttttcttaatggaagaagatatttaatatcttaaaaatattccaagttaggaagaacactacttgccttatccatttcccatttaaaggacttttaaactttgacacatccttcagatttcctgaaaataattgaaatatcttactttaaaaatattttcatctctgaaatatctcgttatttattggaggtattgtttaaccttagagagaccattaaattatttataaaatattttgtaattacctgtagctaatacattacatagaaaaaaactatgttaacagtgtctctgtttaagtataatcagatataaatatatacttaattttttaattttaaaaatagatacctgtttgactttgaggtagtccagaccttttctttttttttttttttttaatgtgtgcaaaagcccaaaggttcctaagcctggctgcaaagaagaatcaacagggacactttttaaaaacactcttatcagcctgggcaacacagtgagactccatctcttaaaaaaaaaattagctgggtatagtggtatgtgcctgtagtcccaggtactcaggaggctgaggcaggaggattgcctgagcccaggaggtggaaactgcagagagtcatgatcatgtccttacactccagcctggataacagagcgagaccctgtctcaaaaaaataaaataaaaaataaaaa

SEQ ID NO: 3078 - DNA, 3828 bp, Homo sapiens
aactgcaacacttcctctgcatctggatatgaagggagccccagaaaagcggaagaatttagacgcacactgggtcgcatagggcatggagctggagaactataaacagcccgtggtgctgagagaggacaactgccgaaggcgccggaggatgaagccgcgcagtgctgcggccagcctgtcctccatggagctcatccccatcgagttcgtgctgcccaccagccagcgcaaatgcaagagccccgaaacggcgctgctgcacgtggccggccacggcaacgtggagcagatgaaggcccaggtgtggctgcgagcgctggagaccagcgtggcggcggacttctaccaccggctgggaccgcatcacttcctcctgctctatcagaagaaggggcagtggtacgagatctacgacaagtaccaggtggtgcagactctggactgcctgcgctactggaaggccacgcaccggagcccgggccagatccacctggtgcagcggcacccgccctccgaggagtcccaagccttccagcggcagctcacggcgctgattggctatgacgtcactgacgtcagcaacgtgcacgacgatgagctggagttcacgcgccgtggcttggtgaccccgcgcatggcggaggtggccagccgcgaccccaagctctacgccatgcacccgtgggtgacgtccaagcccctcccggagtacctgtggaagaagattgccaacaactgcatcttcatcgtcattcaccgcagcaccaccagccagaccattaaggtctcacccgacgacacccccggcgccatcctgcagagcttcttcaccaagatggccaagaagaaatctctgatggatattcccgaaagccaaagcgaacaggattttgtgctgcgcgtctgtggccgggatgagtacctggtgggcgaaacgcccatcaaaaacttccagtgggtgaggcactgcctcaagaacggagaagagattcacgtggtactggacacgcctccagacccggccctagacgaggtgaggaaggaagagtggccactggtggatgactgcacgggagtcaccggctaccatgagcagcttaccatccacggcaaggaccacgagagtgtgttcaccgtgtccctgtgggactgcgaccgcaagttcagggtcaagatcagaggcattgatatccccgtcctgcctcggaacaccgacctcacagtttttgtagaggcaaacatccagcatgggcaacaagtcctttgccaaaggagaaccagccccaaacccttcacagaggaggtgctgtggaatgtgtggcttgagttcagtatcaaaatcaaagacttgcccaaaggggctctactgaacctccagatctactgcggtaaagctccagcactgtccagcaaggcctctgcagagtcccccagttctgagtccaagggcaaagttcagcttctctattatgtgaacctgctgctgatagaccaccgtttcctcctgcgccgtggagaatacgtcctccacatgtggcagatatctgggaagggagaagaccaaggaagcttcaatgctgacaaactcacgtctgcaactaacccagacaaggagaactcaatgtccatctccattcttctggacaattactgccacccgatagccctgcctaagcatcagcccacccctgacccggaaggggaccgggttcgagcagaaatgcccaaccagcttcgcaagcaattggaggcgatcatagccactgatccacttaaccctctcacagcagaggacaaagaattgctctggcattttagatacgaaagccttaagcacccaaaagcatatcctaagctatttagttcagtgaaatggggacagcaagaaattgtggccaaaacataccaattgttggccagaagggaagtctgggatcaaagtgctttggatgttgggttaacaatgcagctcctggactgcaacttctcagatgaaaatgtaagagccattgcagttcagaaactggagagcttggaggacgatgatgttctgcattaccttctacaattggtccaggctgtgaaatttgaaccataccatgatagcgcccttgccagatttctgctgaagcgtggtttaagaaacaaaagaattggtcactttttgttttggttcttgagaagtgagatagcccagtccagacactatcagcagaggttcgctgtgattctggaagcctatctgaggggctgtggcacagccatgctgcacgactttacccaacaagtccaagtaatcgagatgttacaaaaagtcacccttgatattaaatcgctctctgctgaaaagtatgacgtcagttcccaagttatttcacaacttaaacaaaagcttgaaaacctgcagaattctcaactccccgaaagctttagagttccatatgatcctggactgaaagcaggagcgctggcaattgaaaaatgtaaagtaatggcctccaagaaaaaaccactatggcttgagtttaaatgtgccgatcctacagccctatcaaatgaaacaattggaattatctttaaacatggtgatgatctgcgccaagacatgcttattttacagattctacgaatcatggagtctatttgggagactgaatctttggatctatgcctcctgccatatggttgcatttcaactggtgacaaaataggaatgatcgagattgtgaaagacgccacgacaattgccaaaattcagcaaagcacagtgggcaacacgggagcatttaaagatgaagtcctgaatcactggctcaaagaaaaatcccctactgaagaaaagtttcaggcagcagtggagagatttgtttattcctgtgcaggctactgtgtggcaacctttgttcttggaataggcgacagacacaatgacaatattatgatcaccgagacaggaaacctatttcatattgacttcgggcacattcttgggaattacaaaagtttcctgggcattaataaagagagagtgccatttgtgctaacccctgacttcctctttgtgatgggaacttctggaaagaagacaagcccacacttccagaaatttcaggacatctgtgttaaggcttatctagcccttcgtcatcacacaaacctactgatcatcctgttctccatgatgctgatgacaggaatgccccagttaacaagcaaagaagacattgaatatatccgggatgccctcacagtggggaaaaatgaggaggatgctaaaaagtattttcttgatcagatcgaagtttgcagagacaaaggatggactgtgcagtttaattggtttctacatcttgttcttggcatcaaacaaggagagaaacattcagcctaatactttaggctagaatcaaaaacaagttagtgttctatggtttaaattagcatagcaatcatcgaacttggatttcaaatgcaatagacattgtgaaagctggcatttcagaagtatagctcttttcctacctgaactcttccctggagaaaagatgttggcattgctgattgtttggttaagcaatgtccagtgctaggattatttgcaggtttggttttttctcatttgtctgtggcattggagaatattctcggtttaaacagactaatgacttccttattgtccctgatattttgactatcttactattgagtgcttctggaaattctttggaataattgatgacatctattttcatctgggtttagtctcaattttggttatctttgtgttcctcaagctctttaaagaaaaagatgtaatcgttgtaa

SEQ ID NO: 3079 - DNA, 5197 bp, Homo sapiens
gcatctggatatgaagggagccccagaaaagcggaagaatttagacgcacactgggtaggtttgaatttgttttgttttcaaaaattaaacaaatgatccttcagcatcatcgcctccgctgctttatcaggtcgcatagggcatggagctggagaactataaacagcccgtggtgctgagagaggacaactgccgaaggcgccggaggatgaagccgcgcagtgctgcggccagcctgtcctccatggagctcatccccatcgagttcgtgctgcccaccagccagcgcaaatgcaagagccccgaaacggcgctgctgcacgtggccggccacggcaacgtggagcagatgaaggcccaggtgtggctgcgagcgctggagaccagcgtggcggcggacttctaccaccggctgggaccgcatcacttcctcctgctctatcagaagaaggggcagtggtacgagatctacgacaagtaccaggtggtgcagactctggactgcctgcgctactggaaggccacgcaccggagcccgggccagatccacctggtgcagcggcacccgccctccgaggagtcccaagccttccagcggcagctcacggcgctgattggctatgacgtcactgacgtcagcaacgtgcacgacgatgagctggagttcacgcgccgtggcttggtgaccccgcgcatggcggaggtggccagccgcgaccccaagctctacgccatgcacccgtgggtgacgtccaagcccctcccggagtacctgtggaagaagattgccaacaactgcatcttcatcgtcattcaccgcagcaccaccagccagaccattaaggtctcacccgacgacacccccggcgccatcctgcagagcttcttcaccaagatggccaagaagaaatctctgatggatattcccgaaagccaaagcgaacaggattttgtgctgcgcgtctgtggccgggatgagtacctggtgggcgaaacgcccatcaaaaacttccagtgggtgaggcactgcctcaagaacggagaagagattcacgtggtactggacacgcctccagacccggccctagacgaggtgaggaaggaagagtggccactggtggatgactgcacgggagtcaccggctaccatgagcagcttaccatccacggcaaggaccacgagagtgtgttcaccgtgtccctgtgggactgcgaccgcaagttcagggtcaagatcagaggcattgatatccccgtcctgcctcggaacaccgacctcacagtttttgtagaggcaaacatccagcatgggcaacaagtcctttgccaaaggagaaccagccccaaacccttcacagaggaggtgctgtggaatgtgtggcttgagttcagtatcaaaatcaaagacttgcccaaaggggctctactgaacctccagatctactgcggtaaagctccagcactgtccagcaaggcctctgcagagtcccccagttctgagtccaagggcaaagttcagcttctctattatgtgaacctgctgctgatagaccaccgtttcctcctgcgccgtggagaatacgtcctccacatgtggcagatatctgggaagggagaagaccaaggaagcttcaatgctgacaaactcacgtctgcaactaacccagacaaggagaactcaatgtccatctccattcttctggacaattactgccacccgatagccctgcctaagcatcagcccacccctgacccggaaggggaccgggttcgagcagaaatgcccaaccagcttcgcaagcaattggaggcgatcatagccactgatccacttaaccctctcacagcagaggacaaagaattgctctggcattttagatacgaaagccttaagcacccaaaagcatatcctaagctatttagttcagtgaaatggggacagcaagaaattgtggccaaaacataccaattgttggccagaagggaagtctgggatcaaagtgctttggatgttgggttaacaatgcagctcctggactgcaacttctcagatgaaaatgtaagagccattgcagttcagaaactggagagcttggaggacgatgatgttctgcattaccttctacaattggtccaggctgtgaaatttgaaccataccatgatagcgcccttgccagatttctgctgaagcgtggtttaagaaacaaaagaattggtcactttttgttttggttcttgagaagtgagatagcccagtccagacactatcagcagaggttcgctgtgattctggaagcctatctgaggggctgtggcacagccatgctgcacgactttacccaacaagtccaagtaatcgagatgttacaaaaagtcacccttgatattaaatcgctctctgctgaaaagtatgacgtcagttcccaagttatttcacaacttaaacaaaagcttgaaaacctgcagaattctcaactccccgaaagctttagagttccatatgatcctggactgaaagcaggagcgctggcaattgaaaaatgtaaagtaatggcctccaagaaaaaaccactatggcttgagtttaaatgtgccgatcctacagccctatcaaatgaaacaattggaattatctttaaacatggtgatgatctgcgccaagacatgcttattttacagattctacgaatcatggagtctatttgggagactgaatctttggatctatgcctcctgccatatggttgcatttcaactggtgacaaaataggaatgatcgagattgtgaaagacgccacgacaattgccaaaattcagcaaagcacagtgggcaacacgggagcatttaaagatgaagtcctgaatcactggctcaaagaaaaatcccctactgaagaaaagtttcaggcagcagtggagagatttgtttattcctgtgcaggctactgtgtggcaacctttgttcttggaataggcgacagacacaatgacaatattatgatcaccgagacaggaaacctatttcatattgacttcgggcacattcttgggaattacaaaagtttcctgggcattaataaagagagagtgccatttgtgctaacccctgacttcctctttgtgatgggaacttctggaaagaagacaagcccacacttccagaaatttcaggacatctgtgttaaggcttatctagcccttcgtcatcacacaaacctactgatcatcctgttctccatgatgctgatgacaggaatgccccagttaacaagcaaagaagacattgaatatatccgggatgccctcacagtggggaaaaatgaggaggatgctaaaaagtattttcttgatcagatcgaagtttgcagagacaaaggatggactgtgcagtttaattggtttctacatcttgttcttggcatcaaacaaggagagaaacattcagcctaatactttaggctagaatcaaaaacaagttagtgttctatggtttaaattagcatagcaatcatcgaacttggatttcaaatgcaatagacattgtgaaagctggcatttcagaagtatagctcttttcctacctgaactcttccctggagaaaagatgttggcattgctgattgtttggttaagcaatgtccagtgctaggattatttgcaggtttggttttttctcatttgtctgtggcattggagaatattctcggtttaaacagactaatgacttccttattgtccctgatattttgactatcttactattgagtgcttctggaaattctttggaataattgatgacatctattttcatctgggtttagtctcaattttggttatctttgtgttcctcaagctctttaaagaaaaagatgtaatcgttgtaacctttgtctcattccttaaatgatgcttccaaacatctccttagtgtctgcaggtgttagtggtgtgctaaaagcaaggaaagcgagttagtcttttcagtgtcttttgcaattcaattcttttgtcatgtataactgagacacacaaacacagcaggagaaatctaaaccgttgtgccttgaccttcctctgctggtcttgttccagggttatgaatatgaaaaaatagagatgagactttttgtgtcaactctgtccacaagagtgagttatctagtatgattagtatagctttctccagcatggcagcaggaagtaactacagggcctcttttatgcctgacatttcttcccttcctttttccctgcctccctttttcatcaattgcgatgctcccacaactctttacagacttgtgaaatcttcaagaacacctttactctataactcaaaaattagttgaaaaataattacttctcaaggattattagaatcttaggtacttatttgtaaagatgtttagtgacttttttttcaagtatcttattaaaggaggcattctagaaaatatgaattagtttccaaatgccttaattttaaactttggcctgaacagttttttctttttcttaatggaagaagatatttaatatcttaaaaatattccaagttaggaagaacactacttgccttatccatttcccatttaaaggacttttaaactttgacacatccttcagatttcctgaaaataattgaaatatcttactttaaaaatattttcatctctgaaatatctcgttatttattggaggtattgtttaaccttagagagaccattaaattatttataaaatattttgtaattacctgtagctaatacattacatagaaaaaaactatgttaacagtgtctctgtttaagtataatcagatataaatatatacttaattttttaattttaaaaatagatacctgtttgactttgaggtagtccagaccttttctttttttttttttttttaatgtgtgcaaaagcccaaaggttcctaagcctggctgcaaagaagaatcaacagggacactttttaaaaacactcttatcagcctgggcaacacagtgagactccatctcttaaaaaaaaaattagctgggtatagtggtatgtgcctgtagtcccaggtactcaggaggctgaggcaggaggattgcctgagcccaggaggtggaaactgcagagagtcatgatcatgtccttacactccagcctggataacagagcgagaccctgtctcaaaaaaataaaa

SEQ ID NO: 3080 - DNA, 8227 bp, Homo sapiens
atggctcagatatctagcaacagcggatttaaagaatgtccatcttcacatccggaaccaacaagagcaaaagatgtggacaaagaagaagcattacagatggaagcagaggctttagcaaaactgcaaaaggatagacaagtgactgacaatcagagaggctttgagttgtcaagcagcaccagaaaaaaagcacaggtttataacaagcaggattatgatctcatggtgtttcctgaatcagattcccaaaaaagagcattagatattgatgtagaaaagctcacccaagctgaacttgagaaactattgctggatgacagtttcgagactaaaaaaacacctgtattaccagttactcctattctgagcccttccttttcagcacagctctattttagacctactattcagagaggacagtggccacctggattacctgggccttccacttatgctttaccttctatttatccttctacttacagtaaacaggctgcattccaaaatggcttcaatccaagaatgcccacttttccatctacagaacctatatatttaagtcttccgggacaatctccatatttctcatatcctttgacacctgccacaccctttcatccacaaggaagcttacctatctatcgtccagtagtcagtactgacatggcaaaactatttgacaaaatagctagtacatcagaatttttaaaaaatgggaaagcaaggactgatttggagataacagattcaaaagtcagcaatctacaggtatctccaaagtctgaggatatcagtaaatttgactggttagacttggatcctctaagtaagcctaaggtggataatgtggaggtattagaccatgaggaagagaaaaatgtttcaagtttgctagcaaaggatccttgggatgctgttcttcttgaagagagatcgacagcaaattgtcatcttgaaagaaaggtgaatggaaaatccctttctgtggcaactgttacaagaagccagtctttaaatattcgaacaactcagcttgcaaaagcccagggccatatatctcagaaagacccaaatgggaccagtagtttgccaactggaagttctcttcttcaagaagttgaagtacagaatgaggagatggcagctttttgtcgatccattacaaaattgaagaccaaatttccatataccaatcaccgcacaaacccaggctatttgttaagtccagtcacagcacaaagaaacatatgcggagaaaatgctagtgtgaaggtctccattgacattgaaggatttcagctaccagttacttttacgtgtgatgtgagttctactgtagaaatcattataatgcaagccctttgctgggtacatgatgacttgaatcaagtagatgttggcagctatgttctaaaagtttgtggtcaagaggaagtgctgcagaataatcattgccttggaagtcatgagcatattcaaaactgtcgaaaatgggacacagaaattagactacaactcttgaccttcagtgcaatgtgtcaaaatctggcccgaacagcagaagatgatgaaacacccgtggatttaaacaaacacctgtatcaaatagaaaaaccttgcaaagaagccatgacgagacaccctgttgaagaactcttagattcttatcacaaccaagtagaactggctcttcaaattgaaaaccaacaccgagcagtagatcaagtaattaaagctgtaagaaaaatctgtagtgctttagatggtgtcgagactcttgccattacagaatcagtaaagaagctaaagagagcagttaatcttccaaggagtaaaactgctgatgtgacttctttgtttggaggagaagacactagcaggagttcaactaggggctcacttaatcctgaaaatcctgttcaagtaagcataaaccaattaactgcagcaatttatgatcttctcagactccatgcaaattctggtaggagtcctacagactgtgcccaaagtagcaagagtgtcaaggaagcatggactacaacagagcagctccagtttactatttttgctgctcatggaatttcaagtaattgggtatcaaattatgaaaaatactacttgatatgttcactgtctcacaatggaaaggatctttttaaacctattcaatcaaagaaggttggcacttacaagaatttcttctatcttattaaatgggatgaactaatcatttttcctatccagatatcacaattgccattagaatcagttcttcaccttactctttttggaattttaaatcagagcagtggaagttcccctgattctaataagcagagaaagggaccagaagctttgggcaaagtttctttacctctttttgactttaaacggtttttaacatgtggaactaaacttctatatctttggacttcatcacatacaaattctgttcctggaacagttaccaaaaaaggatatgtcatggaaagaatagtgctacaggttgattttccttctcctgcatttgatattatttatacaactcctcaagttgacagaagcattatacagcaacataacttagaaacactagagaatgatataaaagggaaacttcttgatattcttcataaagactcatcacttggactttctaaagaagataaagcttttttatgggagaaacgttattattgcttcaaacacccaaattgtcttcctaaaatattagcaagcgccccaaactggaaatgggttaatcttgccaaaacttactcattgcttcaccagtggcctgcattgtacccactaattgcattggaacttcttgattcaaaatttgctgatcaggaagtaagatccctagctgtgacctggattgaggccattagtgatgatgagctaacagatcttcttccacagtttgtacaagctttgaaatatgaaatttacttgaatagttcattagtgcaattccttttgtccagggcattgggaaatatccagatagcacacaatttatattggcttctcaaagatgccctgcatgatgtacagtttagtacccgatacgaacatgttttgggtgctctcctgtcagtaggaggaaaacgacttagagaagaacttctaaaacagacgaaacttgtacagcttttaggaggagtagcagaaaaagtaaggcaggctagtggatcagccagacaggttgttctccaaagaagtatggaacgagtacagtccttttttcagaaaaataaatgccgtctccctctcaagccaagtctagtggcaaaagaattaaatattaagtcgtgttccttcttcagttctaatgctgtccccctaaaagtcacaatggtgaatgctgaccctatgggagaagaaattaatgtcatgtttaaggttggtgaagatcttcggcaagatatgttagctttacagatgataaagattatggataagatctggcttaaagaaggactagatctgaggatggtaattttcaaatgtctctcaactggcagagatcgaggcatggtggagctggttcctgcttccgataccctcaggaaaatccaagtggaatatggtgtgacaggatcctttaaagataaaccacttgcagagtggctaaggaaatacaatccctctgaagaagaatatgaaaaggcttcagagaactttatctattcctgtgctggatgctgtgtagccacctatgttttaggcatctgtgatcgacacaatgacaatataatgcttcgaagcacgggacacatgtttcacattgactttggaaagtttttgggacatgcacagatgtttggcagcttcaaaagggatcgggctccttttgtgctgacctctgatatggcatatgtcattaatgggggtgaaaagcccaccattcgttttcagttgtttgtggacctctgctgtcaggcctacaacttgataagaaagcagacaaacctttttcttaacctcctttcactgatgattccttcagggttaccagaacttacaagtattcaagatttgaaatacgttagagatgcacttcaaccccaaactacagacgcagaagctacaattttctttactaggcttattgaatcaagtttgggaagcattgccacaaagtttaacttcttcattcacaaccttgctcagcttcgtttttctggtcttccttctaatgatgagcccatcctttcattttcacctaaaacatactcctttagacaagatggtcgaatcaaggaagtctctgtttttacatatcataagaaatacaacccagataaacattatatttatgtagtccgaattttgagggaaggacagattgaaccatcatttgtcttccgaacatttgacgaatttcaggaacttcacaataagctcagtattatttttccactttggaagttaccaggctttcctaataggatggttctaggaagaacacacataaaagatgtagcagccaaaaggaaaattgagttaaacagttacttacagagtttgatgaatgcttcaacggatgtagcagagtgtgatcttgtttgtactttcttccaccctttacttcgtgatgagaaagctgaagggatagctaggtctgcagatgcaggttccttcagtcctactccaggccaaataggaggagctgtgaaattatccatctcttaccgaaatggtactcttttcatcatggtgatgcatatcaaagatcttgttactgaagatggagctgacccaaatccatatgtcaaaacatacctacttccagataaccacaaaacatccaaacgtaaaaccaaaatttcacgaaaaacgaggaatccgacattcaatgaaatgcttgtatacagtggatatagcaaagaaaccctaagacagcgagaacttcaactaagtgtactcagtgcagaatctctgcgggagaattttttcttgggtggagtaaccctgcctttgaaagatttcaacttgagcaaagagacggttaaatggtatcagctgactgcggcaacatacttgtaaactagtgaatgtttgagctttggaagcatgaacagttataaacgtgcatgcatacatgcacacacacacagacacacacacacacacttgttaattttgtatagtatttttatacttggacagaacttataaagttaaatatacttgctgcatttcaacacatctgttggaccaacagtcacataactaacctttttgaatttttggaagccattgctgttttaaagtcattatgtagaatgctacaaaccctaaacttaatatatactaattcctgaaaaagactttgagacagtactatgtcagttcagccacctattttgcattgttttctataaggaggcaaagcatatgtgttttcctgttatgcaccttttatagcctttaccactgtgtaatgttcacaaacaccaaagtaaaggaaaaatgcaggatgttaccgtaaaatccagctgctattcatggagctgaaaaacaaagcacaaataatagatagctaagttaagaactactaagtagtttatagaagtagggaaaaacgtaatactgctttttattcatgtctttaaagcctttttcagaataagtgccaatcactgatgttgtaaataatggtgccttaactttatatgcttccctggcacttcgtttctgatttttttcctgatttgataaataattagtacatagttttcactcacttgcagcttactaaagacaagaaattatgtacatgtactaatgtttttcccacaaaaaaatcctttacttctgatgtatgaattagttatctaaatagttaagcctaatacctgaataagactcaccaatgtgattgtacaataaattctatcattccattaaaatcctacatttattcccaggaatggtaatttcacctccctacatctatactccactccctcagtaaataagtgaaaattgttaacccatgtgcccattcctgagtagggcagactcttcacaagaggcccatgacaagaattctagggtccagattgaactttaatatagacctttgtctgtgtagaccagtttgtcttgtaaactgtcttacttatgtgtgtaaacattttacattcacatgaaaagttattttcctttatataattggattcagaatcataagggacaggactgaaattattctacagtaaccagtaagaataagattcggccgggcacggtggctcctgcctgtaatcccaacactttgggaggccaaggtgggcggatcacctgaggtcaggagtttgagaccagcctggccaacatggtgaaaccccgtctctacacaaaaattagccaggcgtggtagcgggcatctgtaatcccagctacttggggggctgaggcaggagaatcgcttgaacccaggaggcggaggttgcagtgagccgagatcacgccactgcactcccgcctgggtgacaagagcaaaactccatcttaaaaaaaaagaaaaaaagagtaagattcatttttattagttactcaacttcagacacaattttgttaatttggatatatacatatatataataagaactcatggttagaatagaaatacagatactttaaaaatggtaatagaaattgtaccaatcaggttgctgtgagaaaactgacaaaatatgcaataaagaataccaagagagaaaggacaatcgccaattcagtttcccagaacagaatttttatgaactgcacaaatgtttaatgtaaatggtgatacctacagggaagaaatagaagagttgataatatatcactgggacggggtgggggaaagacttgaaatttttggtgcctaacactaatggtccatatgtagttaaacccatgagtatggtatatgaatgtcttttttaaatgttaaaatgtgttgtctatttaatgttaattaaaatgcagatcaaagcaccaccatttgctttttccacagatcattaacatttccttaaagtatgtaagtacctttgcaaatgcaaatgtactagtaattttcacttaagcttttgagaccgaattccattccaccagttatcacttagccactgtaatttaaaaacaaacaaacaaacaaaaactgtcttggtagaggtcgttaattagactcaacatgtactgcctttttgcagtctattatgacagtgtcttttagcacaaataatagagctaaaaaatgtcctgtcacttccattataagaaatctggattcatatctaagtgtatattataatactgtacagttaagagttcagaacaagtggtaatgttttctcttaatttaactcattttgtgccttctttactcattcaaacacacatacattttacatatagtttatttctttatgaaatgctaatcttcagcccgtaccaaaaagtagagtggagcctctttgcactactactatcaataaattttaaatcagttggatttttaagcattttttaaaagctgacattaaagtaaatctaaaaaaagtttaacaaactggccaagacactaatttttatgtataatcacaatattttatactcacctttattgactaaaaataattatgctacatgttgtcctgcatcagaagaattatttcttcttgccagtgttttgggatttgaagataatggttcactcaaagaacctattattttctctactgaggaacccaatgtagaacttgcactgatatttttattactgcctttatatgaatctataggtatctaaatgttaaggcatgtatgatctttgatcatttcttttttcaaattaaagttgtataaaagtttcaatatcttgccttaaattagttgcctattctttctaggattcaaatattgtgacatttaaaaaagaaaacattcacttttgaaacttagacttcagatcaaaaaggactgaacccccactatcataatccatacattcatttccatgttgtttgactagcagtgcatatatgaatgaatatggtaattaatcttacctataagaaccaaatactttaattatattaagatagtgaataaagatgtataatatttttattaataccttgaatatattcagtggattgaatgtgacttcataactgtactacgattgtattaaaatatttctggaataaaagaa

SEQ ID NO: 3081 - DNA, 584 bp, Homo sapiens
agctttcggcggcggctgagccagctgaggggaaaaatggctcggactgtggcggcttcggcggctcaggttgtggtagaggcggaggctcaggcagcttgaggtttatttgtacaaatagcacaggaggccttgctattttggaagctacaagaaaaaaatagaggaaggaaggtttggtctttttagtggacatggctcagatatctagcaacagcggatttaaagaatgtccatcttcacatccggaaccaacaagagcaaaagatgtggacaaagaagaagcattacagatggaagcagaggctttagcaaaactgcaaaaggatagacaagtgactgacaatcagagaggctttgagttgtcaagcagcaccagaaaaaaagcacaggtttataacaagcaggattatgatctcatggtgtttcctgaatcagattcccaaaaaagagcattagatattgatgtagaaaagctcacccaagctgaacttgagaaactattgctggatgacagtttcgagactaaaaaaacacctgtattaccagttactcctattctgagcccttccttttcagcacag

SEQ ID NO: 3082 - DNA, 2101 bp, Homo sapiens
tttcggcggcggctgagccagctgaggggaaaaatggctcggactgtggcggcttcggcggctcaggttgtggtagaggcggaggctcaggcagcttgaggccttgctattttggaagctacaagaaaaaaatagaggaaggaaggtttggtctttttagtggacatggctcagatatctagcaacagcggatttaaagaatgtccatcttcacatccggaaccaacaagagcaaaagatgtggacaaagaagaagcattacagatggaagcagaggctttagcaaaactgcaaaaggatagacaagtgactgacaatcagagaggctttgagttgtcaagcagcaccagaaaaaaagcacaggtttataacaagcaggattatgatctcatggtgtttcctgaatcagattcccaaaaaagagcattagatattgatgtagaaaagctcacccaagctgaacttgagaaactattgctggatgacagtttcgagactaaaaaaacacctgtattaccagttactcctattctgagcccttccttttcagcacagctctattttagacctactattcagagaggacagtggccacctggattacctgggccttccacttatgctttaccttctatttatccttctacttacagtaaacaggctgcattccaaaatggcttcaatccaagaatgcccacttttccatctacagaacctatatatttaagtcttccgggacaatctccatatttctcatatcctttgacacctgccacaccctttcatccacaaggaagcttacctatctatcgtccagtagtcagtactgacatggcaaaactatttgacaaaatagctagtacatcagaatttttaaaaaatgggaaagcaaggactgatttggagataacagattcaaaagtcagcaatctacaggtatctccaaagtctgaggatatcagtaaatttgactggttagacttggatcctctaagtaagcctaaggtggataatgtggaggtattagaccatgaggaagagaaaaatgtttcaagtttgctagcaaaggatccttgggatgctgttcttcttgaagagagatcgacagcaaattgtcatcttgaaagaaaggtgaatggaaaatccctttctgtggcaactgttacaagaagccagtctttaaatattcgaacaactcagcttgcaaaagcccagggccatatatctcagaaagacccaaatgggaccagtagtttgccaactggaagttctcttcttcaagaagttgaagtacagaatgaggagatggcagctttttgtcgatccattacaaaattgaagaccaaatttccatataccaatcaccgcacaaacccaggctatttgttaagtccagtcacagcacaaagaaacatatgcggagaaaatgctagtgtgaaggtctccattgacattgaaggatttcagctaccagttacttttacgtgtgatgtgagttctactgtagaaatcattataatgcaagccctttgctgggtacatgatgacttgaatcaagtagatgttggcagctatgttctaaaagtttgtggtcaagaggaagtgctgcagaagtaagtttatttaactactgagcaacatccttggaaatttcatttttaatggtttaatctagaaaaatttcaagttaaatttataatgcagaaatacattggatcctattgaattgatttattgaatcaataaacttttattgaaatatataatgtctaagatgtcatgtctaagacagtggtggggtttcagagataagtgagacattgtattcccttaaggagcttgtagtctttacaggaagagtttcaggcagttggttaataagtgatataatgggtctttcttactgtaaagagtcaatagtcacatcattatagactatattcctcttgcaacatgcactgttactttatgcacagtagtcagctgtgatttccttttagttgcctgaaataatcattatatgaatctttttcttacccaggagaattggttgaaaccgggaggcagaggttgcagtgagctgagatcacactgctgcagt

SEQ ID NO: 3083 - DNA, 4550 bp, Homo sapiens
gtgctgcgcttggctggctgtggagtcggccgaagctttcggcggcggctgagccagctgaggggaaaaatggctcggactgtggcggcttcggcggctcaggttgtggtagaggcggaggctcaggcagcttgagaaagacccaaatgggaccagtagtttgccaactggaagttctcttcttcaagaagttgaagtacagaatgaggagatggcagctttttgtcgatccattacaaaattgaagaccaaatttccatataccaatcaccgcacaaacccaggctatttgttaagtccagtcacagcacaaagaaacatatgcggagaaaatgctagtgtgaaggtctccattgacattgaaggatttcagctaccagttacttttacgtgtgatgtgagttctactgtagaaatcattataatgcaagccctttgctgggtacatgatgacttgaatcaagtagatgttggcagctatgttctaaaagtttgtggtcaagaggaagtgctgcagaataatcattgccttggaagtcatgagcatattcaaaactgtcgaaaatgggacacagaaattagactacaactcttgaccttcagtgcaatgtgtcaaaatctggcccgaacagcagaagatgatgaaacacccgtggatttaaacaaacacctgtatcaaatagaaaaaccttgcaaagaagccatgacgagacaccctgttgaagaactcttagattcttatcacaaccaagtagaactggctcttcaaattgaaaaccaacaccgagcagtagatcaagtaattaaagctgtaagaaaaatctgtagtgctttagatggtgtcgagactcttgccattacagaatcagtaaagaagctaaagagagcagttaatcttccaaggagtaaaactgctgatgtgacttctttgtttggaggagaagacactagcaggagttcaactaggggctcacttaatcctgaaaatcctgttcaagtaagcataaaccaattaactgcagcaatttatgatcttctcagactccatgcaaattctggtaggagtcctacagactgtgcccaaagtagcaagagtgtcaaggaagcatggactacaacagagcagctccagtttactatttttgctgctcatggaatttcaagtaattgggtatcaaattatgaaaaatactacttgatatgttcactgtctcacaatggaaaggatctttttaaacctattcaatcaaagaaggttggcacttacaagaatttcttctatcttattaaatgggatgaactaatcatttttcctatccagatatcacaattgccattagaatcagttcttcaccttactctttttggaattttaaatcagagcagtggaagttcccctgattctaataagcagagaaagggaccagaagctttgggcaaagtttctttacctctttttgactttaaacggtttttaacatgtggaactaaacttctatatctttggacttcatcacatacaaattctgttcctggaacagttaccaaaaaaggatatgtcatggaaagaatagtgctacaggttgattttccttctcctgcatttgatattatttatacaactcctcaagttgacagaagcattatacagcaacataacttagaaacactagagaatgatataaaagggaaacttcttgatattcttcataaagactcatcacttggactttctaaagaagataaagcttttttatgggagaaacgttattattgcttcaaacacccaaattgtcttcctaaaatattagcaagcgccccaaactggaaatgggttaatcttgccaaaacttactcattgcttcaccagtggcctgcattgtacccactaattgcattggaacttcttgattcaaaatttgctgatcaggaagtaagatccctagctgtgacctggattgaggccattagtgatgatgagctaacagatcttcttccacagtttgtacaagctttgaaatatgaaatttacttgaatagttcattagtgcaattccttttgtccagggcattgggaaatatccagatagcacacaatttatattggcttctcaaagatgccctgcatgatgtacagtttagtacccgatacgaacatgttttgggtgctctcctgtcagtaggaggaaaacgacttagagaagaacttctaaaacagacgaaacttgtacagcttttaggaggagtagcagaaaaagtaaggcaggctagtggatcagccagacaggttgttctccaaagaagtatggaacgagtacagtccttttttcagaaaaataaatgccgtctccctctcaagccaagtctagtggcaaaagaattaaatattaagtcgtgttccttcttcagttctaatgctgtccccctaaaagtcacaatggtgaatgctgaccctatgggagaagaaattaatgtcatgtttaaggttggtgaagatcttcggcaagatatgttagctttacagatgataaagattatggataagatctggcttaaagaaggactagatctgaggatggtaattttcaaatgtctctcaactggcagagatcgaggcatggtggagctggttcctgcttccgataccctcaggaaaatccaagtggaatatggtgtgacaggatcctttaaagataaaccacttgcagagtggctaaggaaatacaatccctctgaagaagaatatgaaaaggcttcagagaactttatctattcctgtgctggatgctgtgtagccacctatgttttaggcatctgtgatcgacacaatgacaatataatgcttcgaagcacgggacacatgtttcacattgactttggaaagtttttgggacatgcacagatgtttggcagcttcaaaagggatcgggctccttttgtgctgacctctgatatggcatatgtcattaatgggggtgaaaagcccaccattcgttttcagttgtttgtggacctctgctgtcaggcctacaacttgataagaaagcagacaaacctttttcttaacctcctttcactgatgattccttcagggttaccagaacttacaagtattcaagatttgaaatacgttagagatgcacttcaaccccaaactacagacgcagaagctacaattttctttactaggcttattgaatcaagtttgggaagcattgccacaaagtttaacttcttcattcacaaccttgctcagcttcgtttttctggtcttccttctaatgatgagcccatcctttcattttcacctaaaacatactcctttagacaagatggtcgaatcaaggaagtctctgtttttacatatcataagaaatacaacccagataaacattatatttatgtagtccgaattttgagggaaggacagattgaaccatcatttgtcttccgaacatttgacgaatttcaggaacttcacaataagctcagtattatttttccactttggaagttaccaggctttcctaataggatggttctaggaagaacacacataaaagatgtagcagccaaaaggaaaattgagttaaacagttacttacagagtttgatgaatgcttcaacggatgtagcagagtgtgatcttgtttgtactttcttccaccctttacttcgtgatgagaaagctgaagggatagctaggtctgcagatgcaggttccttcagtcctactccaggccaaataggaggagctgtgaaattatccatctcttaccgaaatggtactcttttcatcatggtgatgcatatcaaagatcttgttactgaagatggagctgacccaaatccatatgtcaaaacatacctacttccagataaccacaaaacatccaaacgtaaaaccaaaatttcacgaaaaacgaggaatccgacattcaatgaaatgcttgtatacagtggatatagcaaagaaaccctaagacagcgagaacttcaactaagtgtactcagtgcagaatctctgcgggagaattttttcttgggtggagtaaccctgcctttgaaagatttcaacttgagcaaagagacggttaaatggtatcagctgactgcggcaacatacttgtaaactagtgaatgtttgagctttggaagcatgaacagttataaacgtgcatgcatacatgcacacacacacagacacacacacacacacttgttaattttgtatagtatttttatacttggacagaacttataaagttaaatatacttgctgcatttcaacacatctgttggaccaacagtcacataactaacctttttgaatttttggaagccattgctgttttaaagtcattatgtagaatgctacaaaccctaaacttaatatatactaattcctgaaaaagactttgagacagtactatgtcagttcagccacctattttgcattgttttctataaggaggcaaagcatatgtgttttcctgttatgcaccttttatagcctttaccactgtgtaatgttcacaaacaccaaagta

SEQ ID NO: 3084 - DNA, 2090 bp, Homo sapiens
agctgaggggaaaaatggctcggactgtggcggcttcggcggctcaggttgtggtagaggcggaggctcaggcagcttgaggccttgctattttggaagctacaagaaaaaaatagaggaaggaaggtttggtctttttagtggacatggctcagatatctagcaacagcggatttaaagaatgtccatcttcacatccggaaccaacaagagcaaaagatgtggacaaagaagaagcattacagatggaagcagaggctttagcaaaactgcaaaaggatagacaagtgactgacaatcagagaggctttgagttgtcaagcagcaccagaaaaaaagcacaggtttataacaagcaggattatgatctcatggtgtttcctgaatcagattcccaaaaaagagcattagatattgatgtagaaaagctcacccaagctgaacttgagaaactattgctggatgacagtttcgagactaaaaaaacacctgtattaccagttactcctattctgagcccttccttttcagcacagctctattttagacctactattcagagaggacagtggccacctggattacctgggccttccacttatgctttaccttctatttatccttctacttacagtaaacaggctgcattccaaaatggcttcaatccaagaatgcccacttttccatctacagaacctatatatttaagtcttccgggacaatctccatatttctcatatcctttgacacctgccacaccctttcatccacaaggaagcttacctatctatcgtccagtagtcagtactgacatggcaaaactatttgacaaaatagctagtacatcagaatttttaaaaaatgggaaagcaaggactgatttggagataacagattcaaaagtcagcaatctacaggtatctccaaagtctgaggatatcagtaaatttgactggttagacttggatcctctaagtaagcctaaggtggataatgtggaggtattagaccatgaggaagagaaaaatgtttcaagtttgctagcaaaggatccttgggatgctgttcttcttgaagagagatcgacagcaaattgtcatcttgaaagaaaggtgaatggaaaatccctttctgtggcaactgttacaagaagccagtctttaaatattcgaacaactcagcttgcaaaagcccagggccatatatctcagaaagacccaaatgggaccagtagtttgccaactggaagttctcttcttcaagaagttgaagtacagaatgaggagatggcagctttttgtcgatccattacaaaattgaagaccaaatttccatataccaatcaccgcacaaacccaggctatttgttaagtccagtcacagcacaaagaaacatatgcggagaaaatgctagtgtgaaggtctccattgacattgaaggatttcagctaccagttacttttacgtgtgatgtgagttctactgtagaaatcattataatgcaagccctttgctgggtacatgatgacttgaatcaagtagatgttggcagctatgttctaaaagtttgtggtcaagaggaagtgctgcagaataatcattgccttggaagtcatgagcatattcaaaactgtcgaaaatgggacacagaaattagactacaactcttgaccttcagtgcaatgtgtcaaaatctggcccgaacagcagaagatgatgaaacacccgtggatttaaacaaacacctgtatcaaatagaaaaaccttgcaaagaagccatgacgagacaccctgttgaagaactcttagattcttatcacaaccaagtagaactggctcttcaaattgaaaaccaacaccgagcagtagatcaagtaattaaagctgtaagaaaaatctgtagtgctttagatggtgtcgagactcttgccattacagaatcagtaaagaagctaaagagagcagttaatcttccaaggagtaaaactgctgatgtgacttctttgtttggaggagaagacactagcaggagttcaactaggggctcacttaatcctgaaaatcctgttcaagtaagcataaaccaatta

SEQ ID NO: 3085 - DNA, 9443 bp, Homo sapiens
cgtgttgtggggctcagctggttcatttatgttgtttttcctgtacctaagttcccgctgtaggtggtacctttgcagacggtgcgatgggggaagcagagaagtttcactacatctatagttgtgacctggatatcaacgtccagcttaagataggaagcttggaagggaagagagaacaaaagagttataaagctgtcctggaagacccaatgttgaagttctcaggactatatcaagagacatgctctgatctttatgttacttgtcaagtttttgcagaagggaagcctttggccttgccagtgagaacatcctacaaagcatttagtacaagatggaactggaatgaatggctgaaactaccagtaaaataccctgacctgcccaggaatgcccaagtggccctcaccatatgggatgtgtatggtcccggaaaagcagtgcctgtaggaggaacaacggtttcgctctttggaaaatacggcatgtttcgccaagggatgcatgacttgaaagtctggcctaatgtagaagcagatggatcagaacccacaaaaactcctggcagaacaagtagcactctctcagaagatcagatgagccgtcttgccaagctcaccaaagctcatcgacaaggacacatggtgaaagtagattggctggatagattgacatttagagaaatagaaatgataaatgagagtgaaaaacgaagttctaatttcatgtacctgatggttgaatttcgatgtgtcaagtgtgatgataaggaatatggtattgtttattatgaaaaggacggtgatgaatcatctccaattttaacaagttttgaattagtgaaagttcctgacccccagatgtctatggagaatttagttgagagcaaacaccacaagcttgcccggagtttaagaagtggaccttctgaccacgatctgaaacccaatgctgccacgagagatcagttaaatattattgtgagttatccaccaaccaagcaacttacatatgaagaacaagatcttgtttggaagtttagatattatcttacgaatcaagaaaaagccttgacaaaattcttgaaatgtgttaattgggatctacctcaagaggccaaacaggccttggaacttctgggaaaatggaagccgatggatgtagaggactccttggagctgttatcctctcattacaccaacccaactgtgaggcgttatgctgttgcccggttgcgacaggccgatgatgaggatttgttgatgtacctattacaattggtccaggctctcaaatatgaaaattttgatgatataaagaatggattggaacctaccaagaaggatagtcagagttcagtgtcagaaaatgtgtcaaattctggaataaattctgcagaaatagatagctcccaaattataaccagcccccttccttcagtctcttcacctcctcctgcatcaaaaacaaaagaagttccagatggcgaaaatctggaacaagatctctgtaccttcttgatatcgagagcctgcaaaaactcaacactggctaattatttatactggtatgtgatagtggaatgtgaagatcaagatactcagcagagagatccaaagacccatgagatgtacttgaacgtaatgagaagattcagccaagcattgttgaagggtgataagtctgtcagagttatgcgttctttgctggctgcacaacagacatttgtagatcggttggtgcatctaatgaaggcagtacaacgcgaaagtggaaatcgtaagaaaaagaatgagagactacaggcattgcttggagataatgaaaagatgaatttgtcagatgtggaacttatcccgttgcctttagaaccccaagtgaaaattagaggaataattccggaaacagctacactgtttaaaagtgcccttatgcctgcacagttgttttttaagacggaagatggaggcaaatatccagttatatttaagcatggagatgatttacgtcaagatcaacttattcttcaaatcatttcactcatggacaagctgttacggaaagaaaatctggacttgaaattgacaccttataaggtgttagccaccagtacaaaacatggcttcatgcagtttatccagtcagttcctgtggctgaagttcttgatacagagggaagcattcagaacttttttagaaaatatgcaccaagtgagaatgggccaaatgggattagtgctgaggtcatggacacttacgttaaaagctgtgctggatattgcgtgatcacctatatacttggagttggagacaggcacctggataaccttttgctaacaaaaacaggcaaactcttccacatagactttggatatattttgggtcgggatccaaagcctcttcctccaccaatgaagctgaataaagaaatggtagaaggaatggggggcacacagagtgagcagtaccaagagttccgtaaacagtgttacacggctttcctccacctgcgaaggtattctaatctgattttgaacttgttttccttgatggttgatgcaaacattccagatattgcacttgaaccagataaaactgtgaaaaaggttcaggataaattccgcttagacctgtcggatgaagaggctgtgcattacatgcagagtctgattgatgagagtgtccatgctctttttgctgcagtggtggaacagattcacaagtttgcccagtactggagaaaatgaaactgggattgacccatcaagatgcttggctcaataagaaaaccacgttaggagcaacctttgtatattggagacttcagagtaaccagcaaggaagagaaatcttaatcttcaagttaccatattttccaaatattacatggtacctgagttctgcttccttggatgtcattgcttaaatatagtcttgaagggcttgttttgaaatattgtatatattttttcaaatgtatacattgttaataaattaagaaatgagaaacattcttatttatgtacatgttatgagagttctggaggaagtaatatgttgaaatagtaaaacattttagtttttgagtttaaaatgttattttttcctcttatatcttcatatcaggacagcagtaacctgaatttagattgtcacagtttacaagtttttgtttgttccttctttcctctctcttctcccactcacttttgtgtgttgtttgtttttgcctaatttacatgtttaaagttctacttaaaatttttcttcaagttttacatgtgatggctcattcttctgcagttcaagaattgcttatatttttagaagatactcattttctcttacaaataattaattttttgtaaactacagttaatagttcttctagcttgtaagtgtgtaaagtagaatatgaaaatgtggctatttagataactggccaaaaggtcatatgaccaccagttttagtattgagcataagatatttttacatattcatgtaagacaatgtaaattgtctttctgcaataaattttttggatgcaaatttagatttcaaaagctttttgatgttataaaggagttgaggaacaaaaagctctttgaaatagctcacctagacctgttaatgtaatatattctttctgaattaagcaaaattttttttgtcttttaagactagaactaatccctctagcttttttactggaactttggggaaaaagaacaaatacaaatatacaaatgatatgaacaatatggtaataatcttttgcaacttaatatgttacatagtcatatgacttggtcttggaagaaaaagaattgttttggtgctgaataaatattagaaatcaagtgacagagaagatgaaggtaaaattgtggcacagtttcagagaatgccgttaatgataacgtgttatttgtctcaaattcttagccctgggcttgcctcttcagagtggggttaccggcgagagggcaagcatgtaattaagagacactctagaggcatatggaatatagtttgtataaaacatacctgctgattagaaaaatggtaaaaatgaaaatacctttgtacatcatcttaagagagcttatatataaactaaatgggcaggctccatcgtctacctttctttttcttttcttcacatgtttatgtcttttttgttattagtcagacatttttagccctctgtatgctcattcttgtagttctatttctattgaaacttcctccaaaacttttctctgaattacccttgttgaaactgacctttcttccgtgtgaactcctacacttgcatctcctatttcaggatttggcatactttttctttaatgggctaagaaagtaaatatcttcagctttggggggcatatgatcccaatagcatcaacttaactctgctaactggaaggcaaaagtgtatcatcttactcgtctttataaactccacagcactctgcatagatatgaccatgtttataaggaactcaataaataattttgacacaaacatgaaattctagaagggcagacactgacaactagtaaggaagttgatcatgagtaactttgtattcagtgccaccttaacaagaattgtaaagaggataaacctttctaggaaggttgatgcgtgttgggtgaggaaggagcatctctcaggagggtaaacagtagctgtggttttgctgagagattttggctgtgagtgacaagcctatatcaaaaagaaaagtggcttatcaatctcagtttttattgctcaaagcaattctttactcctattttttccaaattccattgtttttactctttagagctctatcctcagagtgtagtctgcatatttctttattatcattgccatgtgacttctttggtgacaagttcagtgatatttcaagcatgatgttttgagtttgagaaatgtatttgtgaggacacatcactttaattaaaaaagtgtgagtactatggtcattaagttattcagagtgagatttctgagaggagaagagagaatgtagatggcagttattgagagtggggctataggacaaaaagaagaaaagtatggttaacattgccaaataaagggtcatacagccttgctttttgctggagttagcaaaaatcattctccatatgatagttttagatgttccccagctcatttgtattattgagttttcagctgggtatatattataataacagtcaacatgatgtaggggctcagtattacatggcagggctatactaattgcttcatatgccttatctcattattctgtgagatagaattgtctcctcattttttagttgaaataactgaagtttaaagcaattgaatcatctgcccaaggataagctgctggtgagagcagagttgggatttgaagtcgagttagaccccagtgatcacagtcttgacgattaaattcttccagctttcatttttcactgagataatggtagtgatagtactgacctctaatgtgtgcatttgtgggtatgtggtccattcagctttaatccccagaagacaaggcttattccttttcttatttttggtcatgttttatttttccattgcttttaacaggattaccaaaggcacactcagtagtcagtaaacacatttctaggaaaggtgttgtgtcatcatgccacatattcatactttccttgggttggaaaatagatcattcagtaaaaacatacaggaaaaatgaatcttgccaatgcaattgttaacctacaaccataatataccttaagtatatttttgcacataagtataacattgcgatttaaaacaataaaccagattgagattctaaggagcattttgtaagtaattactaatgtttattttagagagatcacacaacttcaaataaaaactgacatagattgaacaccttgagaataaactttagtgccaaatggaaaataattttttacaagtaaatttgaagaacaatgtgaactttctataattatatacagaaaatatactgatttgccaaaatgagtaattttgatatattaatatttcacttataagaatgcataccacctgatccaggatgggatccaggaacagaaaaagaacattaggtaaaaatgacagaaatctgaatatagtatagagtagctaaaaacaaaccaaaaaaaaaaaaaaaaaaaaaggaaaaacagaataagcctcagaagatagtgagcatcccacctgggtgaccacttagagaagctgaggtgggacccctgcatccgataagtggctgcactagaccacaggaaccagactccactgtaagaactagagtgggaatggacatgtcaaaacctcctgggaaccttattaaatgtgcacattcccaatccccactcctgagcagccaaatcaatctgcaggtgggccttgtgagttttcccaggggattccgatgcctgctagatttaaccagtagatgagatgttaagttatcctgtagtccagagattccacaggccagtgtcagggaacaggggccagggctgggaaggcataagaacagaagataaatttgaggctctgttacgctggtcatccaacccaaccaggtatctcttgttatatgctaacttcattttccctttcttgtccatagtgggaaaaaataatttttaactggctatgtagttaaaaaacctaacaaaaagcacttttctatataatgagtggtttatattaagaataggtacaatgtaaatactggtaagtgaaagttcattttgttcagtgctatgggctggtacattgcatttcaacactagttttttacttttatctaccctgagggtagataacccatattccaaaatacagtattattttcatttgctgtaacattttaagaaatatgtagtttctaaaacttcatatactttatatggaatatgaacaactttaatatgaataaatagtctagaaaaaaatttaggaaaaattgccatgaaatcatgagctaagtcaatggttattttaaaccacttaattttgagactagtatttcatacagaaaaagctaatactgatatcacacactaattgtgtataaaacactaggaatgtcaaaatagaacataagaaaatgagtctagtggacccactgcatagtgtaactttgggatgaatttaaaagaatatttaagtcacagtcaattttctgttggtctaattttaccaaataaccccctaaataagaagtctgatttatctaaaatagaagttaacatagcatcccagtattgccattctaaaactctggcatgtaaatgggagaaatggaaataagctcaaaatgggtagagtaacccatttctgcatgaaccatagaatttaactagaatttggctggctcatgcctgtaatgccagcactttgggaggccaaggcaggcagatcacttgagcccaggagtttgagaccagcccgggcaacatggtgaaactccatctcttcaaaaatatatatttgtgtgtgtgtgtgtgtgtatgtgcgtgcacaaaaattagctgagtgtggtggttcacacttgtaatcacagctacctgggaggctgaggcaggaggattgcttgagcctgggaggcagaggttgcagtgagctgagattgcaccattgcactgcagcctgggtaatagagcgagacaactctatctcaaaaaaaagaatttcactagaatttatatcttcagtgtttgcattagattgtcaccagcactatctgccttgtgactgtcaggactaatccttatatcatttatcttatgtcctttacctcagtttatgtctgtcaccacaagaaacccagacctccctaatcataccatatgccctggtcttacccacatacagctcggtacaactgcatttccccaaacctcagaactccttgggccatcactgtcagagacatttgaactagagcaactccatcttgagtagggactgggtataatgaagctgagacccactgggctgcattcccaggaagttaggcattcttagtcacaggatgagataggagattggctcaagataaggtcacaaagaccttgctgataaaacagtctgtggtaaagaagccagccaaaacccaccaaaaccaagacgggaatgaaagtgacctccggtcatcctcactgctcattatacgctagttataatgcattgacatgctaagagacactcccaccagcaccatgacagtttacaaatgccataacaacatcaggaagttaccctatatggtctaaaaaggggaggaaccctcagttctgagaatttccttgaaaattcatgaataatccaccccttgtttagcatatgatcaagaaataatcattaaaaaatagccaaccagcagctcatgctgctggtctgcctatggagtagccatcctttctttattaacctgctttcactttatggactcccctgaattcttctgcaggagatccaagaaccctctcttggagtcttaaccaggatccctttccagtaacttcagcaggatctgtgagtgccagtttccttctgtggtgcaaaactaggtgctaagtacactttttcccccctttcctctatttttaaaagaactttcagcccttttgaagtgggtacattgtctggagtacataccctggggttcattgttataggagaatttaggacacagacacacgaggagtttaggagcagaggtttaataggtagaagagaagggaaagagaaacagcttcctctatagatgtctgcactgacaccgtggctttaaggcatggcccatgatgtgtctccgagtggaaaagactggttggtggtgaatgcgccaaattttatagtccggtttgaggaggtggtttctgattggttgcatcatgtatgacgtttgcaaggtgcatgtggaaggctggtcgccccaccctaatcttatgcaaatgggctttccagttgattgggtccatcttgtgtaacacgtggctggcagagaagggaagatgaagccaccatcttgaaaatgtctagtccttagtttctgctggcattcacccatgcaagctgccagcttgtctatgtctgcagctcaactttacaggctgctctttgttagcaaatgatttggagcttcttttcattaaagaaaaaagccttaccgaggactcccatacccttgctttctgcttaagtgatttcttcttaactcctatgtcaattttatacagcatgaaataatgatgtatctataaatgagcctttgcaagattaccatttatcaaagaaaaccagtgatgtttagttaactgtttgtaaaaataaatggttagtagaatgtctaattcaataaatgtttcataaatgagtaaa

SEQ ID NO: 3086 - DNA, 2778 bp, Homo sapiens
aagttcccgctgtaggtggtacctttgcagacggtgcgatgggggaagcagagaagtttcactacatctatagttgtgacctggatatcaacgtccagcttaagatctggaatgaatggctgaaactaccagtaaaataccctgacctgcccaggaatgcccaagtggccctcaccatatgggatgtgtatggtcccggaaaagcagtgcctgtaggaggaacaacggtttcgctctttggaaaatacggcatgtttcgccaagggatgcatgacttgaaagtctggcctaatgtagaagcagatggatcagaacccacaaaaactcctggcagaacaagtagcactctctcagaagatcagatgagccgtcttgccaagctcaccaaagctcatcgacaaggacacatggtgaaagtagattggctggatagattgacatttagagaaatagaaatgataaatgagagtgaaaaacgaagttctaatttcatgtacctgatggttgaatttcgatgtgtcaagtgtgatgataaggaatatggtattgtttattatgaaaaggacggtgatgaatcatctccaattttaacaagttttgaattagtgaaagttcctgacccccagatgtctatggagaatttagttgagagcaaacaccacaagcttgcccggagtttaagaagtggaccttctgaccacgatctgaaacccaatgctgccacgagagatcagttaaatattattgtgagttatccaccaaccaagcaacttacatatgaagaacaagatcttgtttggaagtttagatattatcttacgaatcaagaaaaagccttgacaaaattcttgaaatgtgttaattgggatctacctcaagaggccaaacaggccttggaacttctgggaaaatggaagccgatggatgtagaggactccttggagctgttatcctctcattacaccaacccaactgtgaggcgttatgctgttgcccggttgcgacaggccgatgatgaggatttgttgatgtacctattacaattggtccaggctctcaaatatgaaaattttgatgatataaagaatggattggaacctaccaagaaggatagtcagagttcagtgtcagaaaatgtgtcaaattctggaataaattctgcagaaatagatagctcccaaattataaccagcccccttccttcagtctcttcacctcctcctgcatcaaaaacaaaagaagttccagatggcgaaaatctggaacaagatctctgtaccttcttgatatcgagagcctgcaaaaactcaacactggctaattatttatactggtatgtgatagtggaatgtgaagatcaagatactcagcagagagatccaaagacccatgagatgtacttgaacgtaatgagaagattcagccaagcattgttgaagggtgataagtctgtcagagttatgcgttctttgctggctgcacaacagacatttgtagatcggttggtgcatctaatgaaggcagtacaacgcgaaagtggaaatcgtaagaaaaagaatgagagactacaggcattgcttggagataatgaaaagatgaatttgtcagatgtggaacttatcccgttgcctttagaaccccaagtgaaaattagaggaataattccggaaacagctacactgtttaaaagtgcccttatgcctgcacagttgttttttaagacggaagatggaggcaaatatccagttatatttaagcatggagatgatttacgtcaagatcaacttattcttcaaatcatttcactcatggacaagctgttacggaaagaaaatctggacttgaaattgacaccttataaggtgttagccaccagtacaaaacatggcttcatgcagtttatccagtcagttcctgtggctgaagttcttgatacagagggaagcattcagaacttttttagaaaatatgcaccaagtgagaatgggccaaatgggattagtgctgaggtcatggacacttacgttaaaagctgtgctggatattgcgtgatcacctatatacttggagttggagacaggcacctggataaccttttgctaacaaaaacaggcaaactcttccacatagactttggatatattttgggtcgggatccaaagcctcttcctccaccaatgaagctgaataaagaaatggtagaaggaatggggggcacacagagtgagcagtaccaagagttccgtaaacagtgttacacggctttcctccacctgcgaaggtattctaatctgattttgaacttgttttccttgatggttgatgcaaacattccagatattgcacttgaaccagataaaactgtgaaaaaggttcaggataaattccgcttagacctgtcggatgaagaggctgtgcattacatgcagagtctgattgatgagagtgtccatgctctttttgctgcagtggtggaacagattcacaagtttgcccagtactggagaaaatgaaactgggattgacccatcaagatgcttggctcaataagaaaaccacgttaggagcaacctttgtatattggagacttcagagtaaccagcaaggaagagaaatcttaatcttcaagttaccatattttccaaatattacatggtacctgagttctgcttccttggatgtcattgcttaaatatagtcttgaagggcttgttttgaaatattgtatatattttttcaaatgtatacattgttaataaattaagaaatgagaaacat

SEQ ID NO: 3087 - DNA, 6435 bp, Homo sapiens
tacaaccaggctcaactgttgcatggtagcagatttgcaaacatgagtgctgaggggtaccagtacagagcgctgtatgattataaaaaggaaagagaagaagatattgacttgcacttgggtgacatattgactgtgaataaagggtccttagtagctcttggattcagtgatggacaggaagccaggcctgaagaaattggctggttaaatggctataatgaaaccacaggggaaaggggggactttccgggaacttacgtagaatatattggaaggaaaaaaatctcgcctcccacaccaaagccccggccacctcggcctcttcctgttgcaccaggttcttcgaaaactgaagcagatgttgaacaacaagctttgactctcccggatcttgcagagcagtttgcccctcctgacattgccccgcctcttcttatcaagctcgtggaagccattgaaaagaaaggtctggaatgttcaactctatacagaacacagagctccagcaacctggcagaattacgacagcttcttgattgtgatacaccctccgtggacttggaaatgatcgatgtgcacgttttggctgacgctttcaaacgctatctcctggacttaccaaatcctgtcattccagcagccgtttacagtgaaatgatttctttagctccagaagtacaaagctccgaagaatatattcagctattgaagaagcttattaggtcgcctagcatacctcatcagtattggcttacgcttcagtatttgttaaaacatttcttcaagctctctcaaacctccagcaaaaatctgttgaatgcaagagtactctctgaaattttcagccctatgcttttcagattctcagcagccagctctgataatactgaaaacctcataaaagttatagaaattttaatctcaactgaatggaatgaacgacagcctgcaccagcactgcctcctaaaccaccaaaacctactactgtagccaacaacggtatgaataacaatatgtccttacaagatgctgaatggtactggggagatatctcgagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactgaagaccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagtaaaaaaaaaaaatggcttcagaattaaaactatgaaatattttacagtttttcttgtacagagtacttggctgttagcccaaggttaaaaagttcataacagattttttttggactgttttgttgggcagtgcctgataagcttcaaagctgctttattcaataaaaaaaagaaatgaaaaagatatatgaatatgacaaagtattgctgagtccaacaatgttgttttaagactcttaaaatacggtacctggcaatgtttatttcataaagaattgtgaacttcttgaatctagggagggggaatgtagtgaagggatgtatcaagtggggtggtgggagggggaggcaaggttatatgcactttctcatgatttacagagaagtgaataactgcaaagtgaagttgcttcttctacttcagtcttctctcactttgatttgctagttgttatcaattaatgacaattacaaacctactgtatctctaatacagtgtgactggtcaggtatttcagttcttaggaaggaagtgccaagtttgtttttgggttcctggaacagcgctcacctttgtttagaacactggtttaaagggataatcatctctgtcacattagactatccatcatgaccagcaaatactcattttaggaaaaaaaaaagcatgatctgaaaaatacttttggtggtatgttggttaccctcctagctttccatttggtttagaacataaagcaaatagacacagtcatactgtcactgctctggactgtgtggagctcgctaaagtcatggtcattgcaggaatccaagtggcagtccttctcattcattctaatcattgtatgtgcttcactacgggggggagaaggaaacgttagcatcatgtttcccatttagggcaggagtgagaggtctctcttcctgatttagatatgcaaaagctggtatgttcagtaggaactgtacatgtgttgggaggcataaagactaattagcaaccataatatggtcactaccctaatagactaaatgaaatcttgcaatttcaaattactctttctccatattagatttacccacagctatatttctgtttaagtactagggtgagggttttctgttactttgttttttaatgttgttccttttgaaagaatcagtcttgcagctgagtgaaaaatctgtggaatgtattatttgtcctctttacatgaaactactcatacttaagcaaaagtcagtcttatagcaagactgttagccctcaaacttgactctactgatctgaccatttccctctcatcgccagacaactgacgatttccctggttttagtctgcgtctctgctttaaagttattgtgatatccttctagatcatacacaagtctaacagttaattagttaacagtttttaaactaggtttgtgggtatttttttggtagcacatgtatgctattacatacaaatttttatttctaaaatataagatctgagattgaatattttcattaaaagctacagttttgtgaatctttgtgcttcaacattctttgcaagatgatacggtatttaggcatttgccttatttttgcatctcacaaacataagtgcaatagatcttttcattgaacagcaaagtaggattcatcattccatatgacttgagttacaccagacctgttctgcccaatgcctttttgattacagtgtagcttgcccaccgcatttgtcgttttagatactttgctagccggccactttggatttcatcagacagtcctaacaatattgtctgaacggctgaatatgaatagatacagcagaggcactcctgatatatgatttttatccatgcgtcagtttttcccacccagtgtagcatcctaaagataaagccagaagctaagctgcagtgaggctgtgattgggcgtagaagtgggagcattgggacctcacattacacacacgagagatcataaccatgtgaaaaggcaaaaagcatgtgtttgcaacatctgataacttcatggcctttgataaatgtatatatgtatatgtgcatggactgtgtttccagtacacctttcagccaaaacagatccacagtagttgttgagttcaagtacataaagtacataacaagcgaacgtctagtacaattcttacttatgtgtatgggatttttccctttgaggttgctttgttttgtcttacaaaggtgaaaattgtttgtaagtgaagtgagaagttcatatttctttggcttttttgtgtttttaaaagttactccttttagggagctggtctgatgacttgcttagcttggaaatccttgttttcagtgtgtcgagtcaaaatgtgtttatgtgagctgtcactgtggggaaccaattgctttgtcatatagctggttatgaactagtaacatgtttgggaagtcctactgatgttcctttggaagaaaaaatctgctggttttaacaactgtgcttttgctatgtatggtatccaagttagttgaaacgcagacactgagatctgtttgagtttagggtcatttttagaaaggggcagtttaaagcacaatgtctcacatgggacaaagttccaaaatgccaaattcttattttttaaaaagctagttctataaaatactggtattatgggtggggaggaaatagaattgagtcaattggaaagactatccaacttaacatgaaacttgtcaccatgagatagcattagctgcccaggatgctgctatatatatatatatatatatatatgtgtgtgtgtgtgtgtgtgtgtgtgtatatatatatatatatatatatatatatatatatatatatgtgtgtgtatatatatatatatgtgtatatatatatgtatatacatatatgtatatatatgcacatatatatatgtatttaaaaaaatcaaaacaaaaaaaaactcatttatacctgtgtattttttaaagctacaatctgttcaatgtttttaaaaatctgtttatatgacattgttaaaataaagttggtcttttgacgagagggaggatgtcacggtcagttgtaactttgccttcacaaggcaactggggtggggggtgggggtagtgtgcctccttgacatttcgttcaagttatagattcaatggagctatgtcttgttttaagttgctttaatgcattgtattagatcttcaaacagaataaaggttgttttgaaactg

SEQ ID NO: 3088 - DNA, 2625 bp, Homo sapiens
atctttatctaagggagacgtgcgagcgcctgggctcctttcctccccgatacagtagcgaaatccagttggcttctcaatgaggagccggcagtgagcggcggtggcccggacgcactgccgggcggggcgtggggcggagggacgagccgagccgagccaagcggagctgggccactgtgcacgcccggagggtcctggcggcgcccccgctcctgcgcgcactctcggcgccggacacgagcactgcctgccgggaacaggctggggggaggtgcgggggcttggcccacttggtggaagaacagctttggggattttttttttttcattgtcggatacaggcatttcaaagggaaaccgttgaaatgcataacctgcaaacactgcctcctaaaccaccaaaacctactactgtagccaacaacggtatgaataacaatatgtccttacaagatgctgaatggtactggggagatatctcgagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactgaagaccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagtaaaaaaaaaaaa

SEQ ID NO: 3089 - DNA, 2439 bp, Homo sapiens
tataggttttaaaatgaattccaagacaccattacaaagaaagccggactcttttcttataactgagctcagccaaggaaactcttgcacaaatgtacaatactgtttggaatatggaagacctggatttagaatatgccaagacagatataaattgtggcacagacttgatgttttatatagaaatggacccaccagcactgcctcctaaaccaccaaaacctactactgtagccaacaacggtatgaataacaatatgtccttacaagatgctgaatggtactggggagatatctcgagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactgaagaccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagtaaaaaaaaaaaa

SEQ ID NO: 3090 - DNA, 6459 bp, Homo sapiens
tacaaccaggctcaactgttgcatggtagcagatttgcaaacatgagtgctgaggggtaccagtacagagcgctgtatgattataaaaaggaaagagaagaagatattgacttgcacttgggtgacatattgactgtgaataaagggtccttagtagctcttggattcagtgatggacaggaagccaggcctgaagaaattggctggttaaatggctataatgaaaccacaggggaaaggggggactttccgggaacttacgtagaatatattggaaggaaaaaaatctcgcctcccacaccaaagccccggccacctcggcctcttcctgttgcaccaggttcttcgaaaactgaagcagatgttgaacaacaagctttgactctcccggatcttgcagagcagtttgcccctcctgacattgccccgcctcttcttatcaagctcgtggaagccattgaaaagaaaggtctggaatgttcaactctatacagaacacagagctccagcaacctggcagaattacgacagcttcttgattgtgatacaccctccgtggacttggaaatgatcgatgtgcacgttttggctgacgctttcaaacgctatctcctggacttaccaaatcctgtcattccagcagccgtttacagtgaaatgatttctttagctccagaagtacaaagctccgaagaatatattcagctattgaagaagcttattaggtcgcctagcatacctcatcagtattggcttacgcttcagtatttgttaaaacatttcttcaagctctctcaaacctccagcaaaaatctgttgaatgcaagagtactctctgaaattttcagccctatgcttttcagattctcagcagccagctctgataatactgaaaacctcataaaagttatagaaattttaatctcaactgaatggaatgaacgacagcctgcaccagcactgcctcctaaaccaccaaaacctactactgtagccaacaacggtatgaataacaatatgtccttacaagatgctgaatggtactggggagatatctcgagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactgaagaaaactttctgtcctgcctgcctagccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagtaaaaaaaaaaaatggcttcagaattaaaactatgaaatattttacagtttttcttgtacagagtacttggctgttagcccaaggttaaaaagttcataacagattttttttggactgttttgttgggcagtgcctgataagcttcaaagctgctttattcaataaaaaaaagaaatgaaaaagatatatgaatatgacaaagtattgctgagtccaacaatgttgttttaagactcttaaaatacggtacctggcaatgtttatttcataaagaattgtgaacttcttgaatctagggagggggaatgtagtgaagggatgtatcaagtggggtggtgggagggggaggcaaggttatatgcactttctcatgatttacagagaagtgaataactgcaaagtgaagttgcttcttctacttcagtcttctctcactttgatttgctagttgttatcaattaatgacaattacaaacctactgtatctctaatacagtgtgactggtcaggtatttcagttcttaggaaggaagtgccaagtttgtttttgggttcctggaacagcgctcacctttgtttagaacactggtttaaagggataatcatctctgtcacattagactatccatcatgaccagcaaatactcattttaggaaaaaaaaaagcatgatctgaaaaatacttttggtggtatgttggttaccctcctagctttccatttggtttagaacataaagcaaatagacacagtcatactgtcactgctctggactgtgtggagctcgctaaagtcatggtcattgcaggaatccaagtggcagtccttctcattcattctaatcattgtatgtgcttcactacgggggggagaaggaaacgttagcatcatgtttcccatttagggcaggagtgagaggtctctcttcctgatttagatatgcaaaagctggtatgttcagtaggaactgtacatgtgttgggaggcataaagactaattagcaaccataatatggtcactaccctaatagactaaatgaaatcttgcaatttcaaattactctttctccatattagatttacccacagctatatttctgtttaagtactagggtgagggttttctgttactttgttttttaatgttgttccttttgaaagaatcagtcttgcagctgagtgaaaaatctgtggaatgtattatttgtcctctttacatgaaactactcatacttaagcaaaagtcagtcttatagcaagactgttagccctcaaacttgactctactgatctgaccatttccctctcatcgccagacaactgacgatttccctggttttagtctgcgtctctgctttaaagttattgtgatatccttctagatcatacacaagtctaacagttaattagttaacagtttttaaactaggtttgtgggtatttttttggtagcacatgtatgctattacatacaaatttttatttctaaaatataagatctgagattgaatattttcattaaaagctacagttttgtgaatctttgtgcttcaacattctttgcaagatgatacggtatttaggcatttgccttatttttgcatctcacaaacataagtgcaatagatcttttcattgaacagcaaagtaggattcatcattccatatgacttgagttacaccagacctgttctgcccaatgcctttttgattacagtgtagcttgcccaccgcatttgtcgttttagatactttgctagccggccactttggatttcatcagacagtcctaacaatattgtctgaacggctgaatatgaatagatacagcagaggcactcctgatatatgatttttatccatgcgtcagtttttcccacccagtgtagcatcctaaagataaagccagaagctaagctgcagtgaggctgtgattgggcgtagaagtgggagcattgggacctcacattacacacacgagagatcataaccatgtgaaaaggcaaaaagcatgtgtttgcaacatctgataacttcatggcctttgataaatgtatatatgtatatgtgcatggactgtgtttccagtacacctttcagccaaaacagatccacagtagttgttgagttcaagtacataaagtacataacaagcgaacgtctagtacaattcttacttatgtgtatgggatttttccctttgaggttgctttgttttgtcttacaaaggtgaaaattgtttgtaagtgaagtgagaagttcatatttctttggcttttttgtgtttttaaaagttactccttttagggagctggtctgatgacttgcttagcttggaaatccttgttttcagtgtgtcgagtcaaaatgtgtttatgtgagctgtcactgtggggaaccaattgctttgtcatatagctggttatgaactagtaacatgtttgggaagtcctactgatgttcctttggaagaaaaaatctgctggttttaacaactgtgcttttgctatgtatggtatccaagttagttgaaacgcagacactgagatctgtttgagtttagggtcatttttagaaaggggcagtttaaagcacaatgtctcacatgggacaaagttccaaaatgccaaattcttattttttaaaaagctagttctataaaatactggtattatgggtggggaggaaatagaattgagtcaattggaaagactatccaacttaacatgaaacttgtcaccatgagatagcattagctgcccaggatgctgctatatatatatatatatatatatatgtgtgtgtgtgtgtgtgtgtgtgtgtatatatatatatatatatatatatatatatatatatatatgtgtgtgtatatatatatatatgtgtatatatatatgtatatacatatatgtatatatatgcacatatatatatgtatttaaaaaaatcaaaacaaaaaaaaactcatttatacctgtgtattttttaaagctacaatctgttcaatgtttttaaaaatctgtttatatgacattgttaaaataaagttggtcttttgacgagagggaggatgtcacggtcagttgtaactttgccttcacaaggcaactggggtggggggtgggggtagtgtgcctccttgacatttcgttcaagttatagattcaatggagctatgtcttgttttaagttgctttaatgcattgtattagatcttcaaacagaataaaggttgttttgaaactg

SEQ ID NO: 3091 - DNA, 7011 bp, Homo sapiens
gcgccgggcgctggagctgcgggcgcacggagaggagtcgccagcagctggagcggagttggaggaagcagcggcagcggcgagggcggcaggctagctgtcggagacggcaagcacggatcgggcacggccggcgggtcgcagccgggctggaggccggtcggaaccgagcgggcaggaggccaccgctgcagcgcgggccccgcagaggaaggaagccggcgggcggggtgaagctcgtgtgtggagtgccacggtacaatcagacgacagatggacagtgtgacaaaagtgtcagaaaggattgggcctcgctgtgagagtcagcctggattcaaagtgttgacaagttgctgaaaaggaagccagtgagaggactgtggcacgcagaggaagtggagccctgtcttcggtcacaccattgatggaggacagatggacagccgtatggccagtcacctctcctcttaaacctttggagagtggtcctttgtcctctgctggacacataataggaattctaacacattctctgaattcacttttcataaaaacgtaaaatcagactgctctgtacaaccaggctcaactgttgcatggtagcagatttgcaaacatgagtgctgaggggtaccagtacagagcgctgtatgattataaaaaggaaagagaagaagatattgacttgcacttgggtgacatattgactgtgaataaagggtccttagtagctcttggattcagtgatggacaggaagccaggcctgaagaaattggctggttaaatggctataatgaaaccacaggggaaaggggggactttccgggaacttacgtagaatatattggaaggaaaaaaatctcgcctcccacaccaaagccccggccacctcggcctcttcctgttgcaccaggttcttcgaaaactgaagcagatgttgaacaacaagctttgactctcccggatcttgcagagcagtttgcccctcctgacattgccccgcctcttcttatcaagctcgtggaagccattgaaaagaaaggtctggaatgttcaactctatacagaacacagagctccagcaacctggcagaattacgacagcttcttgattgtgatacaccctccgtggacttggaaatgatcgatgtgcacgttttggctgacgctttcaaacgctatctcctggacttaccaaatcctgtcattccagcagccgtttacagtgaaatgatttctttagctccagaagtacaaagctccgaagaatatattcagctattgaagaagcttattaggtcgcctagcatacctcatcagtattggcttacgcttcagtatttgttaaaacatttcttcaagctctctcaaacctccagcaaaaatctgttgaatgcaagagtactctctgaaattttcagccctatgcttttcagattctcagcagccagctctgataatactgaaaacctcataaaagttatagaaattttaatctcaactgaatggaatgaacgacagcctgcaccagcactgcctcctaaaccaccaaaacctactactgtagccaacaacggtatgaataacaatatgtccttacaagatgctgaatggtactggggagatatctcgagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactgaagaccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagtaaaaaaaaaaaatggcttcagaattaaaactatgaaatattttacagtttttcttgtacagagtacttggctgttagcccaaggttaaaaagttcataacagattttttttggactgttttgttgggcagtgcctgataagcttcaaagctgctttattcaataaaaaaaagaaatgaaaaagatatatgaatatgacaaagtattgctgagtccaacaatgttgttttaagactcttaaaatacggtacctggcaatgtttatttcataaagaattgtgaacttcttgaatctagggagggggaatgtagtgaagggatgtatcaagtggggtggtgggagggggaggcaaggttatatgcactttctcatgatttacagagaagtgaataactgcaaagtgaagttgcttcttctacttcagtcttctctcactttgatttgctagttgttatcaattaatgacaattacaaacctactgtatctctaatacagtgtgactggtcaggtatttcagttcttaggaaggaagtgccaagtttgtttttgggttcctggaacagcgctcacctttgtttagaacactggtttaaagggataatcatctctgtcacattagactatccatcatgaccagcaaatactcattttaggaaaaaaaaaagcatgatctgaaaaatacttttggtggtatgttggttaccctcctagctttccatttggtttagaacataaagcaaatagacacagtcatactgtcactgctctggactgtgtggagctcgctaaagtcatggtcattgcaggaatccaagtggcagtccttctcattcattctaatcattgtatgtgcttcactacgggggggagaaggaaacgttagcatcatgtttcccatttagggcaggagtgagaggtctctcttcctgatttagatatgcaaaagctggtatgttcagtaggaactgtacatgtgttgggaggcataaagactaattagcaaccataatatggtcactaccctaatagactaaatgaaatcttgcaatttcaaattactctttctccatattagatttacccacagctatatttctgtttaagtactagggtgagggttttctgttactttgttttttaatgttgttccttttgaaagaatcagtcttgcagctgagtgaaaaatctgtggaatgtattatttgtcctctttacatgaaactactcatacttaagcaaaagtcagtcttatagcaagactgttagccctcaaacttgactctactgatctgaccatttccctctcatcgccagacaactgacgatttccctggttttagtctgcgtctctgctttaaagttattgtgatatccttctagatcatacacaagtctaacagttaattagttaacagtttttaaactaggtttgtgggtatttttttggtagcacatgtatgctattacatacaaatttttatttctaaaatataagatctgagattgaatattttcattaaaagctacagttttgtgaatctttgtgcttcaacattctttgcaagatgatacggtatttaggcatttgccttatttttgcatctcacaaacataagtgcaatagatcttttcattgaacagcaaagtaggattcatcattccatatgacttgagttacaccagacctgttctgcccaatgcctttttgattacagtgtagcttgcccaccgcatttgtcgttttagatactttgctagccggccactttggatttcatcagacagtcctaacaatattgtctgaacggctgaatatgaatagatacagcagaggcactcctgatatatgatttttatccatgcgtcagtttttcccacccagtgtagcatcctaaagataaagccagaagctaagctgcagtgaggctgtgattgggcgtagaagtgggagcattgggacctcacattacacacacgagagatcataaccatgtgaaaaggcaaaaagcatgtgtttgcaacatctgataacttcatggcctttgataaatgtatatatgtatatgtgcatggactgtgtttccagtacacctttcagccaaaacagatccacagtagttgttgagttcaagtacataaagtacataacaagcgaacgtctagtacaattcttacttatgtgtatgggatttttccctttgaggttgctttgttttgtcttacaaaggtgaaaattgtttgtaagtgaagtgagaagttcatatttctttggcttttttgtgtttttaaaagttactccttttagggagctggtctgatgacttgcttagcttggaaatccttgttttcagtgtgtcgagtcaaaatgtgtttatgtgagctgtcactgtggggaaccaattgctttgtcatatagctggttatgaactagtaacatgtttgggaagtcctactgatgttcctttggaagaaaaaatctgctggttttaacaactgtgcttttgctatgtatggtatccaagttagttgaaacgcagacactgagatctgtttgagtttagggtcatttttagaaaggggcagtttaaagcacaatgtctcacatgggacaaagttccaaaatgccaaattcttattttttaaaaagctagttctataaaatactggtattatgggtggggaggaaatagaattgagtcaattggaaagactatccaacttaacatgaaacttgtcaccatgagatagcattagctgcccaggatgctgctatatatatatatatatatatatatgtgtgtgtgtgtgtgtgtgtgtgtgtatatatatatatatatatatatatatatatatatatatatgtgtgtgtatatatatatatatgtgtatatatatatgtatatacatatatgtatatatatgcacatatatatatgtatttaaaaaaatcaaaacaaaaaaaaactcatttatacctgtgtattttttaaagctacaatctgttcaatgtttttaaaaatctgtttatatgacattgttaaaataaagttggtcttttgacgagagggaggatgtcacggtcagttgtaactttgccttcacaaggcaactggggtggggggtgggggtagtgtgcctccttgacatttcgttcaagttatagattcaatggagctatgtcttgttttaagttgctttaatgcattgtattagatcttcaaacagaataaaggttgttttgaaactgaa

SEQ ID NO: 3092 - DNA, 540 bp, Homo sapiens
ttcattgtcggatacaggcatttcaaagggaaaccgttgaaatgcataacctgcaaaggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagaccca

SEQ ID NO: 3093 - DNA, 3891 bp, Homo sapiens
agttggaggaagcagcggcagcggcgagggcggcaggctagctgtcggagacggcaagcacggatcgggcacggccggcgggtcgcagccgggctggaggccggtcggaaccgagcgggcaggaggccaccgctgcagcgcgggccccgcagaggaaggaagccggcgggcggggtaggtgaagctcgtgtgtggagtgccacggtacaatcagacgacagatggacagtgtgacaaaagtgtcagaaaggattgggcctcgctgtgagagtcagcctggattcaaagtgttgacaagttgctgaaaaggaagccagtgagaggactgtggcacgcagaggaagtggagccctgtcttcggtcacaccattgatggaggacagatggacagccgtatggccagtcacctctcctcttaaacctttggagagtggtcctttgtcctctgctggacacataataggaattctaacacattctctgaattcacttttcataaaaacgtaaaatcagactgctctgtacaaccaggctcaactgttgcatggtagcagatttgcaaacatgagtgctgaggggtaccagtacagagcgctgtatgattataaaaaggaaagagaagaagatattgacttgcacttgggtgacatattgactgtgaataaagggtccttagtagctcttggattcagtgatggacaggaagccaggcctgaagaaattggctggttaaatggctataatgaaaccacaggggaaaggggggactttccgggaacttacgtagaatatattggaaggaaaaaaatctcgcctcccacaccaaagccccggccacctcggcctcttcctgttgcaccaggttcttcgaaaactgaagcagatgttgaacaacaagctttgactctcccggatcttgcagagcagtttgcccctcctgacattgccccgcctcttcttatcaagctcgtggaagccattgaaaagaaaggtctggaatgttcaactctatacagaacacagagctccagcaacctggcagaattacgacagcttcttgattgtgatacaccctccgtggacttggaaatgatcgatgtgcacgttttggctgacgctttcaaacgctatctcctggacttaccaaatcctgtcattccagcagccgtttacagtgaaatgatttctttagctccagaagtacaaagctccgaagaatatattcagctattgaagaagcttattaggtcgcctagcatacctcatcagtattggcttacgcttcagtatttgttaaaacatttcttcaagctctctcaaacctccagcaaaaatctgttgaatgcaagagtactctctgaaattttcagccctatgcttttcagattctcagcagccagctctgataatactgaaaacctcataaaagttatagaaattttaatctcaactgaatggaatgaacgacagcctgcaccagcactgcctcctaaaccaccaaaacctactactgtagccaacaacggtatgaataacaatatgtccttacaagatgctgaatggtactggggagatatctcgagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactgaagaccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagtaaaaaaaaaaaatggcttcagaattaaaactatgaaatattttacagtttttcttgtacagagtacttggctgttagcccaaggttaaaaagttcataacagattttttttggactgttttgttgggcagtgcctgataagcttcaaagctgctttattcaataaaaaaaagaaatgaaaaa

SEQ ID NO: 3094 - DNA, 4026 bp, Homo sapiens
ccgcccggctcgaatgcgctcgggcatttccgccgggggcgggccaggccgctcggaaccgtggcggcggcggaggcggggatcccgcggctgcggcgacggtggccgcggtggagccacggggcgggcttggcttggtgtgacggcggctgcggcggcggtggcggccgcgaccaggtcggcgtcctcagctggccgagcatggtggcagcctgcacccttggctcccttgtctggtgcagccagcagagccgccagccttgggcgcccatggccctccgtgtgagggcgtgagcggcctgccccagcctcacctgctgatggaggactcaatggcccagtgacctgacaccacaccaccaactccctcccaccagctgacgaatggtggacccagtgacgagtggcccttgtaagggtcatggaataatttgaagcgaggcatgagcggcccctgtggtcgcctgtgactgctggagatagaggtcccagcaccccaagccaacccagcggaccctcccagccctgcttcaaccaatggggccagtggggctccaagcagccacctaaccatccagaccccaccccactcacgcggccatggcgggccctgagggcttccagtaccgcgctctgtacccgttccgccgggagcggccggaggacctggagctgctgcccggcgacgtgctggtagtgagccgggcggccttgcaggcgctgggcgtggccgagggtggcgagcgctgcccacagagcgtgggctggatgcccggcctcaacgagcgcacacggcagcgaggtgacttccctggcacctatgtggagttcctggggcccgtggccctggcccggcccggccctcgcccacggggcccccgcccactgcccgccaggccccgtgatggggcccctgagccaggcctcacactccccgacttgcccgagcagttctccccacctgatgtggctccccctcttctggtgaagcttgtggaggccattgaaaggacagggctggacagcgaatctcactaccgcccggagctgcccgcaccgcgtacagactggtccctgagcgacgtggatcagtgggacacggcagccctggctgacggcattaagagcttcctgctggcactgcccgcgccgctcgtgacccccgaggcctcggccgaggcgcgccgggccctgcgggaggccgcggggcccgtggggccggcgctggagccaccgacgctgccgctgcaccgcgcgctcacgctgcgcttcctgctccagcacctgggccgcgtggccagccgcgccccggccctgggtcccgcggtccgggccctgggcgccacctttgggccgctgctgctgcgcgcgccgccgccgccgtcctcgccgccgccagggggcgctcccgacgggagtgagcccagccctgacttcccggcgctgctggtggagaagctgcttcaggaacacttggaagagcaggaggttgcgcccccagcgctgccgcctaaaccccccaaggcaaagccggcctccacagtcctggccaatggagggagcccaccctccctgcaggatgctgagtggtactggggggacatttcaagggaggaggtgaacgagaaactccgggacactcccgatggcaccttcctagtccgagatgcttctagcaagatccagggcgagtacacgctgaccctcaggaaaggcgggaacaataagctgatcaaggtcttccaccgagatgggcactatggcttctcagagccactcaccttctgctccgttgtggacctcatcaatcactaccgccacgagtctctggcccagtacaatgccaagctggacacacggctcctctaccctgtgtccaaataccagcaggaccagattgtcaaggaggacagcgtggaggcagtgggcgcccagcttaaggtctatcaccagcagtaccaggacaagagccgcgagtatgaccagctttatgaagagtacacacggacctcccaggagctgcagatgaagcgtactgcaattgaggccttcaatgagactatcaagatctttgaagagcagggccagactcaagagaaatgcagcaaggaatacctggagcgcttccggcgtgagggcaacgagaaagagatgcaaaggatcctgctgaactccgagcggctcaagtcccgcattgccgagatccatgagagccgcacgaagctggagcagcagctgcgggcccaggcctcggacaacagagagatcgacaagcgcatgaacagcctcaagccggacctcatgcagctgcgcaagatccgagaccagtacctcgtgtggctcacccagaaaggcgcccggcagaagaaaatcaacgagtggctggggattaaaaatgagactgaggaccagtacgcactcatggaggacgaggacgatctcccgcaccacgaggaacgcacttggtacgtgggcaagatcaaccgcacgcaggcagaggagatgctgagtggcaagcgggatggcaccttcctcatccgcgagagcagccagcggggctgctacgcctgctccgtggtagtggacggcgacaccaagcactgcgtcatctaccgcacggccaccggcttcggcttcgcggagccctacaacctgtacgggtcgctgaaggagctggtgctgcactaccagcacgcctcgctggtgcagcacaacgacgcgctcaccgtcaccctggcgcacccagtgcgcgccccgggccccggcccgccgcctgccgcccgctgagcaccgaggacccgccccaagcagagccgcccctgggcccgtctgcgccggaggctgcggcggcgggagccacggaccagaccagccacatccaggggtcctcatttctccggctctggctcttgtttggggttctctcaccctctttctctttccttccctcccccattctccagatctccctctgtctccttttctctgtctttcttggcccctgtctctctccatgttgggggtcctaactcccccaccccatatctacgtgtcctccgggcattgccctctccatggctctggtcaccctgaccctctgccctgcccaccgcaggtcccccggggtcccggaagccccttctggctgcacctgccatgtttacagagggcccctgggctgcgcggccccagcctgggcaccctgatttttaagccatagacctggggtcagggcaggaaggaacttcactctgctgcttccgagaacctcggccgtgacattcggggccgggcgggacccgccccacagactccaacttcccctccaaaccccgaagtgaaacccgccaccgggttacccccacaagggggccgctgcgagaagttcacccacccccgaaaaaataattaaactcgcaggccaggcacggtggctcatgcctgtaatcccagcactttgggaggccaagacgggcggatcttttgaggtcgggagttggaggccagcctggccaaaatggcaaaaccccgcatctactaaaatacaaaaattagccgggcgtggtggcggccgcctgtaatcccagctacttgggaggctgaggcgtgagaatctcttgaacccaggagatggaggttgcagtgagcagagatcgtgccactgcactccagcctgggtaacagagggagactcctccgtctcaaaaaaataaataaataaacttgtgagctggccccaacccctcctaggaatcacagctccccgtactggtgccgccgcagtggccaagttgcgacactgcccacggcccctccctctgatgcagattcagggcttctcttcgatcatgttgggttttgattctgtttttccttgactgcaaaaccctctttcctctcctcttttgggacaagagccctggttttctacgctgcccttggccaccacactgcctgccccacgagctgggaggcaggttttgtacggtacgttgttattgatatgatataaaacatcaaacgtcg

SEQ ID NO: 3095 - DNA, 5609 bp, Homo sapiens
gtggctggagtccgggcagagcttgagggcagttggtgcggtcgggttggttcttacaccccggcgggagcgcccagacaagccgagctgactggacttctccggccggccccattcccgaggctgcggcagcttcggttccgagaccgaccggagaggagcccgagtcccggcctctgggggattcgctctctgcagaccagtgggaccccgaaacttgaacgcaatctccagcccccttttttgccttcctttgtcacttgcccgggtttctcccaacgtgttcttttttttcctcttcattctccctccttcgaaggacacaaaagtggcttccgcggaaagatttggaggcggtgggagcttttctccccggagagcgactgtgtagaaaggatttttgggaagccgctttttaacacctctgctctccgtcccccaagcctctgtgtaatcctctgaggagaaaagcccatagcttgaaagttcgggggcattttgttgtgttctgtaggagagagggggaggaccctgttcgggtagtttggccggactggtactggccgttggaaaacccgaagtacatttccgtgtggaacttttgcagatatatatttttagatttttaaataccagataaaaaatatatgccttctatatatctcctggcgacctgcccctgacagcgcgatgtacaatacggtgtggagtatggaccgcgatgacgcagactggagggaggtgatgatgccctattcgacagaactgatattttatattgaaatggatcctccagctcttccaccaaagccacctaagccaatgacttcagcagttccaaatggaatgaaggacagttctgtttctcttcaggatgcagaatggtactggggggatatttcaagggaggaggtaaatgacaaattgcgggatatgccagatgggaccttcttggtccgagatgcctcaacaaaaatgcagggagattatactttgactttgcggaagggaggcaataataagttaataaagatctatcaccgggatggtaaatatggcttttctgatcctctgacatttaattccgtggtggagctcattaaccactatcaccatgaatctcttgctcagtacaatcccaaacttgatgtgaagctgatgtacccagtgtccagataccaacaggatcagttggtaaaagaagataatattgatgcagtaggtaaaaaactgcaagaataccactctcagtatcaggagaagagtaaagagtatgataggctgtatgaagaatatactagaacatcccaggaaatacagatgaagaggactgcaatagaagcttttaatgaaacaattaaaatatttgaagagcagtgtcacacacaagaacaacatagcaaagaatatattgagcgatttcgcagagaggggaatgaaaaggagattgaacgaattatgatgaattatgataaattgaaatcacgtctgggtgagattcatgatagcaaaatgcgtctagagcaggatttgaagaatcaagctttggacaaccgagaaatagataaaaaaatgaatagcatcaaacctgacctgatccagctgcgaaagatccgagatcaacaccttgtatggctcaatcacaaaggagtgagacagaaacgcctgaatgtctggctgggaattaagaatgaggatgctgatgagaactattttatcaatgaggaagatgaaaacctgccccattatgatgagaaaacctggtttgttgaggatatcaatcgagtacaagcagaggacttgctttatgggaaacctgatggtgcattcttaattcgtgagagtagcaagaaaggatgctatgcttgctctgtggtggccgatggggaagtgaagcactgtgtgatctacagcactgctcggggctatggctttgcagagccctacaacctgtacagctctctgaaggagctagtgctccattaccagcagacatccttggttcagcacaacgactccctcaacgtcaggcttgcctaccctgttcatgcacagatgccctcgctttgcagataaagaggaagtgggaagagaggtggttctctggcatttttttctacagtttttattagactacgatgagggcattctttctacatagactgcttgttttgcacaagaagtgattttgtgaatgtgaagtggagaggccgagcagcagccggccgggatgggggcattagaggcctgaggttctctaggactcagccatgccgctgcactgacatactaagctggaagcagatgttttttttgaaagtctgtttcattggggtttttgttttgtttagccagacaccctcaacagaatattaggcttgatggttatagcgggtggggttgtatttggaagcctctgaagagaccatgtctttttaaaatctaactcttgagagtgcagcaggggcatggctctgctgggagttgtgttttgctttggcagtctctcttccccccacgaagaaggctgtttaggttttgtgatagaatgggatttgatgaaaaagacaaccaaaggaaaatggggaggcttgggatttcatttaaataatctaagccaagatgataaaaaaaaccttcaactgaaggtattttgtttcttaccaacataatttaggcttcagcatctcaccagcccctccctctgaagaagtattatgttcagaagccaacaaaacagtttgttgccagaccaatgtttgatgggaaaacgtggcactcatagttgaatgtatacttctgtaccaaaacttgaacataaaaagactagaatttgtgagttttagcaaacgctaaaattgatcactgtaactaaccccttctgtccttcctgcctgtttctctgagatgaggaatagcattctttttgtggggatggtgagctttgaatcataaaatgaagttggtgcttgtatggtgtttccttagcctaaagaatgatctgttgtttgaaacctttgtaacttgtttgtatgagtaaagaaaaggtgcaatgcagtgcttttagatggcttgatataccaaataacaatatagaacaacattattatatgtgcttccccaagtttaaaggccctgcagaaatagtaaacatggtttaatttcccttcatttccccctcctttgctggatggggttttgggagctataggttgctaaggaggggagtcagattgtggtcaggtgcctcagtaaatcacagacccaggggccctgtggtccagggtgagagtcacaccacattacacatgtgcttccatacagtggtttctgaagcttttgcagggagagaagatggcttagtgtttagactgttagtagaagccatctggaagcttttctctttgcctttttttgtgatcctgccattaaggctatgtgcagtctgccctcctgctccagtggccttgattttaggccaggaatcttctgctccatgtggcttaagccttccagctgagtgaagctaggcaaatggagtgggggcaggcatctattcctgcccccatcatgccccacacccatcagtcaacactcatttgacaaatagagtccagctgcctctgagccaatcctgggaccataataggctcagagtgagtcagctgtttgaacccaaagctgtgcagtcaggcaccctggctgagctagagaagccagtacctgcatcttggtttataaggcttacagctaggaaagctctagttctgggggtgaaagaaaaatattagtttacctgagcacttatttccatgacagggtctaaaatatggaccatgatgtagacacagatttttaattttggaaaaacctccagttactagtgacgaggatagaaagggaagtgcttctctttggctttttcttggttacactgcagtttcaggattgggtgagacagagacaaatgaacccccctctaaagtcatttaactaatagccagcacatcccttccccaaactgtcaattgaaatcttaactgaaagttttactgaataataccaagctaattgctgttgggcacacctggatggctttgcacctggtgttgaacctgctgaagcaggtggatgctcaagattacgtgcaaggaatccctcccatctggtactaaaatttcagtgtgttctgagtgtcttttaaaccaaaatggaaatacagatacagggctgtagtattcagtaatgtgtctgctccttgttgggcagacaccagcggtgtgcagggagagaccaagtaccatctttatctacacttgggctggcttgtggagaagggctgctttttttcagtcctacattccttcattttttttttcattcttgaattcattgttttgtgggatctaagacccaggggtcatttgagaggtttgacagtatcttttctgaccagttgccacatgacttgcttgaccctgagcctgtggaaatggcatagggaccagtctactacccactgggcctggtgtgtagagggggagagggtagcaaggtgcttctctacgcccatgacttgggagcaggtcttggcctccttcatgagagtctagtgccatgtcctgtcccatgatctggaccctgggactgtcttggcatcttaactgcagtttcaatgaggcagagggcaaagagagaccaagatcagaggggttcattatacccctggctagagaacccagctactgacatgcaagcagcttggggctggctggacacaggtactaggcccattgtttccaggtgaagctttcatcacagaacagtgttgtctccacctggccttagatggcacgccatgattcgggcctggatagactgcctgcgtccttaccactgatctggccaagaatgaggccctcccaacactttcactccctctccaagccttgatgggacctccacttatttaggcctcatgtgctttgaagaagctttgagagccaatgtgtcttccacgggtctcttttttgctacaagtaatcagccccatgtgttctcttaaactgagaattgcacctgggcaattcctgttttctaaggtggtctctgctgctatttaacaacccagagtaggcctctgtgaggcttcagtggcctcagaaaccagagggtccagatagggggcctgcttgggccctctgctgccaactgctcaaacctgctttagctccagccacttgtggcaaacaacctcgtttccttacaaattccagcatgtgactttggtgccgttacttgtgaaaaatctattctgttgtctttgatgtgtccaagaaaattcgtgtagtttacgtaaaaatatctgactcacaagaaagccaactgtatgtcttgtgatgggacagttcataatgtagttgctagaccactttacaaattgttcttgtcaccagatgtgttcagacattgctgtgcaattgttggggagggtagggggaaaggcgagaggagatacttattggtctttttgtttaataccttccccaagaggggacagtctggccaacttgctccagtaatgcaataaagacattgcaataaagtaa

SEQ ID NO: 3096 - DNA, 4889 bp, Homo sapiens
aaccggcctcagccaatcaccacccaccttgcctctcttccctcgccccactccctcctcgcctggctcgcgtgctcccggcactgactcctggagtgcggccagcgcccggatcgtaccattctgattgaggctgggggagagcgcggatggctgattggggagccgaagcctagagagcggtggggagacgtgaaagtcgagatggagagcagctttttgaacatgttctcaggcacttgacagaatcccgcgcgatgtacaatacggtgtggagtatggaccgcgatgacgcagactggagggaggtgatgatgccctattcgacagaactgatattttatattgaaatggatcctccagctgcggaggtaaatgacaaattgcgggatatgccagatgggaccttcttggtccgagatgcctcaacaaaaatgcagggagattatactttgactttgcggaagggaggcaataataagttaataaagatctatcaccgggatggtaaatatggcttttctgatcctctgacatttaattccgtggtggagctcattaaccactatcaccatgaatctcttgctcagtacaatcccaaacttgatgtgaagctgatgtacccagtgtccagataccaacaggatcagttggtaaaagaagataatattgatgcagtaggtaaaaaactgcaagaataccactctcagtatcaggagaagagtaaagagtatgataggctgtatgaagaatatactagaacatcccaggaaatacagatgaagaggactgcaatagaagcttttaatgaaacaattaaaatatttgaagagcagtgtcacacacaagaacaacatagcaaagaatatattgagcgatttcgcagagaggggaatgaaaaggagattgaacgatggctcaatcacaaaggagtgagacagaaacgcctgaatgtctggctgggaattaagaatgaggatgctgatgagaactattttatcaatgaggaagatgaaaacctgccccattatgatgagaaaacctggtttgttgaggatatcaatcgagtacaagcagaggacttgctttatgggaaacctgatggtgcattcttaattcgtgagagtagcaagaaaggatgctatgcttgctctgtggtggccgatggggaagtgaagcactgtgtgatctacagcactgctcggggctatggctttgcagagccctacaacctgtacagctctctgaaggagctagtgctccattaccagcagacatccttggttcagcacaacgactccctcaacgtcaggcttgcctaccctgttcatgcacagatgccctcgctttgcagataaagaggaagtgggaagagaggtggttctctggcatttttttctacagtttttattagactacgatgagggcattctttctacatagactgcttgttttgcacaagaagtgattttgtgaatgtgaagtggagaggccgagcagcagccggccgggatgggggcattagaggcctgaggttctctaggactcagccatgccgctgcactgacatactaagctggaagcagatgttttttttgaaagtctgtttcattggggtttttgttttgtttagccagacaccctcaacagaatattaggcttgatggttatagcgggtggggttgtatttggaagcctctgaagagaccatgtctttttaaaatctaactcttgagagtgcagcaggggcatggctctgctgggagttgtgttttgctttggcagtctctcttccccccacgaagaaggctgtttaggttttgtgatagaatgggatttgatgaaaaagacaaccaaaggaaaatggggaggcttgggatttcatttaaataatctaagccaagatgataaaaaaaaccttcaactgaaggtattttgtttcttaccaacataatttaggcttcagcatctcaccagcccctccctctgaagaagtattatgttcagaagccaacaaaacagtttgttgccagaccaatgtttgatgggaaaacgtggcactcatagttgaatgtatacttctgtaccaaaacttgaacataaaaagactagaatttgtgagttttagcaaacgctaaaattgatcactgtaactaaccccttctgtccttcctgcctgtttctctgagatgaggaatagcattctttttgtggggatggtgagctttgaatcataaaatgaagttggtgcttgtatggtgtttccttagcctaaagaatgatctgttgtttgaaacctttgtaacttgtttgtatgagtaaagaaaaggtgcaatgcagtgcttttagatggcttgatataccaaataacaatatagaacaacattattatatgtgcttccccaagtttaaaggccctgcagaaatagtaaacatggtttaatttcccttcatttccccctcctttgctggatggggttttgggagctataggttgctaaggaggggagtcagattgtggtcaggtgcctcagtaaatcacagacccaggggccctgtggtccagggtgagagtcacaccacattacacatgtgcttccatacagtggtttctgaagcttttgcagggagagaagatggcttagtgtttagactgttagtagaagccatctggaagcttttctctttgcctttttttgtgatcctgccattaaggctatgtgcagtctgccctcctgctccagtggccttgattttaggccaggaatcttctgctccatgtggcttaagccttccagctgagtgaagctaggcaaatggagtgggggcaggcatctattcctgcccccatcatgccccacacccatcagtcaacactcatttgacaaatagagtccagctgcctctgagccaatcctgggaccataataggctcagagtgagtcagctgtttgaacccaaagctgtgcagtcaggcaccctggctgagctagagaagccagtacctgcatcttggtttataaggcttacagctaggaaagctctagttctgggggtgaaagaaaaatattagtttacctgagcacttatttccatgacagggtctaaaatatggaccatgatgtagacacagatttttaattttggaaaaacctccagttactagtgacgaggatagaaagggaagtgcttctctttggctttttcttggttacactgcagtttcaggattgggtgagacagagacaaatgaacccccctctaaagtcatttaactaatagccagcacatcccttccccaaactgtcaattgaaatcttaactgaaagttttactgaataataccaagctaattgctgttgggcacacctggatggctttgcacctggtgttgaacctgctgaagcaggtggatgctcaagattacgtgcaaggaatccctcccatctggtactaaaatttcagtgtgttctgagtgtcttttaaaccaaaatggaaatacagatacagggctgtagtattcagtaatgtgtctgctccttgttgggcagacaccagcggtgtgcagggagagaccaagtaccatctttatctacacttgggctggcttgtggagaagggctgctttttttcagtcctacattccttcattttttttttcattcttgaattcattgttttgtgggatctaagacccaggggtcatttgagaggtttgacagtatcttttctgaccagttgccacatgacttgcttgaccctgagcctgtggaaatggcatagggaccagtctactacccactgggcctggtgtgtagagggggagagggtagcaaggtgcttctctacgcccatgacttgggagcaggtcttggcctccttcatgagagtctagtgccatgtcctgtcccatgatctggaccctgggactgtcttggcatcttaactgcagtttcaatgaggcagagggcaaagagagaccaagatcagaggggttcattatacccctggctagagaacccagctactgacatgcaagcagcttggggctggctggacacaggtactaggcccattgtttccaggtgaagctttcatcacagaacagtgttgtctccacctggccttagatggcacgccatgattcgggcctggatagactgcctgcgtccttaccactgatctggccaagaatgaggccctcccaacactttcactccctctccaagccttgatgggacctccacttatttaggcctcatgtgctttgaagaagctttgagagccaatgtgtcttccacgggtctcttttttgctacaagtaatcagccccatgtgttctcttaaactgagaattgcacctgggcaattcctgttttctaaggtggtctctgctgctatttaacaacccagagtaggcctctgtgaggcttcagtggcctcagaaaccagagggtccagatagggggcctgcttgggccctctgctgccaactgctcaaacctgctttagctccagccacttgtggcaaacaacctcgtttccttacaaattccagcatgtgactttggtgccgttacttgtgaaaaatctattctgttgtctttgatgtgtccaagaaaattcgtgtagtttacgtaaaaatatctgactcacaagaaagccaactgtatgtcttgtgatgggacagttcataatgtagttgctagaccactttacaaattgttcttgtcaccagatgtgttcagacattgctgtgcaattgttggggagggtagggggaaaggcgagaggagatacttattggtctttttgtttaataccttccccaagaggggacagtctggccaacttgctccagtaatgcaataaagacattgcaataaagt

SEQ ID NO: 3097 - DNA, 4997 bp, Homo sapiens
aaccggcctcagccaatcaccacccaccttgcctctcttccctcgccccactccctcctcgcctggctcgcgtgctcccggcactgactcctggagtgcggccagcgcccggatcgtaccattctgattgaggctgggggagagcgcggatggctgattggggagccgaagcctagagagcggtggggagacgtgaaagtcgagatggagagcagctttttgaacatgttctcaggcacttgacagaatcccgcgcgatgtacaatacggtgtggagtatggaccgcgatgacgcagactggagggaggtgatgatgccctattcgacagaactgatattttatattgaaatggatcctccagctcttccaccaaagccacctaagccaatgacttcagcagttccaaatggaatgaaggacagttctgtttctcttcaggatgcagaatggtactggggggatatttcaagggaggaggtaaatgacaaattgcgggatatgccagatgggaccttcttggtccgagatgcctcaacaaaaatgcagggagattatactttgactttgcggaagggaggcaataataagttaataaagatctatcaccgggatggtaaatatggcttttctgatcctctgacatttaattccgtggtggagctcattaaccactatcaccatgaatctcttgctcagtacaatcccaaacttgatgtgaagctgatgtacccagtgtccagataccaacaggatcagttggtaaaagaagataatattgatgcagtaggtaaaaaactgcaagaataccactctcagtatcaggagaagagtaaagagtatgataggctgtatgaagaatatactagaacatcccaggaaatacagatgaagaggactgcaatagaagcttttaatgaaacaattaaaatatttgaagagcagtgtcacacacaagaacaacatagcaaagaatatattgagcgatttcgcagagaggggaatgaaaaggagattgaacgatggctcaatcacaaaggagtgagacagaaacgcctgaatgtctggctgggaattaagaatgaggatgctgatgagaactattttatcaatgaggaagatgaaaacctgccccattatgatgagaaaacctggtttgttgaggatatcaatcgagtacaagcagaggacttgctttatgggaaacctgatggtgcattcttaattcgtgagagtagcaagaaaggatgctatgcttgctctgtggtggccgatggggaagtgaagcactgtgtgatctacagcactgctcggggctatggctttgcagagccctacaacctgtacagctctctgaaggagctagtgctccattaccagcagacatccttggttcagcacaacgactccctcaacgtcaggcttgcctaccctgttcatgcacagatgccctcgctttgcagataaagaggaagtgggaagagaggtggttctctggcatttttttctacagtttttattagactacgatgagggcattctttctacatagactgcttgttttgcacaagaagtgattttgtgaatgtgaagtggagaggccgagcagcagccggccgggatgggggcattagaggcctgaggttctctaggactcagccatgccgctgcactgacatactaagctggaagcagatgttttttttgaaagtctgtttcattggggtttttgttttgtttagccagacaccctcaacagaatattaggcttgatggttatagcgggtggggttgtatttggaagcctctgaagagaccatgtctttttaaaatctaactcttgagagtgcagcaggggcatggctctgctgggagttgtgttttgctttggcagtctctcttccccccacgaagaaggctgtttaggttttgtgatagaatgggatttgatgaaaaagacaaccaaaggaaaatggggaggcttgggatttcatttaaataatctaagccaagatgataaaaaaaaccttcaactgaaggtattttgtttcttaccaacataatttaggcttcagcatctcaccagcccctccctctgaagaagtattatgttcagaagccaacaaaacagtttgttgccagaccaatgtttgatgggaaaacgtggcactcatagttgaatgtatacttctgtaccaaaacttgaacataaaaagactagaatttgtgagttttagcaaacgctaaaattgatcactgtaactaaccccttctgtccttcctgcctgtttctctgagatgaggaatagcattctttttgtggggatggtgagctttgaatcataaaatgaagttggtgcttgtatggtgtttccttagcctaaagaatgatctgttgtttgaaacctttgtaacttgtttgtatgagtaaagaaaaggtgcaatgcagtgcttttagatggcttgatataccaaataacaatatagaacaacattattatatgtgcttccccaagtttaaaggccctgcagaaatagtaaacatggtttaatttcccttcatttccccctcctttgctggatggggttttgggagctataggttgctaaggaggggagtcagattgtggtcaggtgcctcagtaaatcacagacccaggggccctgtggtccagggtgagagtcacaccacattacacatgtgcttccatacagtggtttctgaagcttttgcagggagagaagatggcttagtgtttagactgttagtagaagccatctggaagcttttctctttgcctttttttgtgatcctgccattaaggctatgtgcagtctgccctcctgctccagtggccttgattttaggccaggaatcttctgctccatgtggcttaagccttccagctgagtgaagctaggcaaatggagtgggggcaggcatctattcctgcccccatcatgccccacacccatcagtcaacactcatttgacaaatagagtccagctgcctctgagccaatcctgggaccataataggctcagagtgagtcagctgtttgaacccaaagctgtgcagtcaggcaccctggctgagctagagaagccagtacctgcatcttggtttataaggcttacagctaggaaagctctagttctgggggtgaaagaaaaatattagtttacctgagcacttatttccatgacagggtctaaaatatggaccatgatgtagacacagatttttaattttggaaaaacctccagttactagtgacgaggatagaaagggaagtgcttctctttggctttttcttggttacactgcagtttcaggattgggtgagacagagacaaatgaacccccctctaaagtcatttaactaatagccagcacatcccttccccaaactgtcaattgaaatcttaactgaaagttttactgaataataccaagctaattgctgttgggcacacctggatggctttgcacctggtgttgaacctgctgaagcaggtggatgctcaagattacgtgcaaggaatccctcccatctggtactaaaatttcagtgtgttctgagtgtcttttaaaccaaaatggaaatacagatacagggctgtagtattcagtaatgtgtctgctccttgttgggcagacaccagcggtgtgcagggagagaccaagtaccatctttatctacacttgggctggcttgtggagaagggctgctttttttcagtcctacattccttcattttttttttcattcttgaattcattgttttgtgggatctaagacccaggggtcatttgagaggtttgacagtatcttttctgaccagttgccacatgacttgcttgaccctgagcctgtggaaatggcatagggaccagtctactacccactgggcctggtgtgtagagggggagagggtagcaaggtgcttctctacgcccatgacttgggagcaggtcttggcctccttcatgagagtctagtgccatgtcctgtcccatgatctggaccctgggactgtcttggcatcttaactgcagtttcaatgaggcagagggcaaagagagaccaagatcagaggggttcattatacccctggctagagaacccagctactgacatgcaagcagcttggggctggctggacacaggtactaggcccattgtttccaggtgaagctttcatcacagaacagtgttgtctccacctggccttagatggcacgccatgattcgggcctggatagactgcctgcgtccttaccactgatctggccaagaatgaggccctcccaacactttcactccctctccaagccttgatgggacctccacttatttaggcctcatgtgctttgaagaagctttgagagccaatgtgtcttccacgggtctcttttttgctacaagtaatcagccccatgtgttctcttaaactgagaattgcacctgggcaattcctgttttctaaggtggtctctgctgctatttaacaacccagagtaggcctctgtgaggcttcagtggcctcagaaaccagagggtccagatagggggcctgcttgggccctctgctgccaactgctcaaacctgctttagctccagccacttgtggcaaacaacctcgtttccttacaaattccagcatgtgactttggtgccgttacttgtgaaaaatctattctgttgtctttgatgtgtccaagaaaattcgtgtagtttacgtaaaaatatctgactcacaagaaagccaactgtatgtcttgtgatgggacagttcataatgtagttgctagaccactttacaaattgttcttgtcaccagatgtgttcagacattgctgtgcaattgttggggagggtagggggaaaggcgagaggagatacttattggtctttttgtttaataccttccccaagaggggacagtctggccaacttgctccagtaatgcaataaagacattgcaataaagt

SEQ ID NO: 3098 - DNA, 5019 bp, Homo sapiens
acagaatcccggtacatcgaggcgggacggcgtggaaggggcggtggtgatgcctgctgtcccccctcccggcgcggttgggtggcgcctcagcggcgcgatgtacaatacggtgtggagtatggaccgcgatgacgcagactggagggaggtgatgatgccctattcgacagaactgatattttatattgaaatggatcctccagctcttccaccaaagccacctaagccaatgacttcagcagttccaaatggaatgaaggacagttctgtttctcttcaggatgcagaatggtactggggggatatttcaagggaggaggtaaatgacaaattgcgggatatgccagatgggaccttcttggtccgagatgcctcaacaaaaatgcagggagattatactttgactttgcggaagggaggcaataataagttaataaagatctatcaccgggatggtaaatatggcttttctgatcctctgacatttaattccgtggtggagctcattaaccactatcaccatgaatctcttgctcagtacaatcccaaacttgatgtgaagctgatgtacccagtgtccagataccaacaggatcagttggtaaaagaagataatattgatgcagtaggtaaaaaactgcaagaataccactctcagtatcaggagaagagtaaagagtatgataggctgtatgaagaatatactagaacatcccaggaaatacagatgaagaggactgcaatagaagcttttaatgaaacaattaaaatatttgaagagcagtgtcacacacaagaacaacatagcaaagaatatattgagcgatttcgcagagaggggaatgaaaaggagattgaacgaattatgatgaattatgataaattgaaatcacgtctgggtgagattcatgatagcaaaatgcgtctagagcaggatttgaagaatcaagctttggacaaccgagaaatagataaaaaaatgaatagcatcaaacctgacctgatccagctgcgaaagatccgagatcaacaccttgtatggctcaatcacaaaggagtgagacagaaacgcctgaatgtctggctgggaattaagaatgaggatgctgatgagaactattttatcaatgaggaagatgaaaacctgccccattatgatgagaaaacctggtttgttgaggatatcaatcgagtacaagcagaggacttgctttatgggaaacctgatggtgcattcttaattcgtgagagtagcaagaaaggatgctatgcttgctctgtggtggccgatggggaagtgaagcactgtgtgatctacagcactgctcggggctatggctttgcagagccctacaacctgtacagctctctgaaggagctagtgctccattaccagcagacatccttggttcagcacaacgactccctcaacgtcaggcttgcctaccctgttcatgcacagatgccctcgctttgcagataaagaggaagtgggaagagaggtggttctctggcatttttttctacagtttttattagactacgatgagggcattctttctacatagactgcttgttttgcacaagaagtgattttgtgaatgtgaagtggagaggccgagcagcagccggccgggatgggggcattagaggcctgaggttctctaggactcagccatgccgctgcactgacatactaagctggaagcagatgttttttttgaaagtctgtttcattggggtttttgttttgtttagccagacaccctcaacagaatattaggcttgatggttatagcgggtggggttgtatttggaagcctctgaagagaccatgtctttttaaaatctaactcttgagagtgcagcaggggcatggctctgctgggagttgtgttttgctttggcagtctctcttccccccacgaagaaggctgtttaggttttgtgatagaatgggatttgatgaaaaagacaaccaaaggaaaatggggaggcttgggatttcatttaaataatctaagccaagatgataaaaaaaaccttcaactgaaggtattttgtttcttaccaacataatttaggcttcagcatctcaccagcccctccctctgaagaagtattatgttcagaagccaacaaaacagtttgttgccagaccaatgtttgatgggaaaacgtggcactcatagttgaatgtatacttctgtaccaaaacttgaacataaaaagactagaatttgtgagttttagcaaacgctaaaattgatcactgtaactaaccccttctgtccttcctgcctgtttctctgagatgaggaatagcattctttttgtggggatggtgagctttgaatcataaaatgaagttggtgcttgtatggtgtttccttagcctaaagaatgatctgttgtttgaaacctttgtaacttgtttgtatgagtaaagaaaaggtgcaatgcagtgcttttagatggcttgatataccaaataacaatatagaacaacattattatatgtgcttccccaagtttaaaggccctgcagaaatagtaaacatggtttaatttcccttcatttccccctcctttgctggatggggttttgggagctataggttgctaaggaggggagtcagattgtggtcaggtgcctcagtaaatcacagacccaggggccctgtggtccagggtgagagtcacaccacattacacatgtgcttccatacagtggtttctgaagcttttgcagggagagaagatggcttagtgtttagactgttagtagaagccatctggaagcttttctctttgcctttttttgtgatcctgccattaaggctatgtgcagtctgccctcctgctccagtggccttgattttaggccaggaatcttctgctccatgtggcttaagccttccagctgagtgaagctaggcaaatggagtgggggcaggcatctattcctgcccccatcatgccccacacccatcagtcaacactcatttgacaaatagagtccagctgcctctgagccaatcctgggaccataataggctcagagtgagtcagctgtttgaacccaaagctgtgcagtcaggcaccctggctgagctagagaagccagtacctgcatcttggtttataaggcttacagctaggaaagctctagttctgggggtgaaagaaaaatattagtttacctgagcacttatttccatgacagggtctaaaatatggaccatgatgtagacacagatttttaattttggaaaaacctccagttactagtgacgaggatagaaagggaagtgcttctctttggctttttcttggttacactgcagtttcaggattgggtgagacagagacaaatgaacccccctctaaagtcatttaactaatagccagcacatcccttccccaaactgtcaattgaaatcttaactgaaagttttactgaataataccaagctaattgctgttgggcacacctggatggctttgcacctggtgttgaacctgctgaagcaggtggatgctcaagattacgtgcaaggaatccctcccatctggtactaaaatttcagtgtgttctgagtgtcttttaaaccaaaatggaaatacagatacagggctgtagtattcagtaatgtgtctgctccttgttgggcagacaccagcggtgtgcagggagagaccaagtaccatctttatctacacttgggctggcttgtggagaagggctgctttttttcagtcctacattccttcattttttttttcattcttgaattcattgttttgtgggatctaagacccaggggtcatttgagaggtttgacagtatcttttctgaccagttgccacatgacttgcttgaccctgagcctgtggaaatggcatagggaccagtctactacccactgggcctggtgtgtagagggggagagggtagcaaggtgcttctctacgcccatgacttgggagcaggtcttggcctccttcatgagagtctagtgccatgtcctgtcccatgatctggaccctgggactgtcttggcatcttaactgcagtttcaatgaggcagagggcaaagagagaccaagatcagaggggttcattatacccctggctagagaacccagctactgacatgcaagcagcttggggctggctggacacaggtactaggcccattgtttccaggtgaagctttcatcacagaacagtgttgtctccacctggccttagatggcacgccatgattcgggcctggatagactgcctgcgtccttaccactgatctggccaagaatgaggccctcccaacactttcactccctctccaagccttgatgggacctccacttatttaggcctcatgtgctttgaagaagctttgagagccaatgtgtcttccacgggtctcttttttgctacaagtaatcagccccatgtgttctcttaaactgagaattgcacctgggcaattcctgttttctaaggtggtctctgctgctatttaacaacccagagtaggcctctgtgaggcttcagtggcctcagaaaccagagggtccagatagggggcctgcttgggccctctgctgccaactgctcaaacctgctttagctccagccacttgtggcaaacaacctcgtttccttacaaattccagcatgtgactttggtgccgttacttgtgaaaaatctattctgttgtctttgatgtgtccaagaaaattcgtgtagtttacgtaaaaatatctgactcacaagaaagccaactgtatgtcttgtgatgggacagttcataatgtagttgctagaccactttacaaattgttcttgtcaccagatgtgttcagacattgctgtgcaattgttggggagggtagggggaaaggcgagaggagatacttattggtctttttgtttaataccttccccaagaggggacagtctggccaacttgctccagtaatgcaataaagacattgcaataaagtaa

SEQ ID NO: 3099 - DNA, 5174 bp, Homo sapiens
aaccggcctcagccaatcaccacccaccttgcctctcttccctcgccccactccctcctcgcctggctcgcgtgctcccggcactgactcctggagtgcggccagcgcccggatcgtaccattctgattgaggctgggggagagcgcggatggctgattggggagccgaagcctagagagcggtggggagacgtgaaagtcgagatggagagcagctttttgaacatgttctcaggcacttgacagaatcccgcgcgatgtacaatacggtgtggagtatggaccgcgatgacgcagactggagggaggtgatgatgccctattcgacagaactgatattttatattgaaatggatcctccagctcttccaccaaagccacctaagccaatgacttcagcagttccaaatggaatgaaggacagttctgtttctcttcaggatgcagaatggtactggggggatatttcaagggaggaggtaaatgacaaattgcgggatatgccagatgggaccttcttggtccgagatgcctcaacaaaaatgcagggagattatactttgactttgcggaagggaggcaataataagttaataaagatctatcaccgggatggtaaatatggcttttctgatcctctgacatttaattccgtggtggagctcattaaccactatcaccatgaatctcttgctcagtacaatcccaaacttgatgtgaagctgatgtacccagtgtccagataccaacaggatcagttggtaaaagaagataatattgatgcagtaggtaaaaaactgcaagaataccactctcagtatcaggagaagagtaaagagtatgataggctgtatgaagaatatactagaacatcccaggaaatacagatgaagaggactgcaatagaagcttttaatgaaacaattaaaatatttgaagagcagtgtcacacacaagaacaacatagcaaagaatatattgagcgatttcgcagagaggggaatgaaaaggagattgaacgaattatgatgaattatgataaattgaaatcacgtctgggtgagattcatgatagcaaaatgcgtctagagcaggatttgaagaatcaagctttggacaaccgagaaatagataaaaaaatgaatagcatcaaacctgacctgatccagctgcgaaagatccgagatcaacaccttgtatggctcaatcacaaaggagtgagacagaaacgcctgaatgtctggctgggaattaagaatgaggatgctgatgagaactattttatcaatgaggaagatgaaaacctgccccattatgatgagaaaacctggtttgttgaggatatcaatcgagtacaagcagaggacttgctttatgggaaacctgatggtgcattcttaattcgtgagagtagcaagaaaggatgctatgcttgctctgtggtggccgatggggaagtgaagcactgtgtgatctacagcactgctcggggctatggctttgcagagccctacaacctgtacagctctctgaaggagctagtgctccattaccagcagacatccttggttcagcacaacgactccctcaacgtcaggcttgcctaccctgttcatgcacagatgccctcgctttgcagataaagaggaagtgggaagagaggtggttctctggcatttttttctacagtttttattagactacgatgagggcattctttctacatagactgcttgttttgcacaagaagtgattttgtgaatgtgaagtggagaggccgagcagcagccggccgggatgggggcattagaggcctgaggttctctaggactcagccatgccgctgcactgacatactaagctggaagcagatgttttttttgaaagtctgtttcattggggtttttgttttgtttagccagacaccctcaacagaatattaggcttgatggttatagcgggtggggttgtatttggaagcctctgaagagaccatgtctttttaaaatctaactcttgagagtgcagcaggggcatggctctgctgggagttgtgttttgctttggcagtctctcttccccccacgaagaaggctgtttaggttttgtgatagaatgggatttgatgaaaaagacaaccaaaggaaaatggggaggcttgggatttcatttaaataatctaagccaagatgataaaaaaaaccttcaactgaaggtattttgtttcttaccaacataatttaggcttcagcatctcaccagcccctccctctgaagaagtattatgttcagaagccaacaaaacagtttgttgccagaccaatgtttgatgggaaaacgtggcactcatagttgaatgtatacttctgtaccaaaacttgaacataaaaagactagaatttgtgagttttagcaaacgctaaaattgatcactgtaactaaccccttctgtccttcctgcctgtttctctgagatgaggaatagcattctttttgtggggatggtgagctttgaatcataaaatgaagttggtgcttgtatggtgtttccttagcctaaagaatgatctgttgtttgaaacctttgtaacttgtttgtatgagtaaagaaaaggtgcaatgcagtgcttttagatggcttgatataccaaataacaatatagaacaacattattatatgtgcttccccaagtttaaaggccctgcagaaatagtaaacatggtttaatttcccttcatttccccctcctttgctggatggggttttgggagctataggttgctaaggaggggagtcagattgtggtcaggtgcctcagtaaatcacagacccaggggccctgtggtccagggtgagagtcacaccacattacacatgtgcttccatacagtggtttctgaagcttttgcagggagagaagatggcttagtgtttagactgttagtagaagccatctggaagcttttctctttgcctttttttgtgatcctgccattaaggctatgtgcagtctgccctcctgctccagtggccttgattttaggccaggaatcttctgctccatgtggcttaagccttccagctgagtgaagctaggcaaatggagtgggggcaggcatctattcctgcccccatcatgccccacacccatcagtcaacactcatttgacaaatagagtccagctgcctctgagccaatcctgggaccataataggctcagagtgagtcagctgtttgaacccaaagctgtgcagtcaggcaccctggctgagctagagaagccagtacctgcatcttggtttataaggcttacagctaggaaagctctagttctgggggtgaaagaaaaatattagtttacctgagcacttatttccatgacagggtctaaaatatggaccatgatgtagacacagatttttaattttggaaaaacctccagttactagtgacgaggatagaaagggaagtgcttctctttggctttttcttggttacactgcagtttcaggattgggtgagacagagacaaatgaacccccctctaaagtcatttaactaatagccagcacatcccttccccaaactgtcaattgaaatcttaactgaaagttttactgaataataccaagctaattgctgttgggcacacctggatggctttgcacctggtgttgaacctgctgaagcaggtggatgctcaagattacgtgcaaggaatccctcccatctggtactaaaatttcagtgtgttctgagtgtcttttaaaccaaaatggaaatacagatacagggctgtagtattcagtaatgtgtctgctccttgttgggcagacaccagcggtgtgcagggagagaccaagtaccatctttatctacacttgggctggcttgtggagaagggctgctttttttcagtcctacattccttcattttttttttcattcttgaattcattgttttgtgggatctaagacccaggggtcatttgagaggtttgacagtatcttttctgaccagttgccacatgacttgcttgaccctgagcctgtggaaatggcatagggaccagtctactacccactgggcctggtgtgtagagggggagagggtagcaaggtgcttctctacgcccatgacttgggagcaggtcttggcctccttcatgagagtctagtgccatgtcctgtcccatgatctggaccctgggactgtcttggcatcttaactgcagtttcaatgaggcagagggcaaagagagaccaagatcagaggggttcattatacccctggctagagaacccagctactgacatgcaagcagcttggggctggctggacacaggtactaggcccattgtttccaggtgaagctttcatcacagaacagtgttgtctccacctggccttagatggcacgccatgattcgggcctggatagactgcctgcgtccttaccactgatctggccaagaatgaggccctcccaacactttcactccctctccaagccttgatgggacctccacttatttaggcctcatgtgctttgaagaagctttgagagccaatgtgtcttccacgggtctcttttttgctacaagtaatcagccccatgtgttctcttaaactgagaattgcacctgggcaattcctgttttctaaggtggtctctgctgctatttaacaacccagagtaggcctctgtgaggcttcagtggcctcagaaaccagagggtccagatagggggcctgcttgggccctctgctgccaactgctcaaacctgctttagctccagccacttgtggcaaacaacctcgtttccttacaaattccagcatgtgactttggtgccgttacttgtgaaaaatctattctgttgtctttgatgtgtccaagaaaattcgtgtagtttacgtaaaaatatctgactcacaagaaagccaactgtatgtcttgtgatgggacagttcataatgtagttgctagaccactttacaaattgttcttgtcaccagatgtgttcagacattgctgtgcaattgttggggagggtagggggaaaggcgagaggagatacttattggtctttttgtttaataccttccccaagaggggacagtctggccaacttgctccagtaatgcaataaagacattgcaataaagt

SEQ ID NO: 3100 - DNA, 1884 bp, Homo sapiens
gggcagttggtgcggtcgggttggttcttacaccccggcgggagcgcccagacaagccgagctgactggacttctccggccggccccattcccgaggctgcggcagcttcggttccgagaccgaccggagaggagcccgagtcccggcctctgggggattcgctctctgcagaccagtgggaccccgaaacttgaacgcaatctccagcccccttttttgccttcctttgtcacttgcccgggtttctcccaacgtgttcttttttttcctcttcattctccctccttcgaaggacacaaaagtggcttccgcggaaagatttggaggcggtgggagcttttctccccggagagcgactgtgtagaaaggatttttgggaagccgctttttaacacctctgctctccgtcccccaagcctctgtgtaatcctctgaggagaaaagcccatagcttgaaagttcgggggcattttgttgtgttctgtaggagagagggggaggaccctgttcgggtagtttggccggactggtactggccgttggaaaacccgaagtacatttccgtgtggaacttttgcagatatatatttttagatttttaaataccagataaaaaatatatgccttctatatatctcctggcgacctgcccctgacagcgcgatgtacaatacggtgtggagtatggaccgcgatgacgcagactggagggaggtgatgatgccctattcgacagaactgatattttatattgaaatggatcctccagctcttccaccaaagccacctaagccaatgacttcagcagttccaaatggaatgaaggacagttctgtttctcttcaggatgcagaatggtactggggggatatttcaagggaggaggtaaatgacaaattgcgggatatgccagatgggaccttcttggtccgagatgcctcaacaaaaatgcagggagattatactttgactttgcggaagggaggcaataataagttaataaagatctatcaccgggatggtaaatatggcttttctgatcctctgacatttaattccgtggtggagctcattaaccactatcaccatgaatctcttgctcagtacaatcccaaacttgatgtgaagctgatgtacccagtgtccagataccaacaggatcagttggtaaaagaagataatattgatgcagtaggtaaaaaactgcaagaataccactctcagtatcaggagaagagtaaagagtatgataggctgtatgaagaatatactagaacatcccaggaaatacagatgaagaggactgcaatagaagcttttaatgaaacaattaaaatatttgaagagcagtgtcacacacaagaacaacatagcaaagaatatattgagcgatttcgcagagaggggaatgaaaaggagattgaacgatggctcaatcacaaaggagtgagacagaaacgcctgaatgtctggctgggaattaagaatgaggatgctgatgagaactattttatcaatgaggaagatgaaaacctgccccattatgatgagaaaacctggtttgttgaggatatcaatcgagtacaagcagaggacttgctttatgggaaacctgatggtgcattcttaattcgtgagagtagcaagaaaggatgctatgcttgctctgtggtggccgatggggaagtgaagcactgtgtgatctacagcactgctcggggctatggctttgcagagccctacaacctgtacagctctctgaaggagctagtgctccattaccagcagacatccttggttcagcacaacgactccctcaacgtcaggcttgcctaccctgttcatgcacagatgccctcgctttgcagataaagaggaagtgg

SEQ ID NO: 3101 - DNA, 753 bp, Homo sapiens
ctgattgaggctgggggagagcgcggatggctgattggggagccgaagcctagagagcggtggggagacgtgaaagtcgagatggagagcagctttttgaacatgttctcaggcacttgacagaatcccgcgcgatgtacaatacggtgtggagtatggaccgcgatgacgcagactggagggaggtgatgatgccctattcgacagaactgatattttatattgaaatggatcctccagctcttccaccaaagccacctaagccaatgacttcagcagttccaaatggaatgaaggacagttctgtttctcttcaggatgcagaatggtactggggggatatttcaagggaggaggtaaatgacaaattgcgggatatgccagatgggaccttcttggtccgagatgcctcaacaaaaatgcagggagattatactttgactttgcggaagggaggcaataataagttaataaagatctatcaccgggatggtaaatatggcttttctgatcctctgacatttaattccgtggtggagctcattaaccactatcaccatgaatctcttgctcagtacaatcccaaacttgatgtgaagctgatgtacccagtgtccagataccaacaggatcagttggtaaaagaagataatattgatgcagtaggtaaaaaactgcaagaataccactctcagtatcaggagaagagtaaagagtatgataggctgtatgaagaatatactagaacatccc

SEQ ID NO: 3102 - DNA, 1553 bp, Homo sapiens
agaagctccctgtgcccatggggccatctcggcttgtccgtggccctcggccccagggcatgcgttccccctaccgcaggccaggtatgggctggcccaggccccgatttcccaggatgttcaagtgtagccgcagaagatatcaacagggtctccgaggtcgaactgccagcagtgcagccatcaatcctgccaccagggccatgggtatcaacaacacccacactgacaccaccatagtgtggatcttcccacctcaagctcttccaccaaagccacctaagccaatgacttcagcagttccaaatggaatgaaggacagttctgtttctcttcaggatgcagaatggtactggggggatatttcaagggaggaggtaaatgacaaattgcgggatatgccagatgggaccttcttggtccgagatgcctcaacaaaaatgcagggagattatactttgactttgcggaagggaggcaataataagttaataaagatctatcaccgggatggtaaatatggcttttctgatcctctgacatttaattccgtggtggagctcattaaccactatcaccatgaatctcttgctcagtacaatcccaaacttgatgtgaagctgatgtacccagtgtccagataccaacaggatcagttggtaaaagaagataatattgatgcagtaggtaaaaaactgcaagaataccactctcagtatcaggagaagagtaaagagtatgataggctgtatgaagaatatactagaacatcccaggaaatacagatgaagaggactgcaatagaagcttttaatgaaacaattaaaatatttgaagagcagtgtcacacacaagaacaacatagcaaagaatatattgagcgatttcgcagagaggggaatgaaaaggagattgaacgaattatgatgaattatgataaattgaaatcacgtctgggtgagattcatgatagcaaaatgcgtctagagcaggatttgaagaatcaagctttggacaaccgagaaatagataaaaaaatgaatagcatcaaacctgacctgatccagctgcgaaagatccgagatcaacaccttgtatggctcaatcacaaaggagtgagacagaaacgcctgaatgtctggctgggaattaagaatgaggatgctgatgagaactattttatcaatgaggaagatgaaaacctgccccattatgatgagaaaacctggtttgttgaggatatcaatcgagtacaagcagaggacttgctttatgggaaacctgatggtgcattcttaattcgtgagagtagcaagaaaggatgctatgcttgctctgtggtggccgatggggaagtgaagcactgtgtgatctacagcactgctcggggctatggctttgcagagccctacaacctgtacagctctctgaaggagctagtgctccattaccagcagacatccttggttcagcacaacgactccctcaacgtcaggcttgcctaccctgttcatgcacagatgccctcgctttgcagataaagaggaagtggg

SEQ ID NO: 3103 - DNA, 4438 bp, Homo sapiens
aagcttactcagcgcatctgctacagcattttatcttcccaagagccccatgaggcgatgacccaggatgcagccaggggccacgacatgcacggaggaccgcatccagcatgccctggaacgctgcctgcatggactcagcctcagccgccgctccacctcctggtcagctgggctgtgtctgaactgctggagcctgcaggagctggtcagcagggacccgggccacttccttatcctccttgagcagatcctgcagaagacccgagaggtccaggagaagggcacctacgacctgctcaccccgctggccctgctcttctattccactgttctttgtacaccacacttcccaccagactcggatctccttctgaaggcagccagcacctaccaccggttcctgacctggcctgttccttactgcagcatctgccaggagctgctcaccttcattgatgctgaactcaaggccccagggatctcctaccagagactggtgagggctgagcagggcctgcccatcaggagtcaccgcagctccaccgtcaccgtgctgctgctgaacccagtggaagtgcaggccgagttccttgctgtagccaataagctgagtacgcccggacactcgcctcacagtgcctacaccaccctgctcctgcacgccttccaggccacctttggggcccactgtgacgtcccgggcctgcactgcaggctacaggccaagaccctggcagagcttgaggacatcttcacggagaccgcagaggcacaggagctggcatctggcatcggggatgctgcagaggcccggcggtggctcaggaccaagctgcaggcggtgggagaaaaagctggcttccctggggtgttagacactgcaaaaccagggaagctccacaccatccccatccctgtcgccaggtgctacacctacagctggagccaggacagctttgacatcctgcaggaaatcctgctcaaggaacaggagctactccagccagggatcctgggagatgatgaagaggaggaagaggaggaggaggaggtggaggaggacttggaaactgacgggcactgtgccgagagagattccctgctctccaccagctctttggcgtcccatgactccaccttgtcccttgcatcctcccaggcctcggggccggccctctcgcgccatctgctgacttcctttgtctcaggcctctctgatggcatggacagcggctacgtggaggacagcgaggagagctcctccgagtggccttggaggcgtggcagccaggaacgccgaggccaccgcaggcctgggcagaagttcatcaggatctataaactcttcaagagcaccagccagctggtactgcggagggactctcggagcctggagggcagctcggacacggccctgcccctgaggcgggcagggagcctctgcagccccctggacgaaccagtatcacccccttcccgggcccagcgctcccgctccctgccccagcccaaactcggtacccagctgcccagctggcttctggcccctgcttcacgcccccagcgccgccgccccttcctgagtggagatgaggatcccaaggcttccacgctacgtgttgtggtctttggctccgatcggatttcagggaaggtggctcgggcgtacagcaaccttcggcggctggagaacaatcgcccactcctcacacggttcttcaaacttcagttcttctacgtgcctgtgaagcgaagtcatgggaccagccctggtgcctgtccaccccctcggagccagacgccctcacccccgacagactcccctaggcacgccagccctggagagctgggcaccaccccatgggaggagagcaccaatgacatctcccactacctcggcatgctggacccctggtatgagcgcaatgtactgggcctcatgcacctgccccctgaagtcctgtgccagcagtccctgaaggctgaagcccaggccctggagggctccccaacccagctgcccatcctggctgacatgctactctactactgccgctttgccgccagaccggtgctgctgcaagtctatcagaccgagctgaccttcatcactggggagaagacgacagagatcttcatccactccttggagctgggtcactccgctgccacacgtgccatcaaggcgtcaggtcctggcagcaagcggctgggcatcgatggcgaccgggaggctgttcctctaacactacagattatttacagcaagggggccatcagtggacgaagtcgctggagcaacctggagaaggtctgtacctccgtgaacctcaacaaggcctgccggaagcaggaggagctggattccagcatggaggccctgacgctaaacctgacagaagtggtgaaaaggcagaactccaaatccaagaagggctttaaccagattagcacatcgcagatcaaagtggacaaggtgcagatcatcggctccaacagctgcccctttgctgtgtgcctggaccaggatgagagaaagatcctgcagagtgtagtcagatgtgaggtctcaccgtgctacaagccagagaagagcgacctctcctcaccaccccagacgcctcctgacctgccggcccaggccgcacctgatctctgctcccttctctgcctgcccatcatgactttcagtggagctctgccctagtgtgggcccagcgccagactggacagaagccctggggcaacctcctcggccacccctccaggacagtccctctctgtggagaactgaatggccctgtgcagagccatagtcccactgtgggtcctgcaatgagcaggggctgggagtagagggtttctggggcctcagggttctgggaaagcaacagctatcagagagagaagggccagaccccatagcctcttagattcctggcagtagaaggagaaggatgggtaaattgacctctgaagtccctgaccattagcatggtctaggatcctttctagaaggaagatctgaggctctggtgctcagggggatggcttgggccttttctctcaaccttggctgagcctaccccttactttgccaaagacttgaggaccctgtatgtctggagttcagtcccctcctctgtggggctcaggtgattgaaatgtggatgaaacatttctctacttcaagaccacctctccctgcaaacaccacacacacatggcatgcatgtacgcacatgcgcacacacacacgcacacacctcaataatttctctcaagtttcctgagtctccagaaaaacagcactaacgctggacctgtctactctcagaacccggcacagattctctcttgatctccttttggaatctgagattcttagaagacaggatagggttaaatttagtagcagctcagttctagctaaatcactagaggaagttaattaactttaagccttcatttctccagcactaaaatggagtggagagttggggtggaaataagacatccttaaaaggttaaattgtctgcaaagcacctagcccagtgccgagctcccagtaggtgttcagtaaagcttagtgcctgactttctgaacactgattcctcctgtttggagtcactgggatactctcattgccgttgggatgttcctcactccttcccagttcgtggctgaggcagaacccagactgaagagggaagagacattccagaggaggattgccttcgtcagggtaaggggtgggctgctcaggggccctacccttcacccccttctgtatcagattggccctcccactcccatctcactctgcgtgtacaatcttccatatccgcaagttcactggcactcttctggcacctgggcaagatcccagaacagaggatggagtgactggcctcacagagcttagtgcccgactcaggggaaatgggactggtgcatgggaaatggtcagcctaggataggacacgagagtctgaaattcaaagcaaccagcttgaagtggtttgagaagctggaagcaaacatgggctagagagatagggcagaagtcaagacgaggatctggactgatgtggagaaagtagccacggaagcatgaactgtatcctgcacaaagtccctcttccccgcctcctaattcattatgcccaaaaggccttacgtgaaattccagcccagagtactcatgacttgagagacgtggacagagccagcttctaccttgcctggccgtctctcccctgtcttaatgtctgctcttgctctaagctccagaagagtggcgggccatgtatcttcaatatgtttttgctgtatgggcaggttgtcttattatgtgatcaacagatgtccaggaactaatgagtggaatttaatattattgtcaaataaaacttgatttgtcctatatttaa

SEQ ID NO: 3104 - DNA, 4488 bp, Homo sapiens
agatgctgcggctcgccgcgcggctccagctggggcgcggtggtcccgacggtcacccgaatcgcagggagtcgccgctggagaggggctcggcgcccggcggggactgcaggcgatgacccaggatgcagccaggggccacgacatgcacggaggaccgcatccagcatgccctggaacgctgcctgcatggactcagcctcagccgccgctccacctcctggtcagctgggctgtgtctgaactgctggagcctgcaggagctggtcagcagggacccgggccacttccttatcctccttgagcagatcctgcagaagacccgagaggtccaggagaagggcacctacgacctgctcaccccgctggccctgctcttctattccactgttctttgtacaccacacttcccaccagactcggatctccttctgaaggcagccagcacctaccaccggttcctgacctggcctgttccttactgcagcatctgccaggagctgctcaccttcattgatgctgaactcaaggccccagggatctcctaccagagactggtgagggctgagcagggcctgcccatcaggagtcaccgcagctccaccgtcaccgtgctgctgctgaacccagtggaagtgcaggccgagttccttgctgtagccaataagctgagtacgcccggacactcgcctcacagtgcctacaccaccctgctcctgcacgccttccaggccacctttggggcccactgtgacgtcccgggcctgcactgcaggctacaggccaagaccctggcagagcttgaggacatcttcacggagaccgcagaggcacaggagctggcatctggcatcggggatgctgcagaggcccggcggtggctcaggaccaagctgcaggcggtgggagaaaaagctggcttccctggggtgttagacactgcaaaaccagggaagctccacaccatccccatccctgtcgccaggtgctacacctacagctggagccaggacagctttgacatcctgcaggaaatcctgctcaaggaacaggagctactccagccagggatcctgggagatgatgaagaggaggaagaggaggaggaggaggtggaggaggacttggaaactgacgggcactgtgccgagagagattccctgctctccaccagctctttggcgtcccatgactccaccttgtcccttgcatcctcccaggcctcggggccggccctctcgcgccatctgctgacttcctttgtctcaggcctctctgatggcatggacagcggctacgtggaggacagcgaggagagctcctccgagtggccttggaggcgtggcagccaggaacgccgaggccaccgcaggcctgggcagaagttcatcaggatctataaactcttcaagagcaccagccagctggtactgcggagggactctcggagcctggagggcagctcggacacggccctgcccctgaggcgggcagggagcctctgcagccccctggacgaaccagtatcacccccttcccgggcccagcgctcccgctccctgccccagcccaaactcggtacccagctgcccagctggcttctggcccctgcttcacgcccccagcgccgccgccccttcctgagtggagatgaggatcccaaggcttccacgctacgtgttgtggtctttggctccgatcggatttcagggaaggtggctcgggcgtacagcaaccttcggcggctggagaacaatcgcccactcctcacacggttcttcaaacttcagttcttctacgtgcctgtgaagcgaagtcatgggaccagccctggtgcctgtccaccccctcggagccagacgccctcacccccgacagactcccctaggcacgccagccctggagagctgggcaccaccccatgggaggagagcaccaatgacatctcccactacctcggcatgctggacccctggtatgagcgcaatgtactgggcctcatgcacctgccccctgaagtcctgtgccagcagtccctgaaggctgaagcccaggccctggagggctccccaacccagctgcccatcctggctgacatgctactctactactgccgctttgccgccagaccggtgctgctgcaagtctatcagaccgagctgaccttcatcactggggagaagacgacagagatcttcatccactccttggagctgggtcactccgctgccacacgtgccatcaaggcgtcaggtcctggcagcaagcggctgggcatcgatggcgaccgggaggctgttcctctaacactacagattatttacagcaagggggccatcagtggacgaagtcgctggagcaacctggagaaggtctgtacctccgtgaacctcaacaaggcctgccggaagcaggaggagctggattccagcatggaggccctgacgctaaacctgacagaagtggtgaaaaggcagaactccaaatccaagaagggctttaaccagattagcacatcgcagatcaaagtggacaaggtgcagatcatcggctccaacagctgcccctttgctgtgtgcctggaccaggatgagagaaagatcctgcagagtgtagtcagatgtgaggtctcaccgtgctacaagccagagaagagcgacctctcctcaccaccccagacgcctcctgacctgccggcccaggccgcacctgatctctgctcccttctctgcctgcccatcatgactttcagtggagctctgccctagtgtgggcccagcgccagactggacagaagccctggggcaacctcctcggccacccctccaggacagtccctctctgtggagaactgaatggccctgtgcagagccatagtcccactgtgggtcctgcaatgagcaggggctgggagtagagggtttctggggcctcagggttctgggaaagcaacagctatcagagagagaagggccagaccccatagcctcttagattcctggcagtagaaggagaaggatgggtaaattgacctctgaagtccctgaccattagcatggtctaggatcctttctagaaggaagatctgaggctctggtgctcagggggatggcttgggccttttctctcaaccttggctgagcctaccccttactttgccaaagacttgaggaccctgtatgtctggagttcagtcccctcctctgtggggctcaggtgattgaaatgtggatgaaacatttctctacttcaagaccacctctccctgcaaacaccacacacacatggcatgcatgtacgcacatgcgcacacacacacgcacacacctcaataatttctctcaagtttcctgagtctccagaaaaacagcactaacgctggacctgtctactctcagaacccggcacagattctctcttgatctccttttggaatctgagattcttagaagacaggatagggttaaatttagtagcagctcagttctagctaaatcactagaggaagttaattaactttaagccttcatttctccagcactaaaatggagtggagagttggggtggaaataagacatccttaaaaggttaaattgtctgcaaagcacctagcccagtgccgagctcccagtaggtgttcagtaaagcttagtgcctgactttctgaacactgattcctcctgtttggagtcactgggatactctcattgccgttgggatgttcctcactccttcccagttcgtggctgaggcagaacccagactgaagagggaagagacattccagaggaggattgccttcgtcagggtaaggggtgggctgctcaggggccctacccttcacccccttctgtatcagattggccctcccactcccatctcactctgcgtgtacaatcttccatatccgcaagttcactggcactcttctggcacctgggcaagatcccagaacagaggatggagtgactggcctcacagagcttagtgcccgactcaggggaaatgggactggtgcatgggaaatggtcagcctaggataggacacgagagtctgaaattcaaagcaaccagcttgaagtggtttgagaagctggaagcaaacatgggctagagagatagggcagaagtcaagacgaggatctggactgatgtggagaaagtagccacggaagcatgaactgtatcctgcacaaagtccctcttccccgcctcctaattcattatgcccaaaaggccttacgtgaaattccagcccagagtactcatgacttgagagacgtggacagagccagcttctaccttgcctggccgtctctcccctgtcttaatgtctgctcttgctctaagctccagaagagtggcgggccatgtatcttcaatatgtttttgctgtatgggcaggttgtcttattatgtgatcaacagatgtccaggaactaatgagtggaatttaatattattgtcaaataaaacttgatttgtcct

SEQ ID NO: 3105 - DNA, 565 bp, Homo sapiens
tggtcatctcagttcttttctcaccttgactgcaagatgaaactccttgtgctagctgtgctgctcacagtggccgccgccgacagcggcatcagccctcgggccgtgtggcagttccgcaaaatgatcaagtgcgtgatcccggggagtgaccccttcttggaatacaacaactacggctgctactgtggcttggggggctcaggcacccccgtggatgaactggacaagtgctgccagacacatgacaactgctatgaccaggccaagaagctggacagctgtaaatttctgctggacaacccgtacacccacacctattcatactcgtgctctggctcggcaatcacctgtagcagcaaaaacaaagagtgtgaggccttcatttgcaactgcgaccgcaacgctgccatctgcttttcaaaagctccatataacaaggcacacaagaacctggacaccaagaagtattgtcagagttgaatatcacctctcaaaagcatcacctctatctgcctcatctcacactgtactctccaataaagcaccttgttgaaagacctca

SEQ ID NO: 3106 - DNA, 970 bp, Homo sapiens
gaaggaaaaagagcaacagatccagggagcattcacctgccctgtctccaaacagccttgtgcctcacctacccccaacctcccagagggagcagctatttaaggggagcaggagtgcagaacaaacaagacggcctggggatacaactctggagtcctctgagagagccaccaaggaggagcaggggagcgacggccggggcagaagttgagaccacccagcagaggagctaggccagtccatctgcatttgtcacccaagaactcttaccatgaagaccctcctactgttggcagtgatcatgatctttggcctactgcaggcccatgggaatttggtgaatttccacagaatgatcaagttgacgacaggaaaggaagccgcactcagttatggcttctacggctgccactgtggcgtgggtggcagaggatcccccaaggatgcaacggatcgctgctgtgtcactcatgactgttgctacaaacgtctggagaaacgtggatgtggcaccaaatttctgagctacaagtttagcaactcggggagcagaatcacctgtgcaaaacaggactcctgcagaagtcaactgtgtgagtgtgataaggctgctgccacctgttttgctagaaacaagacgacctacaataaaaagtaccagtactattccaataaacactgcagagggagcacccctcgttgctgagtcccctcttccctggaaaccttccacccagtgctgaatttccctctctcataccctccctccctaccctaaccaagttccttggccatgcagaaagcatccctcacccatcctagaggccaggcaggagcccttctatacccacccagaatgagacatccagcagatttccagccttctactgctctcctccacctcaactccgtgcttaaccaaagaagctgtactccggggggtctcttctgaataaagcaattagcaaa

SEQ ID NO: 3107 - DNA, 888 bp, Homo sapiens
gagtcagtgtcagcccgaaggctgaaggaaaaagagcaacagatccagggagcattcacctgccctgtctccaaacagagccaccaaggaggagcaggggagcgacggccggggcagaagttgagaccacccagcagaggagctaggccagtccatctgcatttgtcacccaagaactcttaccatgaagaccctcctactgttggcagtgatcatgatctttggcctactgcaggcccatgggaatttggtgaatttccacagaatgatcaagttgacgacaggaaaggaagccgcactcagttatggcttctacggctgccactgtggcgtgggtggcagaggatcccccaaggatgcaacggatcgctgctgtgtcactcatgactgttgctacaaacgtctggagaaacgtggatgtggcaccaaatttctgagctacaagtttagcaactcggggagcagaatcacctgtgcaaaacaggactcctgcagaagtcaactgtgtgagtgtgataaggctgctgccacctgttttgctagaaacaagacgacctacaataaaaagtaccagtactattccaataaacactgcagagggagcacccctcgttgctgagtcccctcttccctggaaaccttccacccagtgctgaatttccctctctcataccctccctccctaccctaaccaagttccttggccatgcagaaagcatccctcacccatcctagaggccaggcaggagcccttctatacccacccagaatgagacatccagcagatttccagccttctactgctctcctccacctcaactccgtgcttaaccaaagaagctgtactccggggggtctcttctgaataaagcaattagcaaatcatgt

SEQ ID NO: 3108 - DNA, 2672 bp, Homo sapiens
gggcagcctgcatggaaagggactgccagcatctgcctccactgctctgtgctgggatcatggaacttgcactgctgtgtgggctggtggtgatggctggtgtgattccaatccagggcgggatcctgaacctgaacaagatggtcaagcaagtgactgggaaaatgcccatcctctcctactggccctacggctgtcactgcggactaggtggcagaggccaacccaaagatgccacggactggtgctgccagacccatgactgctgctatgaccacctgaagacccaggggtgcagcatctacaaggactattacagatacaacttttcccaggggaacatccactgctctgacaagggaagctggtgtgagcagcagctgtgtgcctgtgacaaggaggtggccttctgcctgaagcgcaacctggacacctaccagaagcgactgcgtttctactggcggccccactgccgggggcagacccctgggtgctagaagcccacaccctctaccctgttcctcagcatggagctctggcatccccacctcagtatctaacctgaaccagcctggcttttcaaacactccggggggaggtagtcccagcctcccccggaaccctctaccaatgccttctgaccttctgaagctttccgaatcctcccagttgaggcagtagctgtgtcctctgagggtggatgggaatcttgggagaagcccaagcaagggagccctcagaggtggtgtttggaccaaagcatcggggtgggggaggggtctgccgctgtcccccacctgctggcccccttgtccttcctcaccccctccaatatagtctcggagctacaaccgcagcagccactataaagggcaatattgatctttctgtccatgtggctctatcttttaaaacctcaaggccctccactgtcctaagataaagcctctcataggcactggggaccctgcacagtctggccatgtgaccctctccccaggcaagctctgaagtccctgcaggtggaggccatgcctgtcttaaactcagttgcatccctggtgcccaaagcaacaccagaaccaagaaggagctccataaatccttcttgggtgaagcctagacaaagccgccaggtcttgtggctccaggcaccagagccttgagtactttctcctgcctccaggcattggctcagggtgaattacaaggggctactgaatggctattactttcatcacgactgatccccacctcctcagggtcaaagggctactttctggaagtctccccaggctgactccttctccctgactgcaagggctcactccctcctccaagctcccacaatgcttcatggctctgccgcttacctagcttggcctagagtggcaaatggaacttctctgatctcccccaactagactggagcccccgaaggatggagaccatgtctgtgccatctctgtttcccctgttttcccacatactaggtgctcaattcatgcctgtgaatggcgtgagcccataatggatacacagaggttgcagcagatggtgtgggtacctcacccagatatcatccaggcccaaggcccctctccctgagtgaggccaggtgttggcagccaactgctccaatctgcctccttcccctaaatactgccctggtctagtgggagctgccttccccctgccccacctctcccaccaagaggccacctgtcactcatggccaggagagtgacaccatggagggtacaattgccagctcccccgtgtctgtgcaggattgtctgggttgaatgacactctcaaattgttcctgggatcgggctgaggccaggcctctcctggaaccacctctctgcttggtctgaccccttggcctatccagttttcctggttccctcacaggtttctccagaaagtactccctcagtaaagcatttgcacaagaatccttgtctcaggctctgcttctaaggaaagagactgaagagggacaactttttcctatgaggactcccaatctgccatttgtgtgtggctagctgtttccagccagggggctgaggcacctgcagtcacccacactctgggcctgtggcaccatctgtgcctcagctgactgagcagttctgagatgtggtgactcatgtgaagtggtgtcataggaatgaaggactgtgggcgctgggttcaaattccagttctatgcaccactccaggtagggatacccatgggggcagctgtgcctgtgtgggggaacagggtagggaaatctccataccttctcaattttgctgtgaacctaaaactgccatataaagataaagtctaggccaggcatggtggctcatgcctgtaatcccaacacttagggtggctgaggcaggcagatcacctggggtcaggagttcaagaccagcctgcccaacatggcaaaacctcgtctctactaaaaatacaaaaattagccaggcatcgtggtgggtgcctgtaatcccagctattcaggaggctgaggcaggagaatcacttggacctgggaggcagaggtttcagtgagcccagatcgcgacactgcactccagcctgggcaacagagtgacactctgtctcaaaaaataaaataaaataaaataaaataaaataaaataaaataaaa

SEQ ID NO: 3109 - DNA, 785 bp, Homo sapiens
ctgctttcttctgctgccttttatgctccttgtgcacctcccttccccccaacctgggatgaaatctccccacgtgctggtgttcctttgcctcctggtggctctggtcaccgggaacctggttcagtttggggtgatgatcgagaagatgacaggcaagtccgccctgcagtacaacgactatggctgttactgcggcatcggtggctcccactggccggtggaccagactgactggtgctgccacgcccacgactgctgctacgggcgtctggagaagctgggctgtgagcccaaactggaaaagtatcttttctctgtcagcgaacgtggcattttctgcgccggcaggaccacctgccagcggctgacctgcgagtgtgacaagagggctgccctctgctttcgccgcaacctgggcacctacaaccgcaaatatgcccattatcccaacaagctgtgcaccgggcccaccccgccctgctgaggctatgctcggcctcccccccgtccctggaggtcccgcctcgggctgctgtagtcccaggcctggggaacattggcaccaaaggccctccctttggaaaattcctttcctgcaaactcatccctccttgagagctcagagatatgtcctggaccatcactagcctcccaggctaccccttctctgtagaaagaaccctgccccaggagccatggacccttcagcacccagaagactgtcactagcttctgggatctcagctccctcttctgaataagtgaataatgttttcccataa

SEQ ID NO: 3110 - DNA, 2723 bp, Homo sapiens
agtgtgcgaggcagcgtgaagctggggcctgctccccgcagcctctggagcgcatctcagaccttctgagacctatgttgctggccccccagaacccgcaacatggcagatggggcaaaggccaaccccaaagggttcaaaaagaaggtgctggatagatgcttctctgggtggaggggcccacgcttcggggcctcctgtccttcaagaacctccaggtctagcctgggtatgaagaagttcttcaccgtggccatccttgctggcagcgttctgtccacagctcacggcagcctgctcaacctgaaggccatggtggaggccgtcacagggaggagcgccatcctgtccttcgtgggctacggttgctactgtgggctggggggccgtggccagcccaaggatgaggtggactggtgctgccacgcccacgactgctgctaccaggaactctttgaccaaggctgtcacccctatgtggaccactatgatcacaccatcgagaacaacactgagatagtctgcagtgacctcaacaagacagagtgtgacaagcagacatgcatgtgtgacaagaacatggttctgtgcctcatgaaccagacgtaccgagaggagtaccgtggcttcctcaatgtctactgccagggccccacgcccaactgcagcatctatgaaccgccccctgaggaggtcacctgcagtcaccaatccccagcgccccccgcccctccctagagcctctgaggtttgagagagagagcgggaggagggtctggcttggggaccagacgaggtgcagggagggtaggagccaggccaggagcctgagggttgctggttgcctcctccctggagctctccagtgagggctcagctctcagaggactcaggaaggcctgggtcctgactcccccagcccagccccaggcatgggtgcctcctgctgctggttctggactgggtgggaggcacggagcttataggggtctctcctgagggtggccggggagacctgagagagaggaggaggggcctctgagtggggcctctgttgctggcgccagtttaactccccggagccttagaaagtctgagccttagaaagtctgggcctgagcatccaggcccagagctggatgcatcctcggcccaagatcacaggaaggcagattgctggtcacaaagcatgggttccgggagcccctcagctgatcccacaggatggcctggggtggtggctactttgggcttgaagctctctagagccccattcacagagcaggtgccccaccccagccctcactgaggtggccatgagtccaggttcagaccctaggggatgtgcagtgctgagtgtcccagccctgaagtctagcctcagagcaggctcctgggcactgacagagccacacacccaggtacaccccccaggctaatatggggacacacaaaaatatggccttcaacacctacaagtcttctctgtgtcccccatcgacccatgcacatcaccccaaccctgctctgccacaccacgtgggtctgaggagcactcctaccccccggctccgggtccctgacagacactgccctcctggcctgcacctggaatggcagccagaacactggagggggacccacaccctctctccctgggctgtggatgggtgttgcaagtcccatccctcctggcctgcacctggaacagcagccagaacaccggagggggacccacaccctctctccctgggctgtgggcaggcgtcacaagtcccattggtggggaagaggctgagggctgagacccacctcagtgaagagggaaacgtaagcagggagagcatcaaggcgggaggcagcctggaaacttctagaagagggtcaaggtaggaggctacatggaagcttctagaaggcagtaaggaacagggtggtgaaggagaggggagaagatgggagcatggagagacgaggtgagtgacagccaccagcagggacgggcctccaggcaacacagaggagctgggggccagggccttacggggctgggttcctgtgtggggcgtggagctggggctgaagtggaggggacggccctgcggcccccagcactgttgtttctccaggtgcaccttaccttcctccttacctgcccgagcctcaactcagggtcagcagcctccacggagccagccccacctgcccgaaaaccactgaagccaccctccgcccggactcaacagccgccagcaagctcgcctggcagtgcccctggagcaccattgtcgctggggagggagagccgggaagggtggagaaggaggcagaagggacatgtatgaaaaaaggacaggaaacctgaccagaggcggtttccagagccccagccttggagacaaggacactgccacccagcgccacagtcagtctgggaggggcccacgccccccaccccccatgccacactgccgcctcttgctggccatggttctccggcttgggggaacgcaggttcccagctgcgcccctcccccgcgcacacacaccctcccctgtccctcggaaagactaggccagggtctggggatgggattctgctgccaggggtcctgcctgcccccactcaccccagacgcttcggatgctgcagctcctggataatctccacaggactcggcttcctctcctcaaatgaataaaggcctcctacctcaactccc

SEQ ID NO: 3111 - DNA, 2697 bp, Homo sapiens
atgggggcgtgggccctggcaagtgcactcctcagccaatcagcgtcctgcccggctggtggattcggttacaagcccaagatcaccccatactccagcctctttcctcctcctcccgcagctccattcattggtcccgccgcaccgggcctgctgggctccgcttccgttccactgctcagctgccgcctggtggggccaccaagggcaggcatcccaggggctttgtctgactggactgggccagtgcagaatgggggttcaggcagggctgtttgggatgctgggcttcctgggggtggccctggggggctcccctgccctccgctggtacaggacctcctgccacttgaccaaggccgtccctggcaacccactggggtacctgagcttcctggccaaggatgctcagggactggccctgatccatgcccgctgggatgcgcataggaggctgcagtcatgtagctgggaggatgagccggagctcaccgcagcctacggtgctctctgtgctcatgagactgcctggggctccttcatccacacccccggacccgagctgcagagagcactggccactcttcagagtcagtgggaggcatgccgagcgcttgaggagagtccagcaggggccaggaagaagcgagcagcagggcagagtggagtccctggtggagggcaccagcgagagaagagaggatggaccatgcctggcacactgtggtgtggagttggagattctgctgggaactcctcggagctgggggtcttccagggacctgatctctgttgccgggaacatgaccgctgcccacagaacatctcacccttgcagtacaactatggcatccgaaactaccgattccacaccatctcccactgtgactgtgacaccaggtttcagcaatgcctacagaatcagcacgactccatctcggacatcgtgggcgtggccttcttcaacgtgctggagatcccctgctttgtgctggaggagcaggaggcgtgtgtggcgtggtactggtggggcgggtgtaggatgtacggcacagtgcccctcgctcgcctgcagcccaggaccttctacaatgcctcctggagctcccgggccacctccccaactcccagctcccggagcccagcccctcccaagcctcgacagaagcagcaccttcggaaggggccaccacatcagaaagggtccaagcgccccagcaaagccaacaccacagccctccaggaccctatggtctctcccaggcttgatgtggcccccacaggcctccagggcccacagggtggcctaaaacctcagggtgcccgctgggtctgccgcagcttccgccgccacctggaccagtgtgagcaccagattgggccccgggaaatcgagttccagctgctcaacagcgcccaagagcccctcttccactgcaactgcacgcgccgtctggcacgcttcctgaggctccacagcccacccgaggttaccaacatgctttgggagctgctgggcacaacctgcttcaagctggcccctccactggactgtgtggaaggcaaaaactgttccagagaccctagggccatcagggtgtcagcccggcacttgcggaggcttcagcagaggcgacaccagctccaggataaaggcacagatgagaggcagccatggccttcagagcccctgagaggccccatgtcattctacaaccagtgcctgcagctaacccaggcagccaggagacccgacaggcagcagaagtcctggagccagtgacctcagtttcagctttcctgggcaccagcctggaccttgcccatggctatgccaagccttgggaatctcagcctcccctccgtaggttagactgaagcatggcagaggctgttgtggacaatcaagaggatgaatggggggatctcaaggcccaaatgctggaccacatctcctgctgttctgggtaaccttgagctatgtatgacacaactcttctatgcctggatgtggtgttcaggaagctcattctgatgccctgggctttggccttgccagggaacttcacatacagatgagaatggggaaagggtaacttattgcagcagccccaggcagtaccaggaggaggtacatgtatgtccgtgttgcaaaaataatacatgcctcaaaaacctgcctaggggagccctagtgcctgggtgctgtggcctgaggtagcaggtgggaagttagggatgtcacagaaatgtctgtgtctgaatccaggattggggtgggtgttggagagggctttcagctcccctcctcccaggggggcctctttttttaacggctgccgtgcccttcctggcccagccctaaacctaaattcaaatctcctccatgcctttgcgcaaaggacctccctcttgcactctaagccttagtttcctcctctaaaaaaagggggtctctaaacaggagctacctcatagggttgttgaggattaagtgaaccaatacatatacagtgcttagcacttaataagtattcccccctgcgacacctagctgaactatggtttggtgtctgatcttgagaggttgatgtaaccttttaaaggcctcagttcgctcacctgtgaaatgggtctaagaatagcactgatctcacagggttgtgatgcagattaaaggagatggcatgtgtaatg

SEQ ID NO: 3112 - DNA, 2875 bp, Homo sapiens
aggataagactttctctaagtccggagctgaaaaaggatcctgactgaaagctagaggcattgaggagcctgaagattctcaggttttaaagacgctagagtgccaaagaagactttgaagtgtgaaaacatttcctgtaattgaaaccaaaatgtcatttatagatccttaccagcacattatagtggagcaccagtattcccacaagtttacggtagtggtgttacgtgccaccaaagtgacaaagggggcctttggtgacatgcttgatactccagatccctatgtggaactttttatctctacaacccctgacagcaggaagagaacaagacatttcaataatgacataaaccctgtgtggaatgagacctttgaatttattttggatcctaatcaggaaaatgttttggagattacgttaatggatgccaattatgtcatggatgaaactctagggacagcaacatttactgtatcttctatgaaggtgggagaaaagaaagaagttccttttattttcaaccaagtcactgaaatggttctagaaatgtctcttgaagtttgctcatgcccagacctacgatttagtatggctctgtgtgatcaggagaagactttcagacaacagagaaaagaacacataagggagagcatgaagaaactcttgggtccaaagaatagtgaaggattgcattctgcacgtgatgtgcctgtggtagccatattgggttcaggtgggggtttccgagccatggtgggattctctggtgtgatgaaggcattatacgaatcaggaattctggattgtgctacctacgttgctggtctttctggctccacctggtatatgtcaaccttgtattctcaccctgattttccagagaaagggccagaggagattaatgaagaactaatgaaaaatgttagccacaatccccttttacttctcacaccacagaaagttaaaagatatgttgagtctttatggaagaagaaaagctctggacaacctgtcacctttactgatatctttgggatgttaataggagaaacactaattcataatagaatgaatactactctgagcagtttgaaggaaaaagttaatactgcacaatgccctttacctcttttcacctgtcttcatgtcaaacctgacgtttcagagctgatgtttgcagattgggttgaatttagtccatacgaaattggcatggctaaatatggtacttttatggctcccgacttatttggaagcaaattttttatgggaacagtcgttaagaagtatgaagaaaaccccttgcatttcttaatgggtgtctggggcagtgccttttccatattgttcaacagagttttgggcgtttctggttcacaaagcagaggctccacaatggaggaagaattagaaaatattaccacaaagcatattgtgagtaatgatagctcggacagtgatgatgaatcacacgaacccaaaggcactgaaaatgaagatgctggaagtgactatcaaagtgataatcaagcaagttggattcatcgtatgataatggccttggtgagtgattcagctttattcaataccagagaaggacgtgctgggaaggtacacaacttcatgctgggcttgaatctcaatacatcttatccactgtctcctttgagtgactttgccacacaggactcctttgatgatgatgaactggatgcagctgtagcagatcctgatgaatttgagcgaatatatgagcctctggatgtcaaaagtaaaaagattcatgtagtggacagtgggctcacatttaacctgccgtatcccttgatactgagacctcagagaggggttgatctcataatctcctttgacttttctgcaaggccaagtgactctagtcctccgttcaaggaacttctacttgcagaaaagtgggctaaaatgaacaagctcccctttccaaagattgatccttatgtgtttgatcgggaagggctgaaggagtgctatgtctttaaacccaagaatcctgatatggagaaagattgcccaaccatcatccactttgttctggccaacatcaacttcagaaagtacagggctccaggtgttccaagggaaactgaggaagagaaagaaatcgctgactttgatatttttgatgacccagaatcaccattttcaaccttcaattttcaatatccaaatcaagcattcaaaagactacatgatcttatgcacttcaatactctgaacaacattgatgtgataaaagaagccatggttgaaagcattgaatatagaagacagaatccatctcgttgctctgtttcccttagtaatgttgaggcaagaagatttttcaacaaggagtttctaagtaaacccaaagcatagttcatgtactggaaatggcagcagtttctgatgctgaggcagtttgcaatcccatgacaactggatttaaaagtacagtacagatagtcgtactgatcatgagagactggctgatactcaaagttgcagttacttagctgcatgagaataatactattataagttaggttgacaaatgatgttgattatgtaaggatatacttagctacattttcagtcagtatgaacttcctgatacaaatgtagggatatatactgtatttttaaacatttctcaccaactttcttatgtgtgttctttttaaaaattttttttcttttaaaatatttaacagttcaatctcaataagacctcgcattatgtatgaatgttattcactgactagatttattcataccatgagacaacactatttttatttatatatgcatatatatacatacatgaaataaatacatcaatataaaaataa

SEQ ID NO: 3113 - DNA, 294 bp, Homo sapiens
aagactttctctaagtccggagctgaaaaaggatcctgactgaaagctagaggcattgaggagcctgaagattctcaggttttaaagacgctagagtgccaaagaagactttgaagtgtgaaaacatttcctgtaattgaaaccaaaatgtcatttatagatccttaccagcacattatagtggagcaccagtattcccacaagtttacggtagtggtgttacgtgccaccaaagtgacaaagggggcctttggtgacatgcccaaagtgacaaagggggcctttggtgacatg

SEQ ID NO: 3114 - DNA, 2351 bp, Homo sapiens
atcctgactgaaagctagaggcattgaggagcctgaagattctcaggttttaaagacgctagagtgccaaagaagactttgaagtgtgaaaacatttcctgtaattgaaaccaaaatgtcatttatagatccttaccagcacattatagtggagcaccagtattcccacaagtttacggtagtggtgttacgtgccaccaaagtgacaaagggggcctttggtgacatgcttgatactccagatccctatgtggaactttttatctctacaacccctgacagcaggaagagaacaagacatttcaataatgacataaaccctgtgtggaatgagacctttgaatttattttggatcctaatcaggaaaatgttttggagattacgttaatggatgccaattatgtcatggatgaaactctagggacagcaacatttactgtatcttctatgaaggtgggagaaaagaaagaagttccttttattttcaaccaagtgcctgtggtagccatattgggttcaggtgggggtttccgagccatggtgggattctctggtgtgatgaaggcattatacgaatcaggaattctggattgtgctacctacgttgctggtctttctggctccacctggtatatgtcaaccttgtattctcaccctgattttccagagaaagggccagaggagattaatgaagaactaatgaaaaatgttagccacaatccccttttacttctcacaccacagaaagttaaaagatatgttgagtctttatggaagaagaaaagctctggacaacctgtcacctttactgatatctttgggatgttaataggagaaacactaattcataatagaatgaatactactctgagcagtttgaaggaaaaagttaatactgcacaatgccctttacctcttttcacctgtcttcatgtcaaacctgacgtttcagagctgatgtttgcagattgggttgaatttagtccatacgaaattggcatggctaaatatggtacttttatggctcccgacttatttggaagcaaattttttatgggaacagtcgttaagaagtatgaagaaaaccccttgcatttcttaatgggtgtctggggcagtgccttttccatattgttcaacagagttttgggcgtttctggttcacaaagcagaggctccacaatggaggaagaattagaaaatattaccacaaagcatattgtgagtaatgatagctcggacagtgatgatgaatcacacgaacccaaaggcactgaaaatgaagatgctggaagtgactatcaaagtgataatcaagcaagttggattcatcgtatgataatggccttggtgagtgattcagctttattcaataccagagaaggacgtgctgggaaggtacacaacttcatgctgggcttgaatctcaatacatcttatccactgtctcctttgagtgactttgccacacaggactcctttgatgatgatgaactggatgcagctgtagcagatcctgatgaatttgagcgaatatatgagcctctggatgtcaaaagtaaaaagattcatgtagtggacagtgggctcacatttaacctgccgtatcccttgatactgagacctcagagaggggttgatctcataatctcctttgacttttctgcaaggccaagtgactctagtcctccgttcaaggaacttctacttgcagaaaagtgggctaaaatgaacaagctcccctttccaaagattgatccttatgtgtttgatcgggaagggctgaaggagtgctatgtctttaaacccaagaatcctgatatggagaaagattgcccaaccatcatccactttgttctggccaacatcaacttcagaaagtacagggctccaggtgttccaagggaaactgaggaagagaaagaaatcgctgactttgatatttttgatgacccagaatcaccattttcaaccttcaattttcaatatccaaatcaagcattcaaaagactacatgatcttatgcacttcaatactctgaacaacattgatgtgataaaagaagccatggttgaaagcattgaatatagaagacagaatccatctcgttgctctgtttcccttagtaatgttgaggcaagaagatttttcaacaaggagtttctaagtaaacccaaagcatagttcatgtactggaaatggcagcagtttctgatgctgaggcagtttgcaatcccatgacaactggatttaaaagtacagtacagatagtcgtactgatcatgagagactggctgatactcaaagttgcagttacttagctgcatgagaataatactattataagtta

SEQ ID NO: 3115 - DNA, 2985 bp, Homo sapiens
agacggggtttcaccgtgttagccagtatggtcttgatctcctgacctcgtgatccacctgcctcggcctcccaaaagtgctgggattacaggtgtgagctgctgcgcctggcttatgagtcgtatgttctgatcctccctcttgaagttgccttctgtggtctaaggagggcctgaaggttcaggtggctggttcaggagtgggtgtggagcttaggtggagcagaggcggcgggtaggagggacttgggaccaattgggacatcacatccctggctctgggttagaaagctgacagtccttgatcctgtggccactgccccatcattcctgctcctgaggactcagtctcatggctgtggcagaggtgtccaggacctgcctgctcacggttcgtgtcctgcaggcccatcgcctaccctctaaggacctagtgaccccctctgactgctacgtgactctctggctgcccacggcctgcagccacaggctccagacacgcacggtcaagaacagcagtagccctgtctggaaccagagctttcacttcaggatccacaggcagctcaagaatgtcatggaactgaaagtctttgaccaggacctggtgaccggagatgaccctgtgttgtcagtactgtttgatgcggggactctgcgggctggggagttccggcgcgagagcttctcactgagccctcagggtgaggggcgcctggaagttgaatttcgcctgcagagtctggctgaccgtggcgagtggctcgtcagcaatggcgttctggtggcccgggagctctcctgcttgcacgttcaactggaggagacaggagaccagaagtcctcagagcacagagttcagcttgtggttcctgggtcctgtgagggtccgcaggaggcctctgtgggcactggcaccttccgcttccactgcccagcctgctgggagcaggagctgagtattcgcctgcaggatgcccccgaggagcaactaaaggcgccactgagtgccctgccctctggtcaagtggtgaggcttgtcttccccacgtcccaggagcccctgatgagagtggagctgaaaaaagaagcaggactgagggagctggccgtgcgactgggcttcgggccctgtgcagaggagcaggccttcctgagcaggaggaagcaggtggtggccgcggccttgaggcaggccctgcagctggacggagacctgcaggaggatgagatcccagtggtagctattatggccactggtggtgggatccgggcaatgacttccctgtatgggcagctggctggcctgaaggagctgggcctcttggattgcgtctcctacatcaccggggcctcgggctccacctgggccttggccaacctttatgaggacccagagtggtctcagaaggacctggcagggcccactgagttgctgaagacccaggtgaccaagaacaagctgggtgtgctggcccccagccagctgcagcggtaccggcaggagctggccgagcgtgcccgcttgggctacccaagctgcttcaccaacctgtgggccctcatcaacgaggcgctgctgcatgatgagccccatgatcacaagctctcagatcaacgggaggccctgagtcatggccagaaccctctgcccatctactgtgccctcaacaccaaagggcagagcctgaccacttttgaatttggggagtggtgcgagttctctccctacgaggtcggcttccccaagtacggggccttcatcccctctgagctctttggctccgagttctttatggggcagctgatgaagaggcttcctgagtcccgcatctgcttcttagaaggtatctggagcaacctgtatgcagccaacctccaggacagcttatactgggcctcagagcccagccagttctgggaccgctgggtcaggaaccaggccaacctggacaaggagcaggtcccccttctgaagatagaagaaccaccctcaacagccggcaggatagctgagtttttcaccgatcttctgacgtggcgtccactggcccaggccacacataatttcctgcgtggcctccatttccacaaagactactttcagcatcctcacttctccacatggaaagctaccactctggatgggctccccaaccagctgacaccctcggagccccacctgtgcctgctggatgttggctacctcatcaataccagctgcctgcccctcctgcagcccactcgggacgtggacctcatcctgtcattggactacaacctccacggagccttccagcagttgcagctcctgggccggttctgccaggagcaggggatcccgttcccacccatctcgcccagccccgaagagcagctccagcctcgggagtgccacaccttctccgaccccacctgccccggagcccctgcggtgctgcactttcctctggtcagcgactccttccgggagtactcggcccctggggtccggcggacacccgaggaggcggcagctggggaggtgaacctgtcttcatcggactctccctaccactacacgaaggtgacctacagccaggaggacgtggacaagctgctgcacctgacacattacaatgtctgcaacaaccaggagcagctgctggaggctctgcgccaggcagtgcagcggaggcggcagcgcaggccccactgatggccggggcccctgccacccctaactctcattcattccctggctgctgagttgcaggtgggaactgtcatcacgcagtgcttcagagcctcgggctcaggtggcacggtcccagggtccaggctgagggctgggagctcccttgcgcctcagcagtttgcagtggggtaaggaggccaagcccatttgtgtaatcacccaaaaccccccggcctgtgcctgttttcccttctgcgctaccttgagtagttggagcacttgatacatcacagactcatacaaatgtg

SEQ ID NO: 3116 - DNA, 1161 bp, Homo sapiens
cagggttctacccggctgggtccaggcagaagtttttcctccccacctccgggtttgtcctcatcatcggtcactcccattcacagctttaagattctggaggccaagaatttgactccccccggatccatggtctgtggataccaatgttccgactggagacggggagcccgcgagacccgggtctccagggtctgcccaaggaagttgctcatgggagcagacctctagagcaggatttgaggccaggccaaagagaaccccagagatgaaaggcctcctcccactggcttggttcctggcttgtagtgtgcctgctgtgcaaggaggcttgctggacctaaaatcaatgatcgagaaggtgacagggaagaacgccctgacaaactacggcttctacggctgttactgcggctggggcggccgaggaacccccaaggatggcaccgattggtgctgttgggcgcatgaccactgctatgggcggctggaggagaagggctgcaacattcgcacacagtcctacaaatacagattcgcgtggggcgtggtcacctgcgagcccgggcccttctgccatgtgaacctctgtgcctgtgaccggaagctcgtctactgcctcaagagaaacctacggagctacaacccacagtaccaatactttcccaacatcctctgctcctaggcctccccagcgagctcctcccagaccaagacttttgttctgtttttctacaacacagagtactgactctgcctggttcctgagagaggctcctaagtcacagacctcagtctttctcgaagcttggcggacccccagggccacactgtaccctccagcgagtcccaggagagtgactctggtcataggacttggtagggtcccagggtccctaggcctccacttctgagggcagcccctctggtgccaagagctctcctccaactcagggttggctgtgtctcttttcttctctgaagacagcgtcctggctccagttggaacactttcctgagatgcacttacttctcagcttctgcgatcagattatcatcaccaccaccctccagagaatttttacgcaagaagagccaaattgactctctaaatctggtgtatgggtattaaataaaattcattctcaaggctaataaaaa

SEQ ID NO: 3117 - DNA, 3271 bp, Homo sapiens
aagtgctgagtaagccgaggtgagtgacctcgcgggtgggcggggcctgggggtccgttccccaacttcctcggcgctccggactcccaagtctccgccggaccctcctttggatattcctcgtgtctccgattctgagacagagggggaagacggtggggcctccccacctgccccgcagaagatgcagttctttggccgcctggtcaataccttcagtggcgtcaccaacttgttctctaacccattccgggtgaaggaggtggctgtggccgactacacctcgagtgaccgagttcgggaggaagggcagctgattctgttccagaacactcccaaccgcacctgggactgcgtcctggtcaaccccaggaactcacagagtggattccgactcttccagctggagttggaggctgacgccctagtgaatttccatcagtattcttcccagctgctacccttctatgagagctcccctcaggtcctgcacactgaggtcctgcagcacctgaccgacctcatccgtaaccaccccagctggtcagtggcccacctggctgtggagctagggatccgcgagtgcttccatcacagccgtatcatcagctgtgccaattgcgcggagaacgaggagggctgcacacccctgcacctggcctgccgcaagggtgatggggagatcctggtggagctggtgcagtactgccacactcagatggatgtcaccgactacaagggagagaccgtcttccattatgctgtccagggtgacaattctcaggtgctgcagctccttggaaggaacgcagtggctggcctgaaccaggtgaataaccaagggctgaccccgctgcacctggcctgccagctggggaagcaggagatggtccgcgtgctgctgctgtgcaatgctcggtgcaacatcatgggccccaacggctaccccatccactcggccatgaagttctctcagaaggggtgtgcggagatgatcatcagcatggacagcagccagatccacagcaaagacccccgttacggagccagccccctccactgggccaagaacgcagagatggcccgcatgctgctgaaacggggctgcaacgtgaacagcaccagctccgcggggaacacggccctgcacgtggcggtgatgcgcaaccgcttcgactgtgccatagtgctgctgacccacggggccaacgcggatgcccgcggagagcacggcaacaccccgctgcacctggccatgtcgaaagacaacgtggagatgatcaaggccctcatcgtgttcggagcagaagtggacaccccgaatgactttggggagactcctacattcctagcctccaaaatcggcagacttgtcaccaggaaggcgatcttgactctgctgagaaccgtgggggccgaatactgcttcccacccatccacggggtccccgcggagcagggctctgcagcgccacatcatcccttctccctggaaagagctcagcccccaccgatcagcctaaacaacctagaactacaggatctcatgcacatctcacgggcccggaagccagcgttcatcctgggctccatgagggacgagaagcggacccacgaccacctgctgtgcctggatggaggaggagtgaaaggcctcatcatcatccagctcctcatcgccatcgagaaggcctcgggtgtggccaccaaggacctgtttgactgggtggcgggcaccagcactggaggcatcctggccctggccattctgcacagtaagtccatggcctacatgcgcggcatgtactttcgcatgaaggatgaggtgttccggggctccaggccctacgagtcggggcccctggaggagttcctgaagcgggagtttggggagcacaccaagatgacggacgtcaggaaacccaaggtgatgctgacagggacactgtctgaccggcagccggctgaactccacctcttccggaactacgatgctccagaaactgtccgggagcctcgtttcaaccagaacgttaacctcaggcctccagctcagccctcagaccagctggtgtggcgggcggcccgaagcagcggggcagctcctacttacttccgacccaatgggcgcttcctggacggtgggctgctggccaacaaccccacgctggatgccatgaccgagatccatgagtacaatcaggacctgatccgcaagggtcaggccaacaaggtgaagaaactctccatcgttgtctccctggggacagggaggtccccacaagtgcctgtgacctgtgtggatgtcttccgtcccagcaacccctgggagctggccaagactgtttttggggccaaggaactgggcaagatggtggtggactgttgcacggatccagacgggcgggctgtggaccgggcacgggcctggtgcgagatggtcggcatccagtacttcagattgaacccccagctggggacggacatcatgctggatgaggtcagtgacacagtgctggtcaacgccctctgggagaccgaggtctacatctatgagcaccgcgaggagttccagaagctcatccagctgctgctctcaccctgagggtccccagcctctcaccggccccagctgacctcgtccattcagcccctgccaggccaagcccagccactgccctcccgggcagatctgggcccaggcacctctgagtccatagaccaggcctgggagaatgccaagctgcctgcccgaggctggtcctgaaggcctgtctcccactaaccccgccttccagcactttctgtcattccaggctgggaaagtctagagccccctttggcccctttccctgactgtcaaggacaactgactcccccatcagctcaaacattaagggtacccgggcacaaccgtacccctgcccccagccccagcctccctgagggcctgccgggctgcctctgccccagcccccagcaagggcactcccaggcttcctggtgggtgcagcccactccctctgccctctgctccgttccctgggggctgggactaaagaaatgggtgtcccccaccccatcagctgggaaagcccaggccgcaggagtgggatgcccgttggactttgcccctcacactggcccagcccctcacactgccccaccccgagaaccctcagctctcaaaggtcactcctgggagtttcttcttcccaatggaagtggcttaagagccaaaactgaaataaatcatttggattcaagttca

SEQ ID NO: 3118 - DNA, 1411 bp, Homo sapiens
ccgttccccaacttcctcggcgctccggactcccaagtctccgccggaccctcctttggatattcctcgtgtctccgattctgagacagagggggaagacggtggggcctccccacctgccccgcagaagatgcagttctttggccgcctggtcaataccttcagtggcgtcaccaacttgttctctaacccattccgggtgaaggaggtggctgtggccgactacacctcgagtgaccgagttcgggaggaagggcagctgattctgttccagaacactcccaaccgcacctgggactgcgtcctggtcaaccccaggaactcacagagtggattccgctgtgccaattgcgcggagaacgaggagggctgcacacccctgcacctggcctgccgcaagggtgatggggagatcctggtggagctggtgcagtactgccacactcagatggatgtcaccgactacaagggagagaccgtcttccattatgctgtccagggtgacaattctcaggtgctgcagctccttggaaggaacgcagtggctggcctgaaccaggtgaataaccaagggctgaccccgctgcacctggcctgccagctggggaagcaggagatggtccgcgtgctgctgctgtgcaatgctcggtgcaacatcatgggccccaacggctaccccatccactcggccatgaagttctctcagaaggggtgtgcggagatgatcatcagcatggacagcagccagatccacagcaaagacccccgttacggagccagccccctccactgggccaagaacgcagagatggcccgcatgctgctgaaacggggctgcaacgtgaacagcaccagctccgcggggaacacggccctgcacgtggcggtgatgcgcaaccgcttcgactgtgccatagtgctgctgacccacggggccaacgcggatgcccgcggagagcacggcaacaccccgctgcacctggccatgtcgaaagacaacgtggagatgatcaaggccctcatcgtgttcggagcagaagtggacaccccgaatgactttggggagactcctacattcctagcctccaaaatcggcagacttgtcaccaggaaggcgatcttgactctgctgagaaccgtgggggccgaatactgcttcccacccatccacggggtccccgcggagcagggctctgcagcgccacatcatcccttctccctggaaagagctcagcccccaccgatcagcctaaacaacctaggcagtcacccaagccaggccggatggtgggcctggggtgcggcgtcagatggaactacaggatctcatgcacatctcacgggcccggaagccagcgttcatcctgggctccatgagggacgagaagcggacagacagaacatggagagc

SEQ ID NO: 3119 - DNA, 3060 bp, Homo sapiens
gggggtccgttccccaacttcctcggcgctccggactcccaagtctccgccggaccctcctttggatattcctcgtgtctccgattctgagacagagggggaagacggtggggcctccccacctgccccgcagaagatgcagttctttggccgcctggtcaataccttcagtggcgtcaccaacttgttctctaacccattccgggtgaaggaggtggctgtggccgactacacctcgagtgaccgagttcgggaggaagggcagctgattctgttccagaacactcccaaccgcacctgggactgcgtcctggtcaaccccaggaactcacagagtggattccgactcttccagctggagttggaggctgacgccctagtgaatttccatcagtattcttcccagctgctacccttctatgagagctcccctcaggtcctgcacactgaggtcctgcagcacctgaccgacctcatccgtaaccaccccagctggtcagtggcccacctggctgtggagctagggatccgcgagtgcttccatcacagccgtatcatcagctgtgccaattgcgcggagaacgaggagggctgcacacccctgcacctggcctgccgcaagggtgatggggagatcctggtggagctggtgcagtactgccacactcagatggatgtcaccgactacaagggagagaccgtcttccattatgctgtccagggtgacaattctcaggtgctgcagctccttggaaggaacgcagtggctggcctgaaccaggtgaataaccaagggctgaccccgctgcacctggcctgccagctggggaagcaggagatggtccgcgtgctgctgctgtgcaatgctcggtgcaacatcatgggccccaacggctaccccatccactcggccatgaagttctctcagaaggggtgtgcggagatgatcatcagcatggacagcagccagatccacagcaaagacccccgttacggagccagccccctccactgggccaagaacgcagagatggcccgcatgctgctgaaacggggctgcaacgtgaacagcaccagctccgcggggaacacggccctgcacgtggcggtgatgcgcaaccgcttcgactgtgccatagtgctgctgacccacggggccaacgcggatgcccgcggagagcacggcaacaccccgctgcacctggccatgtcgaaagacaacgtggagatgatcaaggccctcatcgtgttcggagcagaagtggacaccccgaatgactttggggagactcctacattcctagcctccaaaatcggcagacaactacaggatctcatgcacatctcacgggcccggaagccagcgttcatcctgggctccatgagggacgagaagcggacccacgaccacctgctgtgcctggatggaggaggagtgaaaggcctcatcatcatccagctcctcatcgccatcgagaaggcctcgggtgtggccaccaaggacctgtttgactgggtggcgggcaccagcactggaggcatcctggccctggccattctgcacagtaagtccatggcctacatgcgcggcatgtactttcgcatgaaggatgaggtgttccggggctccaggccctacgagtcggggcccctggaggagttcctgaagcgggagtttggggagcacaccaagatgacggacgtcaggaaacccaaggtgatgctgacagggacactgtctgaccggcagccggctgaactccacctcttccggaactacgatgctccagaaactgtccgggagcctcgtttcaaccagaacgttaacctcaggcctccagctcagccctcagaccagctggtgtggcgggcggcccgaagcagcggggcagctcctacttacttccgacccaatgggcgcttcctggacggtgggctgctggccaacaaccccacgctggatgccatgaccgagatccatgagtacaatcaggacctgatccgcaagggtcaggccaacaaggtgaagaaactctccatcgttgtctccctggggacagggaggtccccacaagtgcctgtgacctgtgtggatgtcttccgtcccagcaacccctgggagctggccaagactgtttttggggccaaggaactgggcaagatggtggtggactgttgcacggatccagacgggcgggctgtggaccgggcacgggcctggtgcgagatggtcggcatccagtacttcagattgaacccccagctggggacggacatcatgctggatgaggtcagtgacacagtgctggtcaacgccctctgggagaccgaggtctacatctatgagcaccgcgaggagttccagaagctcatccagctgctgctctcaccctgagggtccccagcctctcaccggccccagctgacctcgtccattcagcccctgccaggccaagcccagccactgccctcccgggcagatctgggcccaggcacctctgagtccatagaccaggcctgggagaatgccaagctgcctgcccgaggctggtcctgaaggcctgtctcccactaaccccgccttccagcactttctgtcattccaggctgggaaagtctagagccccctttggcccctttccctgactgtcaaggacaactgactcccccatcagctcaaacattaagggtacccgggcacaaccgtacccctgcccccagccccagcctccctgagggcctgccgggctgcctctgccccagcccccagcaagggcactcccaggcttcctggtgggtgcagcccactccctctgccctctgctccgttccctgggggctgggactaaagaaatgggtgtcccccaccccatcagctgggaaagcccaggccgcaggagtgggatgcccgttggactttgcccctcacactggcccagcccctcacactgccccaccccgagaaccctcagctctcaaaggtcactcctgggagtttcttcttcccaatggaagtggcttaagagccaaaactgaaataaatcatttggattcaagttc

SEQ ID NO: 3120 - DNA, 1567 bp, Homo sapiens
ccgttccccaacttcctcggcgctccggactcccaagtctccgccggaccctcctttggatattcctcgtgtctccgattctgagacagagggggaagacggtggggcctccccacctgccccgcagaagatgcagttctttggccgcctggtcaataccttcagtggcgtcaccaacttgttctctaacccattccgggtgaaggaggtggctgtggccgactacacctcgagtgaccgagttcgggaggaagggcagctgattctgttccagaacactcccaaccgcacctgggactgcgtcctggtcaaccccaggaactcacagagtggattccgactcttccagctggagttggaggctgacgccctagtgaatttccatcagtattcttcccagctgctacccttctatgagagctcccctcaggtcctgcacactgaggtcctgcagcacctgaccgacctcatccgtaaccaccccagctggtcagtggcccacctggctgtggagctagggatccgcgagtgcttccatcacagccgtatcatcagctgtgccaattgcgcggagaacgaggagggctgcacacccctgcacctggcctgccgcaagggtgatggggagatcctggtggagctggtgcagtactgccacactcagatggatgtcaccgactacaagggagagaccgtcttccattatgctgtccagggtgacaattctcaggtgctgcagctccttggaaggaacgcagtggctggcctgaaccaggtgaataaccaagggctgaccccgctgcacctggcctgccagctggggaagcaggagatggtccgcgtgctgctgctgtgcaatgctcggtgcaacatcatgggccccaacggctaccccatccactcggccatgaagttctctcagaaggggtgtgcggagatgatcatcagcatggacagcagccagatccacagcaaagacccccgttacggagccagccccctccactgggccaagaacgcagagatggcccgcatgctgctgaaacggggctgcaacgtgaacagcaccagctccgcggggaacacggccctgcacgtggcggtgatgcgcaaccgcttcgactgtgccatagtgctgctgacccacggggccaacgcggatgcccgcggagagcacggcaacaccccgctgcacctggccatgtcgaaagacaacgtggagatgatcaaggccctcatcgtgttcggagcagaagtggacaccccgaatgactttggggagactcctacattcctagcctccaaaatcggcagacttgtcaccaggaaggcgatcttgactctgctgagaaccgtgggggccgaatactgcttcccacccatccacggggtccccgcggagcagggctctgcagcgccacatcatcccttctccctggaaagagctcagcccccaccgatcagcctaaacaacctagaactacaggatctcatgcacatctcacgggcccggaagccagcgttcatcctgggctccatgagggacgagaagcggacagacagaaca

SEQ ID NO: 3121 - DNA, 3011 bp, Homo sapiens
tttgtttgcggaagtaggaggaagtagaagtgctgagtaagccgagacagagggggaagacggtggggcctccccacctgccccgcagaagatgcagttctttggccgcctggtcaataccttcagtggcgtcaccaacttgttctctaacccattccgggtgaaggaggtggctgtggccgactacacctcgagtgaccgagttcgggaggaagggcagctgattctgttccagaacactcccaaccgcacctgggactgcgtcctggtcaaccccaggaactcacagagtggattccgactcttccagctggagttggaggctgacgccctagtgaatttccatcagtattcttcccagctgctacccttctatgagagctcccctcaggtcctgcacactgaggtcctgcagcacctgaccgacctcatccgtaaccaccccagctggtcagtggcccacctggctgtggagctagggatccgcgagtgcttccatcacagccgtatcatcagctgtgccaattgcgcggagaacgaggagggctgcacacccctgcacctggcctgccgcaagggtgatggggagatcctggtggagctggtgcagtactgccacactcagatggatgtcaccgactacaagggagagaccgtcttccattatgctgtccagggtgacaattctcaggtgctgcagctccttggaaggaacgcagtggctggcctgaaccaggtgaataaccaagggctgaccccgctgcacctggcctgccagctggggaagcaggagatggtccgcgtgctgctgctgtgcaatgctcggtgcaacatcatgggccccaacggctaccccatccactcggccatgaagttctctcagaaggggtgtgcggagatgatcatcagcatggacagcagccagatccacagcaaagacccccgttacggagccagccccctccactgggccaagaacgcagagatggcccgcatgctgctgaaacggggctgcaacgtgaacagcaccagctccgcggggaacacggccctgcacgtggcggtgatgcgcaaccgcttcgactgtgccatagtgctgctgacccacggggccaacgcggatgcccgcggagagcacggcaacaccccgctgcacctggccatgtcgaaagacaacgtggagatgatcaaggccctcatcgtgttcggagcagaagtggacaccccgaatgactttggggagactcctacattcctagcctccaaaatcggcagacaactacaggatctcatgcacatctcacgggcccggaagccagcgttcatcctgggctccatgagggacgagaagcggacccacgaccacctgctgtgcctggatggaggaggagtgaaaggcctcatcatcatccagctcctcatcgccatcgagaaggcctcgggtgtggccaccaaggacctgtttgactgggtggcgggcaccagcactggaggcatcctggccctggccattctgcacagtaagtccatggcctacatgcgcggcatgtactttcgcatgaaggatgaggtgttccggggctccaggccctacgagtcggggcccctggaggagttcctgaagcgggagtttggggagcacaccaagatgacggacgtcaggaaacccaaggtgatgctgacagggacactgtctgaccggcagccggctgaactccacctcttccggaactacgatgctccagaaactgtccgggagcctcgtttcaaccagaacgttaacctcaggcctccagctcagccctcagaccagctggtgtggcgggcggcccgaagcagcggggcagctcctacttacttccgacccaatgggcgcttcctggacggtgggctgctggccaacaaccccacgctggatgccatgaccgagatccatgagtacaatcaggacctgatccgcaagggtcaggccaacaaggtgaagaaactctccatcgttgtctccctggggacagggaggtccccacaagtgcctgtgacctgtgtggatgtcttccgtcccagcaacccctgggagctggccaagactgtttttggggccaaggaactgggcaagatggtggtggactgttgcacggatccagacgggcgggctgtggaccgggcacgggcctggtgcgagatggtcggcatccagtacttcagattgaacccccagctggggacggacatcatgctggatgaggtcagtgacacagtgctggtcaacgccctctgggagaccgaggtctacatctatgagcaccgcgaggagttccagaagctcatccagctgctgctctcaccctgagggtccccagcctctcaccggccccagctgacctcgtccattcagcccctgccaggccaagcccagccactgccctcccgggcagatctgggcccaggcacctctgagtccatagaccaggcctgggagaatgccaagctgcctgcccgaggctggtcctgaaggcctgtctcccactaaccccgccttccagcactttctgtcattccaggctgggaaagtctagagccccctttggcccctttccctgactgtcaaggacaactgactcccccatcagctcaaacattaagggtacccgggcacaaccgtacccctgcccccagccccagcctccctgagggcctgccgggctgcctctgccccagcccccagcaagggcactcccaggcttcctggtgggtgcagcccactccctctgccctctgctccgttccctgggggctgggactaaagaaatgggtgtcccccaccccatcagctgggaaagcccaggccgcaggagtgggatgcccgttggactttgcccctcacactggcccagcccctcacactgccccaccccgagaaccctcagctctcaaaggtcactcctgggagtttcttcttcccaatggaagtggcttaagagccaaaactgaaataaatcatttggattcaa

SEQ ID NO: 3122 - DNA, 2755 bp, Homo sapiens
ttgtttgcggaagtaggaggaagtagaagtgctgagtaagccgagagggggaagacggtggggcctccccacctgccccgcagaagatgcagttctttggccgcctggtcaataccttcagtggcgtcaccaacttgttctctaacccattccgggtgaaggaggtggctgtggccgactacacctcgagtgaccgagttcgggaggaagggcagctgattctgttccagaacactcccaaccgcacctgggactgcgtcctggtcaaccccaggaactcacagagtggattccgactcttccagctggagttggaggctgacgccctagtgaatttccatcagtattcttcccagctggggaagcaggagatggtccgcgtgctgctgctgtgcaatgctcggtgcaacatcatgggccccaacggctaccccatccactcggccatgaagttctctcagaaggggtgtgcggagatgatcatcagcatggacagcagccagatccacagcaaagacccccgttacggagccagccccctccactgggccaagaacgcagagatggcccgcatgctgctgaaacggggctgcaacgtgaacagcaccagctccgcggggaacacggccctgcacgtggcggtgatgcgcaaccgcttcgactgtgccatagtgctgctgacccacggggccaacgcggatgcccgcggagagcacggcaacaccccgctgcacctggccatgtcgaaagacaacgtggagatgatcaaggccctcatcgtgttcggagcagaagtggacaccccgaatgactttggggagactcctacattcctagcctccaaaatcggcagacttgtcaccaggaaggcgatcttgactctgctgagaaccgtgggggccgaatactgcttcccacccatccacggggtccccgcggagcagggctctgcagcgccacatcatcccttctccctggaaagagctcagcccccaccgatcagcctaaacaacctagaactacaggatctcatgcacatctcacgggcccggaagccagcgttcatcctgggctccatgagggacgagaagcggacccacgaccacctgctgtgcctggatggaggaggagtgaaaggcctcatcatcatccagctcctcatcgccatcgagaaggcctcgggtgtggccaccaaggacctgtttgactgggtggcgggcaccagcactggaggcatcctggccctggccattctgcacagtaagtccatggcctacatgcgcggcatgtactttcgcatgaaggatgaggtgttccggggctccaggccctacgagtcggggcccctggaggagttcctgaagcgggagtttggggagcacaccaagatgacggacgtcaggaaacccaaggtgatgctgacagggacactgtctgaccggcagccggctgaactccacctcttccggaactacgatgctccagaaactgtccgggagcctcgtttcaaccagaacgttaacctcaggcctccagctcagccctcagaccagctggtgtggcgggcggcccgaagcagcggggcagctcctacttacttccgacccaatgggcgcttcctggacggtgggctgctggccaacaaccccacgctggatgccatgaccgagatccatgagtacaatcaggacctgatccgcaagggtcaggccaacaaggtgaagaaactctccatcgttgtctccctggggacagggaggtccccacaagtgcctgtgacctgtgtggatgtcttccgtcccagcaacccctgggagctggccaagactgtttttggggccaaggaactgggcaagatggtggtggactgttgcacggatccagacgggcgggctgtggaccgggcacgggcctggtgcgagatggtcggcatccagtacttcagattgaacccccagctggggacggacatcatgctggatgaggtcagtgacacagtgctggtcaacgccctctgggagaccgaggtctacatctatgagcaccgcgaggagttccagaagctcatccagctgctgctctcaccctgagggtccccagcctctcaccggccccagctgacctcgtccattcagcccctgccaggccaagcccagccactgccctcccgggcagatctgggcccaggcacctctgagtccatagaccaggcctgggagaatgccaagctgcctgcccgaggctggtcctgaaggcctgtctcccactaaccccgccttccagcactttctgtcattccaggctgggaaagtctagagccccctttggcccctttccctgactgtcaaggacaactgactcccccatcagctcaaacattaagggtacccgggcacaaccgtacccctgcccccagccccagcctccctgagggcctgccgggctgcctctgccccagcccccagcaagggcactcccaggcttcctggtgggtgcagcccactccctctgccctctgctccgttccctgggggctgggactaaagaaatgggtgtcccccaccccatcagctgggaaagcccaggccgcaggagtgggatgcccgttggactttgcccctcacactggcccagcccctcacactgccccaccccgagaaccctcagctctcaaaggtcactcctgggagtttcttcttcccaatggaagtggcttaagagccaaaactgaaataaatcatttggattcaagttc

SEQ ID NO: 3123 - DNA, 656 bp, Homo sapiens
agtgacctcgcgggtgggcggggcctgggggtccgttccccaacttcctcggcgctccggactcccaagtctccgccggaccctcctttggatattcctcgtgtctccgattctgagagggggaagacggtggggcctccccacctgccccgcagaagatgcagttctttggccgcctggtcaataccttcagtggcgtcaccaacttgttctctaacccattccgggtgaaggaggtggctgtggccgactacacctcgagtgaccgagttcgggaggaagggcagctgattctgttccagaacactcccaaccgcacctgggactgcgtcctggtcaaccccaggaactcacagagtggattccgctgtgccaattgcgcggagaacgaggagggctgcacacccctgcacctggcctgccgcaagggtgatggggagatcctggtggagctggtgcagtactgccacactcagatggatgtcaccgactacaagggagagaccgtcttccattatgctgtccagggtgacaattctcaggtgctgcagctccttggaaggaacgcagtggctggcctgaaccaggtgaataaccaagggctgaccccgctgcacctggcctgccagctggggaagcaggagatggtccgcgtg

SEQ ID NO: 3124 - DNA, 1652 bp, Homo sapiens
gtttgtttgcggaagtaggaggaagtagaagtgctgagtaagccgagacagagggggaagacggtggggcctccccacctgccccgcagaagatgcagttctttggccgcctggtcaataccttcagtggcgtcaccaacttgttctctaacccattccgggtgaaggaggtggctgtggccgactacacctcgagtgaccgagttcgggaggaagggcagctgattctgttccagaacactcccaaccgcacctgggactgcgtcctggtcaaccccaggaactcacagagtggattccgactcttccagctggagttggaggctgacgccctagtgaatttccatcagtattcttcccagctgctacccttctatgagagctcccctcaggtcctgcacactgaggtcctgcagcacctgaccgacctcatccgtaaccaccccagctggtcagtggcccacctggctgtggagctagggatccgcgagtgcttccatcacagccgtatcatcagagtccggagtgctcaccaggtgccaggtctgtgggagctgatttctacccaccatgaaattgaattttcccaacccccacaagctgtgccaattgcgcggagaacgaggagggctgcacacccctgcacctggcctgccgcaagggtgatggggagatcctggtggagctggtgcagtactgccacactcagatggatgtcaccgactacaagggagagaccgtcttccattatgctgtccagggtgacaattctcaggtgctgcaggtgtgcggagatgatcatcagcatggacagcagccagatccacagcaaagacccccgttacggagccagccccctccactgggccaagaacgcagagatggcccgcatgctgctgaaacggggctgcaacgtgaacagcaccagctccgcggggaacacggccctgcacgtggcggtgatgcgcaaccgcttcgactgtgccatagtgctgctgacccacggggccaacgcggatgcccgcggagagcacggcaacaccccgctgcacctggccatgtcgaaagacaacgtggagatgatcaaggccctcatcgtgttcggagcagaagtggacaccccgaatgactttggggagactcctacattcctagcctccaaaatcggcagacttgtcaccaggaaggcgatcttgactctgctgagaaccgtgggggccgaatactgcttcccacccatccacggggtccccgcggagcagggctctgcagcgccacatcatcccttctccctggaaagagctcagcccccaccgatcagcctaaacaacctaggcagtcacccaagccaggccggatggtgggcctggggtgcggcgtcagatgggtaacgccctgggcctggagaggccaccgagcctagccatgcggcattagctctagctctcactccctaatccgtccttcttagctgcgcacacaccacacgccccctcccctgcaccctgtccccggcctctctcagccactcttctgcttcccttgttcactgtggagccgtgtgccctggggagggggagacaccgcttcgcagccctcggttctgctttgctgcttctagactctgcacagtggtggggggctgtcagagt

SEQ ID NO: 3125 - DNA, 364 bp, Homo sapiens
atgagttgcttgaggtcacaccgatgaggttgaagctggaatctgacaccagagcctgtgtgattgtcctgatgtgtaagacagagggggaagacggtggggcctccccacctgccccgcagaagatgcagttctttggccgcctggtcaataccttcagtggcgtcaccaacttgttctctaacccattccgggtgaaggaggtggctgtggccgactacacctcgagtgaccgagttcgggaggaagggcagctgattctgttccagaacactcccaaccgcacctgggactgcgtcctggtcaaccccaggaactcacagagtggattccgactcttccagctggagttggaggctgacgc

SEQ ID NO: 3126 - DNA, 995 bp, Homo sapiens
ggccttccaaagtgctgggattacaggcgtgagtcaccgcgcccggccaaataaaataaaatgttaaagcaaattcaggactacccctcctccaagtcttctgttccctttgggcgcccaggtgagcgggggaggggctgggggagtaataacatcaaaagagcgccttttcctcccttattccgaggagacttccctgggcctgactcccggtcctgtccccagcgccccgcggcctctggagccccttcagtgaccaagatacagagatcaggacgcctttgcgccgccccaggtgcccgcccctagctggctctgcttgggccgcgagggaaggtgaggtcgggggcggagccggggcgtgacagccggggtgtgtgtccgccgggcttggtgcctccggtggccctgcagcaccgtcccacctctgccaccctccgatggggccgctacctgtgtgcctgccaatcatgctgctcctgctactgccgtcgctgctgctgctgctgcttctacctggccccgggtccggcgaggcctccaggatattacgtgtgcaccggcgtgggatcctggaactggcaggaactgtgggttgtgttggtccccgaacccccatcgcctatatgaaatatggttgcttttgtggcttgggaggccatggccagccccgcgatgccattgactggtgctgccatggccacgactgttgttacactcgagctgaggaggccggctgcagccccaagacagagcgctactcctggcagtgcgtcaatcagagcgtcctgtgcggaccggcagagaacaaatgccaagaactgttgtgcaagtgtgaccaggagattgctaactgcttagcccaaactgagtacaacttaaagtacctcttctacccccagttcctatgtgagccggactcgcccaagtgtgactgactaccttgacttgaaatgctcttttgcacaaggaaataaagcgtcctctcagtaatg

SEQ ID NO: 3127 - DNA, 1000 bp, Homo sapiens
ggccttccaaagtgctgggattacaggcgtgagtcaccgcgcccggccaaataaaataaaatgttaaagcaaattcaggactacccctcctccaagtcttctgttccctttgggcgcccaggtgagcgggggaggggctgggggagtaataacatcaaaagagcgccttttcctcccttattccgaggagacttccctgggcctgactcccggtcctgtccccagcgccccgcggcctctggagccccttcagtgaccaagatacagagatcaggacgcctttgcgccgccccaggtgcccgcccctagctggctctgcttgggccgcgagggaaggtgaggtcgggggcggagccggggcgtgacagccggggtgtgtgtccgccgggcttggtgcctccggtggccctgcagcaccgtcccacctctgccaccctccgatggggccgctacctgtgtgcctgccaatcatgctgctcctgctactgccgtcgctgctgctgctgctgcttctacctggccccgggtccggcgaggcctccaggatattacgtgtgcaccggcgtgggatcctggaactggcaggaactgtgggttgtgttggtccccgaacccccatcgcctatatgaaatatggttgcttttgtggcttgggaggccatggccagccccgcgatgccattgactggtgctgccatggccacgactgttgttacactcgagctgaggaggccggctgcagccccaagacagagcgctactcctggcagtgcgtcaatcagagcgtcctgtgcggaccggcagagaacaaatgccaagaactgttgtgcaagtgtgaccaggagattgctaactgcttagcccaaactgagtacaacttaaagtacctcttctacccccagttcctatgtgagccggactcgcccaagtgtgactgactaccttgacttgaaatgctcttttgcacaaggaaataaagcgtcctctcagtaatgaacaa

SEQ ID NO: 3128 - DNA, 1808 bp, Homo sapiens
cgcaggcgcacaggggacggttgctggcccaggtgagcgggcgcgctggtccaggtgagcgggcgcgtccccgcgacggcgctgcctgcccgaggcggttcacgtaaagacagcgagatcctgagggccagccgggaaggaggcgtggatatggagctggctgctgccaagtccggggcccgcgccgctgcctagcgcgtcctggggactctgtggggacgcgccccgcgccgcggctcggggacccgtagagcccggcgctgcgcgcatggccctgctctcgcgccccgcgctcaccctcctgctcctcctcatggccgctgttgtcaggtgccaggagcaggcccagaccaccgactggagagccaccctgaagaccatccggaacggcgttcataagatagacacgtacctgaacgccgccttggacctcctgggaggcgaggacggtctctgccagtataaatgcagtgacggatctaagcctttcccacgttatggttataaaccctccccaccgaatggatgtggctctccactgtttggtgttcatcttaacattggtatcccttccctgacaaagtgttgcaaccaacacgacaggtgctatgagacctgtggcaaaagcaagaatgactgtgatgaagaattccagtattgcctctccaagatctgccgagatgtacagaaaacactaggactaactcagcatgttcaggcatgtgaaacaacagtggagctcttgtttgacagtgttatacatttaggttgtaaaccatatctggacagccaacgagccgcatgcaggtgtcattatgaagaaaaaactgatctttaaaggagatgccgacagctagtgacagatgaagatggaagaacatacctttgacaaataactaatgtttttacaacataaaactgtcttatttttgtgaaaggattattttgagaccttaaaataatttatatcttgatgttaaaacctcaaagcaaaaaaagtgagggagatagtgaggggagggcacgcttgtcttctcaggtatcttccccagcattgctcccttacttagtatgccaaatgtcttgaccaatatcaaaaacaagtgcttgtttagcggagaattttgaaaagaggaatatataactcaattttcacaaccacatttaccaaaaaaagagatcaaatataaaattcatcataatgtctgttcaacattatcttatttggaaaatggggaaattatcacttacaagtatttgtttactatgaaattttaaatacacatttatgcctagaaggaacggactttttttttctattttaattacacataatatgtaattaaagtacaacataatatgttgtttctctgtagcccgttgagcatatgagtaagtcacatttctattaggactacttacaaggacaaggtttccatttttccagttgtaaaattggaaccatcagctgataacctcgtagggagcaaccccaggatagctaagtgttatgtaatatgcctagaaggtgatgtgaatgcgattcagaagcatagccactcccattttatgagctactcacatgacaaatgtcatcttttgctataacctttgccaagttagagaaaagatggatttaatgagataaatgaaaagatatttaacctaatatatcaaggcactatttgctgttatgctttgttatttatttcccagcacttgttccttattgtagattttttaaagactgtaaccttttactaactgtggtcttactaaaatttgtgcttgatactgcttttcaaaaa

SEQ ID NO: 3129 - DNA, 755 bp, Homo sapiens
tgagggccagccgggaaggaggcgtggatatggagctggctgctgccaagtccggggcccgcgccgctgcctagcgcgtcctggggactctgtggggacgcgccccgcgccgcggctcggggacccgtagagcccggcgctgcgcgcatggccctgctctcgcgccccgcgctcaccctcctgctcctcctcatggccgctgttgtcaggtgccaggagcaggcccagaccaccgactggagagccaccctgaagaccatccggaacggcgttcataagatagacacgtacctgaacgccgccttggacctcctgggaggcgaggacggtctctgccagtataaatgcagtgacgcttaacattggtatcccttccctgacaaagtgttgcaaccaacacgacaggtgctatgagacctgtggcaaaagcaagaatgactgtgatgaagaattccagtattgcctctccaagatctgccgagatgtacagaaaacactaggactaactcagcatgttcaggcatgtgaaacaacagtggagctcttgtttgacagtgttatacatttaggttgtaaaccatatctggacagccaacgagccgcatgcaggtgtcattatgaagaaaaaactgatctttaaaggagatgccgacagctagtgacagatgaagatggaagaacatacctttgacaaataactaatgtttttacaacataaaactgtcttatttttgtgaaaggattattttgagacc

SEQ ID NO: 3130 - DNA, 1128 bp, Homo sapiens
cctgcctgacatctgggtagggggtttgtccctggaattctgggacactggctggggtttgaggagagaagccagtacctacctggctgcaggatgaagctggccagtggcttcttggttttgtggctcagccttgggggtggcctggctcagagcgacacgagccctgacacggaggagtcctattcagactggggccttcggcacctccggggaagctttgaatccgtcaatagctacttcgattcttttctggagctgctgggagggaagaatggagtctgtcagtacaggtgccgatatggaaaggcaccaatgcccagacctggctacaagccccaagagcccaatggctgcggctcctatttcctgggtctcaaggtaccagaaagtatggacttgggcattccagcaatgacaaagtgctgcaaccagctggatgtctgttatgacacttgcggtgccaacaaatatcgctgtgatgcaaaattccgatggtgtctccactcgatctgctctgaccttaagcggagtctgggctttgtctccaaagtggaagcagcctgtgattccctggttgacactgtgttcaacaccgtgtggaccttgggctgccgcccctttatgaatagtcagcgggcagcttgcatctgtgcagaggaggagaaggaagagttatgaggaagaagtgattccttcctggttttgagtgacaccacagctgtcagccttcaagatgtcaagtcttcgagtcagcgtgactcattcattcttccaacagtttggacaccacaaagcaggagaaagggaacatttttctacagctggaaagtgagtcctatcctttgaggaaatttgaaaaaagacatggagtggtttgaaagctactcttcatttaagactgctctccccaaccaagacacatttgcctggaaattcagttcttagcttaaagactaaaatgcaagcaaaccctgcaattcctggacctgatagttatattcatgagtgaaattgtggggagtccagccatttgggaggcaatgactttctgctggcccatgtttcagttgccagtaagcttctcacatttaataaagtgtactttttagaacatttggaaagaga

SEQ ID NO: 3131 - DNA, 5285 bp, Homo sapiens
gagggcgcgcggaggacccgccgccgccggtgtgaggcggcccgtcctggctcccttgtccgggaagcccgcccaggagccgccgccgggtcccgctcgtctgccgcctcagcctcagccccaacctcagccgccgccgttgcgcttgctcccgggcggtcctggcctgtgccgccgccgcccccagcgtcggagccatggcgggcgccgcgtccccttgcgccaacggctgcgggcccggcgcgccctcggacgccgaggtgctgcacctctgccgcagcctcgaggtgggcaccgtcatgactttgttctactccaagaagtcgcagcgacccgagcggaagaccttccaggtcaagctggagacgcgccagatcacgtggagccggggcgccgacaagatcgagggggccattgacattcgtgaaattaaggagatccgcccagggaagacctcacgggactttgatcgctatcaagaggacccagctttccggccggaccagtcacattgctttgtcattctctatggaatggaatttcgcctgaaaacgctgagcctgcaagccacatctgaggatgaagtgaacatgtggatcaagggcttaacttggctgatggaggatacattgcaggcacccacacccctgcagattgagaggtggctccggaagcagttttactcagtggatcggaatcgtgaggatcgtatatcagccaaggacctgaagaacatgctgtcccaggtcaactaccgggtccccaacatgcgcttcctccgagagcggctgacggacctggagcagcgcagcggggacatcacctacgggcagtttgctcagctgtaccgcagcctcatgtacagcgcccagaagacgatggacctccccttcttggaagccagtactctgagggctggggagcggccggagctttgccgagtgtcccttcctgagttccagcagttccttcttgactaccagggggagctgtgggctgttgatcgcctccaggtgcaggagttcatgctcagcttcctccgagaccccttacgagagatcgaggagccatacttcttcctggatgagtttgtcaccttcctgttctccaaagagaacagtgtgtggaactcgcagctggatgcagtatgcccggacaccatgaacaaccctctttcccactactggatctcctcctcgcacaacacgtacctgaccggggaccagttctccagtgagtcctccttggaagcctatgctcgctgcctgcggatgggctgtcgctgcattgagttggactgctgggacggcccggatgggatgccagttatttaccatgggcacacccttaccaccaagatcaagttctcagatgtcctgcacaccatcaaggagcatgcctttgtggcctcagagtacccagtcatcctgtccattgaggaccactgcagcattgcccagcagagaaacatggcccaatacttcaagaaggtgctgggggacacactcctcaccaagcccgtggagatctctgccgacgggctcccctcacccaaccagcttaagaggaagatcctcatcaagcacaagaagctggctgagggcagtgcctacgaggaggtgcctacatccatgatgtactctgagaacgacatcagcaactctatcaagaatggcatcctctacctggaggaccctgtgaaccacgaatggtatccccactactttgttctgaccagcagcaagatctactactctgaggagaccagcagtgaccagggcaacgaggatgaggaggagcccaaggaggtcagcagcagcacagagctgcactccaatgagaagtggttccatgggaagctaggggcagggcgtgacgggcgtcacatcgctgagcgcctgcttactgagtactgcatcgagaccggagcccctgacggctccttcctcgtgcgagagagtgagaccttcgtgggcgactacacgctctctttctggcggaacgggaaagtccagcactgccgtatccactcccggcaagatgctgggacccccaagttcttcttgacagacaacctcgtctttgactccctctatgacctcatcacgcactaccagcaggtgcccctgcgctgtaatgagtttgagatgcgactttcagagcctgtcccacagaccaacgcccacgagagcaaagagtggtaccacgcgagcctgaccagagcacaggctgagcacatgctaatgcgcgtccctcgtgatggggccttcctggtgcggaagcggaatgaacccaactcatatgccatctctttccgggctgagggcaagatcaagcattgccgtgtccagcaagagggccagacagtgatgctagggaactcggagttcgacagccttgttgacctcatcagctactatgagaaacacccgctataccgcaagatgaagctgcgctatcccatcaacgaggaggcactggagaagattggcacagctgagcctgactacggggccctgtatgagggacgcaaccctggcttctatgtagaggcaaaccctatgccaactttcaagtgtgcagtcaaagccctctttgactacaaggcccagagggaggacgagctgaccttcatcaagagcgccatcatccagaatgtggagaagcaagagggaggctggtggcgaggggactacggagggaagaagcagctgtggttcccatcaaactacgtggaagagatggtcaaccccgtggccctggagccggagagggagcacttggacgagaacagccccctaggggacttgctgcggggggtcttggatgtgccggcttgtcagattgccatccgtcctgagggcaagaacaaccggctcttcgtcttctccatcagcatggcgtcggtggcccactggtccctggatgttgctgccgactcacaggaggagctgcaggactgggtgaaaaagatccgtgaagtggcccagacagcagacgccaggctcactgaagggaagataatggaacggaggaagaagattgccctggagctctctgaacttgtcgtctactgccggcctgttccctttgatgaagagaagattggcacagaacgtgcttgctaccgggacatgtcatccttcccggaaaccaaggctgagaaatacgtgaacaaggccaaaggcaagaagttccttcagtacaatcgactgcagctctcccgcatctaccccaagggccagcgactggattcctccaactacgatcctttgcccatgtggatctgtggcagtcagcttgtggccctcaacttccagacccctgacaagcctatgcagatgaaccaggccctcttcatgacgggcaggcactgtggctacgtgctgcagccaagcaccatgcgggatgaggccttcgacccctttgacaagagcagcctccgcgggctggagccatgtgccatctctattgaggtgctgggggcccgacatctgccaaagaatggccgaggcattgtgtgtccttttgtggagattgaggtggctggagctgagtatgacagcaccaagcagaagacagagtttgtggtggacaatggactcaaccctgtatggccagccaagcccttccacttccagatcagtaaccctgaatttgcctttctgcgcttcgtggtgtatgaggaagacatgtttagtgaccagaatttcctggctcaggctactttcccagtaaaaggcctgaagacaggatacagagcagtgcctttgaagaacaactacagtgaggacctggagttggcctccctgctgatcaagattgacattttccctgccaagcaggagaatggtgacctcagtcccttcagtggtacgtccctgcgggagcggggctcagatgcctcaggccagctgtttcatggccgagcccgggaaggctcctttgaatcccgctaccagcagccgtttgaggacttccgcatctcccaggagcatctcgcagaccattttgacagtcgagaacgaagggccccaagaaggactcgggtcaatggagacaaccgcctctagttgtaccccagcctcgttggagagcagcaggtgctgtgcgccttgtagaatgccgcgaactgggttctttggaagcagccccctgtggcggccttccgggtctcgcagcctgaagcctggattccagcagtgaatgctagacagaaaccaagccattaatgagatgttattactgttttgggcctccatgccccagctctggatgaaggcaaaaactgtactgtgtttcgcattaagcacacacatctggccctgacttctggagatggatccttccatcttgtggggccaggaccatggccgaagccccttggagagagaggctgcctcagccagtggcacaggagactccaaggagctactgacattcctaagagtggaggaggaggaggagccttgctgggccagggaaacaaagtttacattgtcctgtagctttaaaaccacagctgggcagggtgagaagctagatgcccctgcagtttggccctggagccagggcagaggaatgtagggcctgcatggagaagggttctgccctgcctgaggaggaggacacagcacaagggcacattgcccatggctgggaacatgacccagcctgaaagatacaggggatcatgttaaaaatagcagtattatttttcgtctcaatggtattgtaactaagttatttactcctcctgctcctcacccctgtagggaaaccttggagaggagagtggcaggtgggctgcctgctgtgttaagaggacttagtttgtgatgtaaggcactgtcaggaatggggggcgggccagggtgggaagagaagaaatagcagagcctattttggtgaggttttttgtttttaagtcaaagaagactcagtatgctttccctgaggaatgaaaaagggattgaggagttgcctgactcctgggtgggtggggtacaggcagttaggtgctgaatgaagctgccatccttgctgcagcttctaactggtaaaaagatccagggatggagatgggaaggttagaaaggcagccctcacctctgaggacagaggccggggtccaggcccgtgggcgcaaaggtgcctcatagcatagccagcattcagcacacacaaacctactgcccacatttgggctcagggttggccatttgctagttctgctgccctcttaagatctgactgccaaataaatcatcctcatgtcctttttc

SEQ ID NO: 3132 - DNA, 5490 bp, Homo sapiens
gccgctcgtggccgccgggctgtgtccggggccgcgtgagaaagctctgcgggactgagggctgggtgggtcgaccgggaacggcgcgcgctcccgccgccatcgcgcctccgtccccgcctgcggcctgtctgggggtcgcggggcgcaggcgcggcgggccgacgggcgggggtcctccccacgggtgcgcgggcgcctttgttcccggcgccgaagcggggtggggcctcagggcagccccgccccgccgcgctgaggccccgccccgtgtccgcctgcaggagccgccgccgggtcccgctcgtctgccgcctcagcctcagccccaacctcagccgccgccgttgcgcttgctcccgggcggtcctggcctgtgccgccgccgcccccagcgtcggagccatggcgggcgccgcgtccccttgcgccaacggctgcgggcccggcgcgccctcggacgccgaggtgctgcacctctgccgcagcctcgaggtgggcaccgtcatgactttgttctactccaagaagtcgcagcgacccgagcggaagaccttccaggtcaagctggagacgcgccagatcacgtggagccggggcgccgacaagatcgagggggccattgacattcgtgaaattaaggagatccgcccagggaagacctcacgggactttgatcgctatcaagaggacccagctttccggccggaccagtcacattgctttgtcattctctatggaatggaatttcgcctgaaaacgctgagcctgcaagccacatctgaggatgaagtgaacatgtggatcaagggcttaacttggctgatggaggatacattgcaggcacccacacccctgcagattgagaggtggctccggaagcagttttactcagtggatcggaatcgtgaggatcgtatatcagccaaggacctgaagaacatgctgtcccaggtcaactaccgggtccccaacatgcgcttcctccgagagcggctgacggacctggagcagcgcagcggggacatcacctacgggcagtttgctcagctgtaccgcagcctcatgtacagcgcccagaagacgatggacctccccttcttggaagccagtactctgagggctggggagcggccggagctttgccgagtgtcccttcctgagttccagcagttccttcttgactaccagggggagctgtgggctgttgatcgcctccaggtgcaggagttcatgctcagcttcctccgagaccccttacgagagatcgaggagccatacttcttcctggatgagtttgtcaccttcctgttctccaaagagaacagtgtgtggaactcgcagctggatgcagtatgcccggacaccatgaacaaccctctttcccactactggatctcctcctcgcacaacacgtacctgaccggggaccagttctccagtgagtcctccttggaagcctatgctcgctgcctgcggatgggctgtcgctgcattgagttggactgctgggacggcccggatgggatgccagttatttaccatgggcacacccttaccaccaagatcaagttctcagatgtcctgcacaccatcaaggagcatgcctttgtggcctcagagtacccagtcatcctgtccattgaggaccactgcagcattgcccagcagagaaacatggcccaatacttcaagaaggtgctgggggacacactcctcaccaagcccgtggagatctctgccgacgggctcccctcacccaaccagcttaagaggaagatcctcatcaagcacaagaagctggctgagggcagtgcctacgaggaggtgcctacatccatgatgtactctgagaacgacatcagcaactctatcaagaatggcatcctctacctggaggaccctgtgaaccacgaatggtatccccactactttgttctgaccagcagcaagatctactactctgaggagaccagcagtgaccagggcaacgaggatgaggaggagcccaaggaggtcagcagcagcacagagctgcactccaatgagaagtggttccatgggaagctaggggcagggcgtgacgggcgtcacatcgctgagcgcctgcttactgagtactgcatcgagaccggagcccctgacggctccttcctcgtgcgagagagtgagaccttcgtgggcgactacacgctctctttctggcggaacgggaaagtccagcactgccgtatccactcccggcaagatgctgggacccccaagttcttcttgacagacaacctcgtctttgactccctctatgacctcatcacgcactaccagcaggtgcccctgcgctgtaatgagtttgagatgcgactttcagagcctgtcccacagaccaacgcccacgagagcaaagagtggtaccacgcgagcctgaccagagcacaggctgagcacatgctaatgcgcgtccctcgtgatggggccttcctggtgcggaagcggaatgaacccaactcatatgccatctctttccgggctgagggcaagatcaagcattgccgtgtccagcaagagggccagacagtgatgctagggaactcggagttcgacagccttgttgacctcatcagctactatgagaaacacccgctataccgcaagatgaagctgcgctatcccatcaacgaggaggcactggagaagattggcacagctgagcctgactacggggccctgtatgagggacgcaaccctggcttctatgtagaggcaaaccctatgccaactttcaagtgtgcagtcaaagccctctttgactacaaggcccagagggaggacgagctgaccttcatcaagagcgccatcatccagaatgtggagaagcaagagggaggctggtggcgaggggactacggagggaagaagcagctgtggttcccatcaaactacgtggaagagatggtcaaccccgtggccctggagccggagagggagcacttggacgagaacagccccctaggggacttgctgcggggggtcttggatgtgccggcttgtcagattgccatccgtcctgagggcaagaacaaccggctcttcgtcttctccatcagcatggcgtcggtggcccactggtccctggatgttgctgccgactcacaggaggagctgcaggactgggtgaaaaagatccgtgaagtggcccagacagcagacgccaggctcactgaagggaagataatggaacggaggaagaagattgccctggagctctctgaacttgtcgtctactgccggcctgttccctttgatgaagagaagattggcacagaacgtgcttgctaccgggacatgtcatccttcccggaaaccaaggctgagaaatacgtgaacaaggccaaaggcaagaagttccttcagtacaatcgactgcagctctcccgcatctaccccaagggccagcgactggattcctccaactacgatcctttgcccatgtggatctgtggcagtcagcttgtggccctcaacttccagacccctgacaagcctatgcagatgaaccaggccctcttcatgacgggcaggcactgtggctacgtgctgcagccaagcaccatgcgggatgaggccttcgacccctttgacaagagcagcctccgcgggctggagccatgtgccatctctattgaggtgctgggggcccgacatctgccaaagaatggccgaggcattgtgtgtccttttgtggagattgaggtggctggagctgagtatgacagcaccaagcagaagacagagtttgtggtggacaatggactcaaccctgtatggccagccaagcccttccacttccagatcagtaaccctgaatttgcctttctgcgcttcgtggtgtatgaggaagacatgtttagtgaccagaatttcctggctcaggctactttcccagtaaaaggcctgaagacaggatacagagcagtgcctttgaagaacaactacagtgaggacctggagttggcctccctgctgatcaagattgacattttccctgccaaggagaatggtgacctcagtcccttcagtggtacgtccctgcgggagcggggctcagatgcctcaggccagctgtttcatggccgagcccgggaaggctcctttgaatcccgctaccagcagccgtttgaggacttccgcatctcccaggagcatctcgcagaccattttgacagtcgagaacgaagggccccaagaaggactcgggtcaatggagacaaccgcctctagttgtaccccagcctcgttggagagcagcaggtgctgtgcgccttgtagaatgccgcgaactgggttctttggaagcagccccctgtggcggccttccgggtctcgcagcctgaagcctggattccagcagtgaatgctagacagaaaccaagccattaatgagatgttattactgttttgggcctccatgccccagctctggatgaaggcaaaaactgtactgtgtttcgcattaagcacacacatctggccctgacttctggagatggatccttccatcttgtggggccaggaccatggccgaagccccttggagagagaggctgcctcagccagtggcacaggagactccaaggagctactgacattcctaagagtggaggaggaggaggagccttgctgggccagggaaacaaagtttacattgtcctgtagctttaaaaccacagctgggcagggtgagaagctagatgcccctgcagtttggccctggagccagggcagaggaatgtagggcctgcatggagaagggttctgccctgcctgaggaggaggacacagcacaagggcacattgcccatggctgggaacatgacccagcctgaaagatacaggggatcatgttaaaaatagcagtattatttttcgtctcaatggtattgtaactaagttatttactcctcctgctcctcacccctgtagggaaaccttggagaggagagtggcaggtgggctgcctgctgtgttaagaggacttagtttgtgatgtaaggcactgtcaggaatggggggcgggccagggtgggaagagaagaaatagcagagcctattttggtgaggttttttgtttttaagtcaaagaagactcagtatgctttccctgaggaatgaaaaagggattgaggagttgcctgactcctgggtgggtggggtacaggcagttaggtgctgaatgaagctgccatccttgctgcagcttctaactggtaaaaagatccagggatggagatgggaaggttagaaaggcagccctcacctctgaggacagaggccggggtccaggcccgtgggcgcaaaggtgcctcatagcatagccagcattcagcacacacaaacctactgcccacatttgggctcagggttggccatttgctagttctgctgccctcttaagatctgactgccaaataaatcatcctcatgtcctttttc

SEQ ID NO: 3133 - DNA, 5493 bp, Homo sapiens
gccgctcgtggccgccgggctgtgtccggggccgcgtgagaaagctctgcgggactgagggctgggtgggtcgaccgggaacggcgcgcgctcccgccgccatcgcgcctccgtccccgcctgcggcctgtctgggggtcgcggggcgcaggcgcggcgggccgacgggcgggggtcctccccacgggtgcgcgggcgcctttgttcccggcgccgaagcggggtggggcctcagggcagccccgccccgccgcgctgaggccccgccccgtgtccgcctgcaggagccgccgccgggtcccgctcgtctgccgcctcagcctcagccccaacctcagccgccgccgttgcgcttgctcccgggcggtcctggcctgtgccgccgccgcccccagcgtcggagccatggcgggcgccgcgtccccttgcgccaacggctgcgggcccggcgcgccctcggacgccgaggtgctgcacctctgccgcagcctcgaggtgggcaccgtcatgactttgttctactccaagaagtcgcagcgacccgagcggaagaccttccaggtcaagctggagacgcgccagatcacgtggagccggggcgccgacaagatcgagggggccattgacattcgtgaaattaaggagatccgcccagggaagacctcacgggactttgatcgctatcaagaggacccagctttccggccggaccagtcacattgctttgtcattctctatggaatggaatttcgcctgaaaacgctgagcctgcaagccacatctgaggatgaagtgaacatgtggatcaagggcttaacttggctgatggaggatacattgcaggcacccacacccctgcagattgagaggtggctccggaagcagttttactcagtggatcggaatcgtgaggatcgtatatcagccaaggacctgaagaacatgctgtcccaggtcaactaccgggtccccaacatgcgcttcctccgagagcggctgacggacctggagcagcgcagcggggacatcacctacgggcagtttgctcagctgtaccgcagcctcatgtacagcgcccagaagacgatggacctccccttcttggaagccagtactctgagggctggggagcggccggagctttgccgagtgtcccttcctgagttccagcagttccttcttgactaccagggggagctgtgggctgttgatcgcctccaggtgcaggagttcatgctcagcttcctccgagaccccttacgagagatcgaggagccatacttcttcctggatgagtttgtcaccttcctgttctccaaagagaacagtgtgtggaactcgcagctggatgcagtatgcccggacaccatgaacaaccctctttcccactactggatctcctcctcgcacaacacgtacctgaccggggaccagttctccagtgagtcctccttggaagcctatgctcgctgcctgcggatgggctgtcgctgcattgagttggactgctgggacggcccggatgggatgccagttatttaccatgggcacacccttaccaccaagatcaagttctcagatgtcctgcacaccatcaaggagcatgcctttgtggcctcagagtacccagtcatcctgtccattgaggaccactgcagcattgcccagcagagaaacatggcccaatacttcaagaaggtgctgggggacacactcctcaccaagcccgtggagatctctgccgacgggctcccctcacccaaccagcttaagaggaagatcctcatcaagcacaagaagctggctgagggcagtgcctacgaggaggtgcctacatccatgatgtactctgagaacgacatcagcaactctatcaagaatggcatcctctacctggaggaccctgtgaaccacgaatggtatccccactactttgttctgaccagcagcaagatctactactctgaggagaccagcagtgaccagggcaacgaggatgaggaggagcccaaggaggtcagcagcagcacagagctgcactccaatgagaagtggttccatgggaagctaggggcagggcgtgacgggcgtcacatcgctgagcgcctgcttactgagtactgcatcgagaccggagcccctgacggctccttcctcgtgcgagagagtgagaccttcgtgggcgactacacgctctctttctggcggaacgggaaagtccagcactgccgtatccactcccggcaagatgctgggacccccaagttcttcttgacagacaacctcgtctttgactccctctatgacctcatcacgcactaccagcaggtgcccctgcgctgtaatgagtttgagatgcgactttcagagcctgtcccacagaccaacgcccacgagagcaaagagtggtaccacgcgagcctgaccagagcacaggctgagcacatgctaatgcgcgtccctcgtgatggggccttcctggtgcggaagcggaatgaacccaactcatatgccatctctttccgggctgagggcaagatcaagcattgccgtgtccagcaagagggccagacagtgatgctagggaactcggagttcgacagccttgttgacctcatcagctactatgagaaacacccgctataccgcaagatgaagctgcgctatcccatcaacgaggaggcactggagaagattggcacagctgagcctgactacggggccctgtatgagggacgcaaccctggcttctatgtagaggcaaaccctatgccaactttcaagtgtgcagtcaaagccctctttgactacaaggcccagagggaggacgagctgaccttcatcaagagcgccatcatccagaatgtggagaagcaagagggaggctggtggcgaggggactacggagggaagaagcagctgtggttcccatcaaactacgtggaagagatggtcaaccccgtggccctggagccggagagggagcacttggacgagaacagccccctaggggacttgctgcggggggtcttggatgtgccggcttgtcagattgccatccgtcctgagggcaagaacaaccggctcttcgtcttctccatcagcatggcgtcggtggcccactggtccctggatgttgctgccgactcacaggaggagctgcaggactgggtgaaaaagatccgtgaagtggcccagacagcagacgccaggctcactgaagggaagataatggaacggaggaagaagattgccctggagctctctgaacttgtcgtctactgccggcctgttccctttgatgaagagaagattggcacagaacgtgcttgctaccgggacatgtcatccttcccggaaaccaaggctgagaaatacgtgaacaaggccaaaggcaagaagttccttcagtacaatcgactgcagctctcccgcatctaccccaagggccagcgactggattcctccaactacgatcctttgcccatgtggatctgtggcagtcagcttgtggccctcaacttccagacccctgacaagcctatgcagatgaaccaggccctcttcatgacgggcaggcactgtggctacgtgctgcagccaagcaccatgcgggatgaggccttcgacccctttgacaagagcagcctccgcgggctggagccatgtgccatctctattgaggtgctgggggcccgacatctgccaaagaatggccgaggcattgtgtgtccttttgtggagattgaggtggctggagctgagtatgacagcaccaagcagaagacagagtttgtggtggacaatggactcaaccctgtatggccagccaagcccttccacttccagatcagtaaccctgaatttgcctttctgcgcttcgtggtgtatgaggaagacatgtttagtgaccagaatttcctggctcaggctactttcccagtaaaaggcctgaagacaggatacagagcagtgcctttgaagaacaactacagtgaggacctggagttggcctccctgctgatcaagattgacattttccctgccaagcaggagaatggtgacctcagtcccttcagtggtacgtccctgcgggagcggggctcagatgcctcaggccagctgtttcatggccgagcccgggaaggctcctttgaatcccgctaccagcagccgtttgaggacttccgcatctcccaggagcatctcgcagaccattttgacagtcgagaacgaagggccccaagaaggactcgggtcaatggagacaaccgcctctagttgtaccccagcctcgttggagagcagcaggtgctgtgcgccttgtagaatgccgcgaactgggttctttggaagcagccccctgtggcggccttccgggtctcgcagcctgaagcctggattccagcagtgaatgctagacagaaaccaagccattaatgagatgttattactgttttgggcctccatgccccagctctggatgaaggcaaaaactgtactgtgtttcgcattaagcacacacatctggccctgacttctggagatggatccttccatcttgtggggccaggaccatggccgaagccccttggagagagaggctgcctcagccagtggcacaggagactccaaggagctactgacattcctaagagtggaggaggaggaggagccttgctgggccagggaaacaaagtttacattgtcctgtagctttaaaaccacagctgggcagggtgagaagctagatgcccctgcagtttggccctggagccagggcagaggaatgtagggcctgcatggagaagggttctgccctgcctgaggaggaggacacagcacaagggcacattgcccatggctgggaacatgacccagcctgaaagatacaggggatcatgttaaaaatagcagtattatttttcgtctcaatggtattgtaactaagttatttactcctcctgctcctcacccctgtagggaaaccttggagaggagagtggcaggtgggctgcctgctgtgttaagaggacttagtttgtgatgtaaggcactgtcaggaatggggggcgggccagggtgggaagagaagaaatagcagagcctattttggtgaggttttttgtttttaagtcaaagaagactcagtatgctttccctgaggaatgaaaaagggattgaggagttgcctgactcctgggtgggtggggtacaggcagttaggtgctgaatgaagctgccatccttgctgcagcttctaactggtaaaaagatccagggatggagatgggaaggttagaaaggcagccctcacctctgaggacagaggccggggtccaggcccgtgggcgcaaaggtgcctcatagcatagccagcattcagcacacacaaacctactgcccacatttgggctcagggttggccatttgctagttctgctgccctcttaagatctgactgccaaataaatcatcctcatgtcctttttc

SEQ ID NO: 3134 - DNA, 4263 bp, Homo sapiens
gcgccggcggcggagggcgtgagcggcgctgagtgacccgagtcgggacgcgggctgcgcgcgcgggaccccggagcccaaacccggggcaggcgggcagctgtgcccgggcggcacggccagcttcctgatttctcccgattccttccttctccctggagcggccgacaatgtccaccacggtcaatgtagattcccttgcggaatatgagaagagccagatcaagagagccctggagctggggacggtgatgactgtgttcagcttccgcaagtccacccccgagcggagaaccgtccaggtgatcatggagacgcggcaggtggcctggagcaagaccgctgacaagatcgagggcttcttggatatcatggaaataaaagaaatccgcccagggaagaactccaaagatttcgagcgagcaaaagcagttcgccagaaagaagactgctgcttcaccatcctatatggcactcagttcgtcctcagcacgctcagcttggcagctgactctaaagaggatgcagttaactggctctctggcttgaaaatcttacaccaggaagcgatgaatgcgtccacgcccaccattatcgagagttggctgagaaagcagatatattctgtggatcaaaccagaagaaacagcatcagtctccgagagttgaagaccatcttgcccctgatcaactttaaagtgagcagtgccaagttccttaaagataagtttgtggaaataggagcacacaaagatgagctcagctttgaacagttccatctcttctataaaaaacttatgtttgaacagcaaaaatcgattctcgatgaattcaaaaaggattcgtccgtgttcatcctggggaacactgacaggccggatgcctctgctgtttacctgcatgacttccagaggtttctcatacatgaacagcaggagcattgggctcaggatctgaacaaagtccgtgagcggatgacaaagttcattgatgacaccatgcgtgaaactgctgagcctttcttgtttgtggatgagttcctcacgtacctgttttcacgagaaaacagcatctgggatgagaagtatgacgcggtggacatgcaggacatgaacaaccccctgtctcattactggatctcctcgtcacataacacgtaccttacaggtgaccagctgcggagcgagtcgtccccagaagcttacatccgctgcctgcgcatgggctgtcgctgcattgaactggactgctgggacgggcccgatgggaagccggtcatctaccatggctggacgcggactaccaagatcaagtttgacgacgtcgtgcaggccatcaaagaccacgcctttgttacctcgagcttcccagtgatcctgtccatcgaggagcactgcagcgtggagcaacagcgtcacatggccaaggccttcaaggaagtatttggcgacctgctgttgacgaagcccacggaggccagtgctgaccagctgccctcgcccagccagctgcgggagaagatcatcatcaagcataagaagctgggcccccgaggcgatgtggatgtcaacatggaggacaagaaggacgaacacaagcaacagggggagctgtacatgtgggattccattgaccagaaatggactcggcactactgcgccattgccgatgccaagctgtccttcagtgatgacattgaacagactatggaggaggaagtgccccaggatataccccctacagaactacattttggggagaaatggttccacaagaaggtggagaagaggacgagtgccgagaagttgctgcaggaatactgcatggagacggggggcaaggatggcaccttcctggttcgggagagcgagaccttccccaatgactacaccctgtccttctggcggtcaggccgggtccagcactgccggatccgctccaccatggagggcgggaccctgaaatactacttgactgacaacctcaccttcagcagcatctatgccctcatccagcactaccgcgagacgcacctgcgctgcgccgagttcgagctgcggctcacggaccctgtgcccaaccccaacccccacgagtccaagccgtggtactatgacagcctgagccgcggagaggcagaggacatgctgatgaggattccccgggacggggccttcctgatccggaagcgagaggggagcgactcctatgccatcaccttcagggctaggggcaaggtaaagcattgtcgcatcaaccgggacggccggcactttgtgctggggacctccgcctattttgagagtctggtggagctcgtcagttactacgagaagcattcactctaccgaaagatgagactgcgctaccccgtgacccccgagctcctggagcgctacaatatggaaagagatataaactccctctacgacgtcagcagaatgtatgtggatcccagtgaaatcaatccgtccatgcctcagagaaccgtgaaagctctgtatgactacaaagccaagcgaagcgatgagctgagcttctgccgtggtgccctcatccacaatgtctccaaggagcccgggggctggtggaaaggagactatggaaccaggatccagcagtacttcccatccaactacgtcgaggacatctcaactgcagacttcgaggagctagaaaagcagattattgaagacaatcccttagggtctctttgcagaggaatattggacctcaatacctataacgtcgtgaaagcccctcagggaaaaaaccagaagtcctttgtcttcatcctggagcccaagcagcagggcgatcctccggtggagtttgccacagacagggtggaggagctctttgagtggtttcagagcatccgagagatcacctggaagattgacaccaaggagaacaacatgaagtactgggagaagaaccagtccatcgccatcgagctctctgacctggttgtctactgcaaaccaaccagcaaaaccaaggacaacttagaaaatcctgacttccgagaaatccgctcctttgtggagacgaaggctgacagcatcatcagacagaagcccgtcgacctcctgaagtacaatcaaaagggcctgacccgcgtctacccaaagggacaaagagttgactcttcaaactacgaccccttccgcctctggctgtgcggttctcagatggtggcactcaatttccagacggcagataagtacatgcagatgaatcacgcattgttttctctcaatgggcgcacgggctacgttctgcagcctgagagcatgaggacagagaaatatgacccgatgccacccgagtcccagaggaagatcctgatgacgctgacagtcaaggttctcggtgctcgccatctccccaaacttggacgaagtattgcctgtccctttgtagaagtggagatctgtggagccgagtatgacaacaacaagttcaagacgacggttgtgaatgataatggcctcagccctatctgggctccaacacaggagaaggtgacatttgaaatttatgacccaaacctggcatttctgcgctttgtggtttatgaagaagatatgttcagcgatcccaactttcttgctcatgccacttaccccattaaagcagtcaaatcaggattcaggtccgttcctctgaagaatgggtacagcgaggacatagagctggcttccctcctggttttctgtgagatgcggccagtcctggagagcgaagaggaactttactcctcctgtcgccagctgaggaggcggcaagaagaactgaacaaccagctctttctgtatgacacacaccagaacttgcgcaatgccaaccgggatgccctggttaaagagttcagtgttaatgagaaccagctccagctgtaccaggagaaatgcaacaagaggttaagagagaagagagtcagcaacagcaagttttactcatagaagctggggtatgtgtgtaagggtattgtgtgtgtgcgcatgtgtgtttgcatgtaggagaacgtgccctattcacactctgggaagacgctaatctgtgacatcttttcttcaagcctgccatcaaggacatttcttaagacccaactggcatgagttggggtaatttcctattattttcatcttggacaactttcttaacttatattctttatagaggattccccaaaatgtgctcctcatttttggcctctcatgttccaaacctcattgaataaaagcaatgaaaaccttg

SEQ ID NO: 3135 - DNA, 3032 bp, Homo sapiens
gctgagctccagctgtgccagaggcacccgagccctgagagtccgccgccaacgcgcaggtgctagcggccccttcgccctgcagcccctttgcttttactctgtccaaagttaacatgtcactgaaaaacgagccacgggtaaatacctctgcactgcagaaaattgctgctgacatgagtaatatcatagaaaatctggacacgcgggaactccactttgagggagaggaggtagactacgacgtgtctcccagcgatcccaagatacaagaagtgtatatccctttctctgctatttataacactcaaggatttaaggagcctaatatacagacgtatctctccggctgtccaataaaagcacaagttctggaagtggaacgcttcacatctacaacaagggtaccaagtattaatctttacactattgaattaacacatggggaatttaaatggcaagttaagaggaaattcaagcattttcaagaatttcacagagagctgctcaagtacaaagcctttatccgcatccccattcccactagaagacacacgtttaggaggcaaaacgtcagagaggagcctcgagagatgcccagtttgccccgttcatctgaaaacatgataagagaagaacaattccttggtagaagaaaacaactggaagattacttgacaaagatactaaaaatgcccatgtatagaaactatcatgccacaacagagtttcttgatataagccagctgtctttcatccatgatttgggaccaaagggcatagaaggtatgataatgaaaagatctggaggacacagaataccaggcttgaattgctgtggtcagggaagagcctgctacagatggtcaaaaagatggttaatagtgaaagattcctttttattgtatatgaaaccagacagcggtgccattgccttcgtcctgctggtagacaaagaattcaaaattaaggtggggaagaaggagacagaaacgaaatatggaatccgaattgataatctttcaaggacacttattttaaaatgcaacagctatagacatgctcggtggtggggaggggctatagaagaattcatccagaaacatggcaccaactttctcaaagatcatcgatttgggtcatatgctgctatccaagagaatgctttagctaaatggtatgttaatgccaaaggatattttgaagatgtggcaaatgcaatggaagaggcaaatgaagagatttttatcacagactggtggctgagtccagaaatcttcctgaaacgcccagtggttgagggaaatcgttggaggttggactgcattcttaaacgaaaagcacaacaaggagtgaggatcttcataatgctctacaaagaggtggaactcgctcttggcatcaatagtgaatacaccaagaggactttgatgcgtctacatcccaacataaaggtgatgagacacccggatcatgtgtcatccaccgtctatttgtgggctcaccatgagaagcttgtcatcattgaccaatcggtggcctttgtgggagggattgacctggcctatggaaggtgggacgacaatgagcacagactcacagacgtgggcagtgtgaagcgggtcacttcaggaccgtctctgggttccctcccacctgccgcaatggagtctatggaatccttaagactcaaagataaaaatgagcctgttcaaaacctacccatccagaagagtattgatgatgtggattcaaaactgaaaggaataggaaagccaagaaagttctccaaatttagtctctacaagcagctccacaggcaccacctgcacgacgcagatagcatcagcagcattgacagcacctccagttattttaatcactatagaagtcatcacaatttaatccatggtttaaaaccccacttcaaactctttcacccgtccagtgagtctgagcaaggactcactagacctcatgctgataccgggtccatccgtagtttacagacaggtgtgggagagctgcatggggaaaccagattctggcatggaaaggactactgcaatttcgtcttcaaagactgggttcaacttgataaaccttttgctgatttcattgacaggtactccacgccccggatgccctggcatgacattgcctctgcagtccacgggaaggcggctcgtgatgtggcacgtcacttcatccagcgctggaacttcacaaaaattatgaaatcaaaatatcggtccctttcttatccttttctgcttccaaagtctcaaacaacagcccatgagttgagatatcaagtgcctgggtctgtccatgctaacgtacagttgctccgctctgctgctgattggtctgctggtataaagtaccatgaagagtccatccacgccgcttacgtccatgtgatagagaacagcaggcactatatctatatcgaaaaccagtttttcataagctgtgctgatgacaaagttgtgttcaacaagataggcgatgccattgcccagaggatcctgaaagctcacagggaaaaccagaaataccgggtatatgtcgtgataccacttctgccagggttcgaaggagacatttcaaccggcggaggaaatgctctacaggcaatcatgcacttcaactacagaaccatgtgcagaggagaaaattccatccttggacagttaaaagcagagcttggtaatcagtggataaattacatatcattctgtggtcttagaacacatgcagagctcgaaggaaacctagtaactgagcttatctatgtccacagcaagttgttaattgctgatgataacactgttattattggctctgccaacataaatgaccgcagcatgctgggaaagcgtgacagtgaaatggctgtcattgtgcaagatacagagactgttccttcagtaatggatggaaaagagtaccaagctggccggtttgcccgaggacttcggctacagtgctttaggtctaaaatgactccaggtgtcgaagatccctga

SEQ ID NO: 3136 - DNA, 5261 bp, Homo sapiens
gctgagctccagctgtgccagaggcacccgagccctgagagtccgccgccaacgcgcaggtgctagcggccccttcgccctgcagcccctttgcttttactctgtccaaagttaacatgtcactgaaaaacgagccacgggtaaatacctctgcactgcagaaaattgctgctgacatgagtaatatcatagaaaatctggacacgcgggaactccactttgagggagaggaggtagactacgacgtgtctcccagcgatcccaagatacaagaagtgtatatccctttctctgctatttataacactcaaggatttaaggagcctaatatacagacgtatctctccggctgtccaataaaagcacaagttctggaagtggaacgcttcacatctacaacaagggtaccaagtattaatctttacactattgaattaacacatggggaatttaaatggcaagttaagaggaaattcaagcattttcaagaatttcacagagagctgctcaagtacaaagcctttatccgcatccccattcccactagaagacacacgtttaggaggcaaaacgtcagagaggagcctcgagagatgcccagtttgccccgttcatctgaaaacatgataagagaagaacaattccttggtagaagaaaacaactggaagattacttgacaaagatactaaaaatgcccatgtatagaaactatcatgccacaacagagtttcttgatataagccagctgtctttcatccatgatttgggaccaaagggcatagaaggtatgataatgaaaagatctggaggacacagaataccaggcttgaattgctgtggtcagggaagagcctgctacagatggtcaaaaagatggttaatagtgaaagattcctttttattgtatatgaaaccagacagcggtgccattgccttcgtcctgctggtagacaaagaattcaaaattaaggtggggaagaaggagacagaaacgaaatatggaatccgaattgataatctttcaaggacacttattttaaaatgcaacagctatagacatgctcggtggtggggaggggctatagaagaattcatccagaaacatggcaccaactttctcaaagatcatcgatttgggtcatatgctgctatccaagagaatgctttagctaaatggtatgttaatgccaaaggatattttgaagatgtggcaaatgcaatggaagaggcaaatgaagagatttttatcacagactggtggctgagtccagaaatcttcctgaaacgcccagtggttgagggaaatcgttggaggttggactgcattcttaaacgaaaagcacaacaaggagtgaggatcttcataatgctctacaaagaggtggaactcgctcttggcatcaatagtgaatacaccaagaggactttgatgcgtctacatcccaacataaaggtgatgagacacccggatcatgtgtcatccaccgtctatttgtgggctcaccatgagaagcttgtcatcattgaccaatcggtggcctttgtgggagggattgacctggcctatggaaggtgggacgacaatgagcacagactcacagacgtgggcagtgtgaagcgggtcacttcaggaccgtctctgggttccctcccaataccgggtccatccgtagtttacagacaggtgtgggagagctgcatggggaaaccagattctggcatggaaaggactactgcaatttcgtcttcaaagactgggttcaacttgataaaccttttgctgatttcattgacaggtactccacgccccggatgccctggcatgacattgcctctgcagtccacgggaaggcggctcgtgatgtggcacgtcacttcatccagcgctggaacttcacaaaaattatgaaatcaaaatatcggtccctttcttatccttttctgcttccaaagtctcaaacaacagcccatgagttgagatatcaagtgcctgggtctgtccatgctaacgtacagttgctccgctctgctgctgattggtctgctggtataaagtaccatgaagagtccatccacgccgcttacgtccatgtgatagagaacagcaggcactatatctatatcgaaaaccagtttttcataagctgtgctgatgacaaagttgtgttcaacaagataggcgatgccattgcccagaggatcctgaaagctcacagggaaaaccagaaataccgggtatatgtcgtgataccacttctgccagggttcgaaggagacatttcaaccggcggaggaaatgctctacaggcaatcatgcacttcaactacagaaccatgtgcagaggagaaaattccatccttggacagttaaaagcagagcttggtaatcagtggataaattacatatcattctgtggtcttagaacacatgcagagctcgaaggaaacctagtaactgagcttatctatgtccacagcaagttgttaattgctgatgataacactgttattattggctctgccaacataaatgaccgcagcatgctgggaaagcgtgacagtgaaatggctgtcattgtgcaagatacagagactgttccttcagtaatggatggaaaagagtaccaagctggccggtttgcccgaggacttcggctacagtgctttagggttgtccttggctatcttgatgacccaagtgaggacattcaggatccagtgagtgacaaattcttcaaggaggtgtgggtttcaacagcagctcgaaatgctacaatttatgacaaggttttccggtgccttcccaatgatgaagtacacaatttaattcagctgagagactttataaacaagcccgtattagctaaggaagatcccattcgagctgaggaggaactgaagaagatccgtggatttttggtgcaattccccttttatttcttgtctgaagaaagcctactgccttctgttgggaccaaagaggccatagtgcccatggaggtttggacttaagagatattcattggcagctcaaagacttccaccctggagaccacactgcacacagtgacttcctggggatgtcatagccaaagccaggcctgacgcattctcgtatccaacccaaggaccttttggaatgactggggagggctgcagtcacattgatgtaaggactgtaaacatcagcaagactttataattccttctgcctaacttgtaaaaagggggctgcattcttgttggtagcatgtactctgttgagtaaaacacatattcaaattccgtataccaaaatccatttcctttgtaacaagaatttaccagtaactgtgatctaggttgccaaaagttgtctgaatctccttattcttctctgatcttcatttatgcagccaatgtctagctggacctgccctcatcttgcagttcatacaggcactgtttgagagattgtttattattagatgttgtaatgctgcttcaagattcttcatggttacatgggatgcccctgctcatctggtcctgaagtagtaacattcacccaaatgaggatatagtcattattccttttcagtcactgtacgaacacggcagactttagcctacacagtagactgtgttaggcacttctggtaacattgacactgtatcttgacaccactaagcaacaggaaggaataaattccaatattgagacagagatttatttcattttgctcccaaaggcactgacaacatgagtccttgtgattaggcccacctgatcaaatgtaaaaacatgcatgggatatttgattacgtaacaaccagctaaaactgagagcacacagccttcggaaacccccaaggtgtcgaggaggatcagatccagataagagaagatgattccttctagtcctgtaaaatttcctgtcatccttagctgctgggttgattgaaatttgatctctacatttcaaaatcaaactagtgaatacagtttgtctttcaagagaatcagaggcatcgtaactcctaccaagttagtaagtatgagtctaaccttgtttgacattcaggtcttctgctacattatcttctttgagaaaaattaattgattataaaatatgtgctacttcacttacattattaaatatgtattaacgcctctcaccagggcttccagtgaagttacaatgccctagtctgtgaattagtctggaaacgtgtttttccttttcggatgttagagtaccctttgataaactaaattttactaagctgaacaactctgacagtctaaagagctaatgtgggttaccaaaaggcctgtacctgtaaaacaaaatgcaggtgtaatgattatacatgtctatggattacctggacatactctcatttgggttgttcttcaaagaagcaagcagccgatccctgttttcataaagctaatacttcagttggaaaaattaaacaggagcacaaagtcagggataggggttagcagaagagagaaatagtgtcacatcaagggcaggatctcatagctagggaacatttcacaaataaggtgagattttgtaaccaataataaaaatgaatgtttttataagtaaataacttatttttcatatggctaaagatggtaaaatgacttcattctatagccattgtaaataagaatttgctattgatgaaagaagttcagattggcatttgaagtattgagtgtatgggatctctaaggatttcttagattttatatttaaatattttttaaaccttagaggagtcaacaaactggctcttgattttcagcaccctactctcatgaaaaaagcctgaaaggaccctttcccttataagtaatttaatccaatttctccccattttatagatgaggaaactgaggctcagatcagatgagaactcacttaaatccactcaatgtgtagatggtagagctgggactagcaacattgctgcagcccattgttggcctctctcttcactttatcattgcccaagaatgaggatatgcagtaaacagaattcaggcaagatacctctaagctgttttgaaccctctgatattttgtatttatgtgtttgtctgtctccccctactagaatgtaagctccatggggcagggacttcactgtattttgttcatagtgtatccccagagcctggaccagtgcttggcacataggagatggcaataaatgcttgtagaattaataaacaaggtgaaggagagagctaatgaaatg

SEQ ID NO: 3137 - DNA, 5604 bp, Homo sapiens
ccctccctcccgctgagctccagctgtgccagaggcacccgagccctgagagtccgccgccaacgcgcaggtgctagcggccccttcgccctgcagcccctttgcttttactctgtccaaagttaacatgtcactgaaaaacgagccacgggtaaatacctctgcactgcagaaaattgctgctgacatgagtaatatcatagaaaatctggacacgcgggaactccactttgagggagaggaggtagactacgacgtgtctcccagcgatcccaagatacaagaagtgtatatccctttctctgctatttataacactcaaggatttaaggagcctaatatacagacgtatctctccggctgtccaataaaagcacaagttctggaagtggaacgcttcacatctacaacaagggtaccaagtattaatctttacactattgaattaacacatggggaatttaaatggcaagttaagaggaaattcaagcattttcaagaatttcacagagagctgctcaagtacaaagcctttatccgcatccccattcccactagaagacacacgtttaggaggcaaaacgtcagagaggagcctcgagagatgcccagtttgccccgttcatctgaaaacatgataagagaagaacaattccttggtagaagaaaacaactggaagattacttgacaaagatactaaaaatgcccatgtatagaaactatcatgccacaacagagtttcttgatataagccagctgtctttcatccatgatttgggaccaaagggcatagaaggtatgataatgaaaagatctggaggacacagaataccaggcttgaattgctgtggtcagggaagagcctgctacagatggtcaaaaagatggttaatagtgaaagattcctttttattgtatatgaaaccagacagcggtgccattgccttcgtcctgctggtagacaaagaattcaaaattaaggtggggaagaaggagacagaaacgaaatatggaatccgaattgataatctttcaaggacacttattttaaaatgcaacagctatagacatgctcggtggtggggaggggctatagaagaattcatccagaaacatggcaccaactttctcaaagatcatcgatttgggtcatatgctgctatccaagagaatgctttagctaaatggtatgttaatgccaaaggatattttgaagatgtggcaaatgcaatggaagaggcaaatgaagagatttttatcacagactggtggctgagtccagaaatcttcctgaaacgcccagtggttgagggaaatcgttggaggttggactgcattcttaaacgaaaagcacaacaaggagtgaggatcttcataatgctctacaaagaggtggaactcgctcttggcatcaatagtgaatacaccaagaggactttgatgcgtctacatcccaacataaaggtgatgagacacccggatcatgtgtcatccaccgtctatttgtgggctcaccatgagaagcttgtcatcattgaccaatcggtggcctttgtgggagggattgacctggcctatggaaggtgggacgacaatgagcacagactcacagacgtgggcagtgtgaagcgggtcacttcaggaccgtctctgggttccctcccacctgccgcaatggagtctatggaatccttaagactcaaagataaaaatgagcctgttcaaaacctacccatccagaagagtattgatgatgtggattcaaaactgaaaggaataggaaagccaagaaagttctccaaatttagtctctacaagcagctccacaggcaccacctgcacgacgcagatagcatcagcagcattgacagcacctccagttattttaatcactatagaagtcatcacaatttaatccatggtttaaaaccccacttcaaactctttcacccgtccagtgagtctgagcaaggactcactagacctcatgctgataccgggtccatccgtagtttacagacaggtgtgggagagctgcatggggaaaccagattctggcatggaaaggactactgcaatttcgtcttcaaagactgggttcaacttgataaaccttttgctgatttcattgacaggtactccacgccccggatgccctggcatgacattgcctctgcagtccacgggaaggcggctcgtgatgtggcacgtcacttcatccagcgctggaacttcacaaaaattatgaaatcaaaatatcggtccctttcttatccttttctgcttccaaagtctcaaacaacagcccatgagttgagatatcaagtgcctgggtctgtccatgctaacgtacagttgctccgctctgctgctgattggtctgctggtataaagtaccatgaagagtccatccacgccgcttacgtccatgtgatagagaacagcaggcactatatctatatcgaaaaccagtttttcataagctgtgctgatgacaaagttgtgttcaacaagataggcgatgccattgcccagaggatcctgaaagctcacagggaaaaccagaaataccgggtatatgtcgtgataccacttctgccagggttcgaaggagacatttcaaccggcggaggaaatgctctacaggcaatcatgcacttcaactacagaaccatgtgcagaggagaaaattccatccttggacagttaaaagcagagcttggtaatcagtggataaattacatatcattctgtggtcttagaacacatgcagagctcgaaggaaacctagtaactgagcttatctatgtccacagcaagttgttaattgctgatgataacactgttattattggctctgccaacataaatgaccgcagcatgctgggaaagcgtgacagtgaaatggctgtcattgtgcaagatacagagactgttccttcagtaatggatggaaaagagtaccaagctggccggtttgcccgaggacttcggctacagtgctttagggttgtccttggctatcttgatgacccaagtgaggacattcaggatccagtgagtgacaaattcttcaaggaggtgtgggtttcaacagcagctcgaaatgctacaatttatgacaaggttttccggtgccttcccaatgatgaagtacacaatttaattcagctgagagactttataaacaagcccgtattagctaaggaagatcccattcgagctgaggaggaactgaagaagatccgtggatttttggtgcaattccccttttatttcttgtctgaagaaagcctactgccttctgttgggaccaaagaggccatagtgcccatggaggtttggacttaagagatattcattggcagctcaaagacttccaccctggagaccacactgcacacagtgacttcctggggatgtcatagccaaagccaggcctgacgcattctcgtatccaacccaaggaccttttggaatgactggggagggctgcagtcacattgatgtaaggactgtaaacatcagcaagactttataattccttctgcctaacttgtaaaaagggggctgcattcttgttggtagcatgtactctgttgagtaaaacacatattcaaattccgtataccaaaatccatttcctttgtaacaagaatttaccagtaactgtgatctaggttgccaaaagttgtctgaatctccttattcttctctgatcttcatttatgcagccaatgtctagctggacctgccctcatcttgcagttcatacaggcactgtttgagagattgtttattattagatgttgtaatgctgcttcaagattcttcatggttacatgggatgcccctgctcatctggtcctgaagtagtaacattcacccaaatgaggatatagtcattattccttttcagtcactgtacgaacacggcagactttagcctacacagtagactgtgttaggcacttctggtaacattgacactgtatcttgacaccactaagcaacaggaaggaataaattccaatattgagacagagatttatttcattttgctcccaaaggcactgacaacatgagtccttgtgattaggcccacctgatcaaatgtaaaaacatgcatgggatatttgattacgtaacaaccagctaaaactgagagcacacagccttcggaaacccccaaggtgtcgaggaggatcagatccagataagagaagatgattccttctagtcctgtaaaatttcctgtcatccttagctgctgggttgattgaaatttgatctctacatttcaaaatcaaactagtgaatacagtttgtctttcaagagaatcagaggcatcgtaactcctaccaagttagtaagtatgagtctaaccttgtttgacattcaggtcttctgctacattatcttctttgagaaaaattaattgattataaaatatgtgctacttcacttacattattaaatatgtattaacgcctctcaccagggcttccagtgaagttacaatgccctagtctgtgaattagtctggaaacgtgtttttccttttcggatgttagagtaccctttgataaactaaattttactaagctgaacaactctgacagtctaaagagctaatgtgggttaccaaaaggcctgtacctgtaaaacaaaatgcaggtgtaatgattatacatgtctatggattacctggacatactctcatttgggttgttcttcaaagaagcaagcagccgatccctgttttcataaagctaatacttcagttggaaaaattaaacaggagcacaaagtcagggataggggttagcagaagagagaaatagtgtcacatcaagggcaggatctcatagctagggaacatttcacaaataaggtgagattttgtaaccaataataaaaatgaatgtttttataagtaaataacttatttttcatatggctaaagatggtaaaatgacttcattctatagccattgtaaataagaatttgctattgatgaaagaagttcagattggcatttgaagtattgagtgtatgggatctctaaggatttcttagattttatatttaaatattttttaaaccttagaggagtcaacaaactggctcttgattttcagcaccctactctcatgaaaaaagcctgaaaggaccctttcccttataagtaatttaatccaatttctccccattttatagatgaggaaactgaggctcagatcagatgagaactcacttaaatccactcaatgtgtagatggtagagctgggactagcaacattgctgcagcccattgttggcctctctcttcactttatcattgcccaagaatgaggatatgcagtaaacagaattcaggcaagatacctctaagctgttttgaaccctctgatattttgtatttatgtgtttgtctgtctccccctactagaatgtaagctccatggggcagggacttcactgtattttgttcatagtgtatccccagagcctggaccagtgcttggcacataggagatggcaataaatgcttgtagaattaataaacaaggtgaaggagagagctaatgaaatgaaaa

SEQ ID NO: 3138 - DNA, 5855 bp, Homo sapiens
ccgccaacgcgcaggtgctagcggccccttcgccctgcagcccctttgcttttactctgtccaaagttaacatgtcactgaaaaacgagccacgggtaaatacctctgcactgcagaaaattgctgctgacatgagtaatatcatagaaaatctggacacgcgggaactccactttgagggagaggaggtagactacgacgtgtctcccagcgatcccaagatacaagaagtgtatatccctttctctgctatttataacactcaaggatttaaggagcctaatatacagacgtatctctccggctgtccaataaaagcacaagttctggaagtggaacgcttcacatctacaacaagggtaccaagtattaatctttacactattgaattaacacatggggaatttaaatggcaagttaagaggaaattcaagcattttcaagaatttcacagagagctgctcaagtacaaagcctttatccgcatccccattcccactagaagacacacgtttaggaggcaaaacgtcagagaggagcctcgagagatgcccagtttgccccgttcatctgaaaacatgataagagaagaacaattccttggtagaagaaaacaactggaagattacttgacaaagatactaaaaatgcccatgtatagaaactatcatgccacaacagagtttcttgatataagccagctgtctttcatccatgatttgggaccaaagggcatagaaggtatgataatgaaaagatctggaggacacagaataccaggcttgaattgctgtggtcagggaagagcctgctacagatggtcaaaaagatggttaatagtgaaagattcctttttattgtatatgaaaccagacagcggtgccattgccttcgtcctgctggtagacaaagaattcaaaattaaggtggggaagaaggagacagaaacgaaatatggaatccgaattgataatctttcaaggacacttattttaaaatgcaacagctatagacatgctcggtggtggggaggggctatagaagaattcatccagaaacatggcaccaactttctcaaagatcatcgatttgggtcatatgctgctatccaagagaatgctttagctaaatggtatgttaatgccaaaggatattttgaagatgtggcaaatgcaatggaagaggcaaatgaagagatttttatcacagactggtggctgagtccagaaatcttcctgaaacgcccagtggttgagggaaatcgttggaggttggactgcattcttaaacgaaaagcacaacaaggagtgaggatcttcataatgctctacaaagaggtggaactcgctcttggcatcaatagtgaatacaccaagaggactttgatgcgtctacatcccaacataaaggtgatgagacacccggatcatgtgtcatccaccgtctatttgtgggctcaccatgagaagcttgtcatcattgaccaatcggtggcctttgtgggagggattgacctggcctatggaaggtgggacgacaatgagcacagactcacagacgtgggcagtgtgaagcgggtcacttcaggaccgtctctgggttccctcccacctgccgcaatggagtctatggaatccttaagactcaaagataaaaatgagcctgttcaaaacctacccatccagaagagtattgatgatgtggattcaaaactgaaaggaataggaaagccaagaaagttctccaaatttagtctctacaagcagctccacaggcaccacctgcacgacgcagatagcatcagcagcattgacagcacctccaataccgggtccatccgtagtttacagacaggtgtgggagagctgcatggggaaaccagattctggcatggaaaggactactgcaatttcgtcttcaaagactgggttcaacttgataaaccttttgctgatttcattgacaggtactccacgccccggatgccctggcatgacattgcctctgcagtccacgggaaggcggctcgtgatgtggcacgtcacttcatccagcgctggaacttcacaaaaattatgaaatcaaaatatcggtccctttcttatccttttctgcttccaaagtctcaaacaacagcccatgagttgagatatcaagtgcctgggtctgtccatgctaacgtacagttgctccgctctgctgctgattggtctgctggtataaagtaccatgaagagtccatccacgccgcttacgtccatgtgatagagaacagcaggcactatatctatatcgaaaaccagtttttcataagctgtgctgatgacaaagttgtgttcaacaagataggcgatgccattgcccagaggatcctgaaagctcacagggaaaaccagaaataccgggtatatgtcgtgataccacttctgccagggttcgaaggagacatttcaaccggcggaggaaatgctctacaggcaatcatgcacttcaactacagaaccatgtgcagaggagaaaattccatccttggacagttaaaagcagagcttggtaatcagtggataaattacatatcattctgtggtcttagaacacatgcagagctcgaaggaaacctagtaactgagcttatctatgtccacagcaagttgttaattgctgatgataacactgttattattggctctgccaacataaatgaccgcagcatgctgggaaagcgtgacagtgaaatggctgtcattgtgcaagatacagagactgttccttcagtaatggatggaaaagagtaccaagctggccggtttgcccgaggacttcggctacagtgctttagggttgtccttggctatcttgatgacccaagtgaggacattcaggatccagtgagtgacaaattcttcaaggaggtgtgggtttcaacagcagctcgaaatgctacaatttatgacaaggttttccggtgccttcccaatgatgaagtacacaatttaattcagctgagagactttataaacaagcccgtattagctaaggaagatcccattcgagctgaggaggaactgaagaagatccgtggatttttggtgcaattccccttttatttcttgtctgaagaaagcctactgccttctgttgggaccaaagaggccatagtgcccatggaggtttggacttaagagatattcattggcagctcaaagacttccaccctggagaccacactgcacacagtgacttcctggggatgtcatagccaaagccaggcctgacgcattctcgtatccaacccaaggaccttttggaatgactggggagggctgcagtcacattgatgtaaggactgtaaacatcagcaagactttataattccttctgcctaacttgtaaaaagggggctgcattcttgttggtagcatgtactctgttgagtaaaacacatattcaaattccgtataccaaaatccatttcctttgtaacaagaatttaccagtaactgtgatctaggttgccaaaagttgtctgaatctccttattcttctctgatcttcatttatgcagccaatgtctagctggacctgccctcatcttgcagttcatacaggcactgtttgagagattgtttattattagatgttgtaatgctgcttcaagattcttcatggttacatgggatgcccctgctcatctggtcctgaagtagtaacattcacccaaatgaggatatagtcattattccttttcagtcactgtacgaacacggcagactttagcctacacagtagactgtgttaggcacttctggtaacattgacactgtatcttgacaccactaagcaacaggaaggaataaattccaatattgagacagagatttatttcattttgctcccaaaggcactgacaacatgagtccttgtgattaggcccacctgatcaaatgtaaaaacatgcatgggatatttgattacgtaacaaccagctaaaactgagagcacacagccttcggaaacccccaaggtgtcgaggaggatcagatccagataagagaagatgattccttctagtcctgtaaaatttcctgtcatccttagctgctgggttgattgaaatttgatctctacatttcaaaatcaaactagtgaatacagtttgtctttcaagagaatcagaggcatcgtaactcctaccaagttagtaagtatgagtctaaccttgtttgacattcaggtcttctgctacattatcttctttgagaaaaattaattgattataaaatatgtgctacttcacttacattattaaatatgtattaacgcctctcaccagggcttccagtgaagttacaatgccctagtctgtgaattagtctggaaacgtgtttttccttttcggatgttagagtaccctttgataaactaaattttactaagctgaacaactctgacagtctaaagagctaatgtgggttaccaaaaggcctgtacctgtaaaacaaaatgcaggtgtaatgattatacatgtctatggattacctggacatactctcatttgggttgttcttcaaagaagcaagcagccgatccctgttttcataaagctaatacttcagttggaaaaattaaacaggagcacaaagtcagggataggggttagcagaagagagaaatagtgtcacatcaagggcaggatctcatagctagggaacatttcacaaataaggtgagattttgtaaccaataataaaaatgaatgtttttataagtaaataacttatttttcatatggctaaagatggtaaaatgacttcattctatagccattgtaaataagaatttgctattgatgaaagaagttcagattggcatttgaagtattgagtgtatgggatctctaaggatttcttagattttatatttaaatattttttaaaccttagaggagtcaacaaactggctcttgattttcagcaccctactctcatgaaaaaagcctgaaaggaccctttcccttataagtaatttaatccaatttctccccattttatagatgaggaaactgaggctcagatcagatgagaactcacttaaatccactcaatgtgtagatggtagagctgggactagcaacattgctgcagcccattgttggcctctctcttcactttatcattgcccaagaatgaggatatgcagtaaacagaattcaggcaagatacctctaagctgttttgaaccctctgatattttgtatttatgtgtttgtctgtctccccctactagaatgtaagctccatggggcagggacttcactgtattttgttcatagtgtatccccagagcctggaccagtgcttggcacataggagatggcaataaatgcttgtagaattaataaacaaggtgaaggagagagctaatgaaatgaaaatcttagtctcatataagaagtcttactactgctttctatggcaagttccttttctattgcatcttcccaaagacaagatgctcatctgcaaaggggtgataagatttacttggagggattttatggaaaattcagtgcaataattgcttttttttttttttttgcagtagcagtttacatagtacagcattctgcaaaaattgcatgaaatgtggacacaagatgtactgtatgacttaattacctgtcattctctgacaccattactacctactagaagttcaaataatttatctttaacattgcaatatctgataaactttttaaaatgtaaataattcaaagccttgaaaatctatcatgaatctgctcaacatttcaaagtgactattttgaaatgcctataaatgctatatacctg

SEQ ID NO: 3139 - DNA, 621 bp, Homo sapiens
agccaaaactgggcttgggaacaggaaggctttgcccgtttatttggattctcagggtagtcgattttgccacctcttggctatcagctgccttggagattggtttcatagtaaggattctttctttaaggtgatatggagcaactgctttcacaggggcaccagcccctttgcttttactctgtccaaagttaacatgtcactgaaaaacgagccacgggtaaatacctctgcactgcagaaaattgctgctgacatgagtaatatcatagaaaatctggacacgcgggaactccactttgagggagaggaggtagactacgacgtgtctcccagcgatcccaagatacaagaagtgtatatccctttctctgctatttataacactcaaggatttaaggagcctaatatacagacgtatctctccggctgtccaataaaagcacaagttctggaagtggaacgcttcacatctacaacaagggtaccaagtattaatctttacactattgaattaacacatggggaatttaaatggcaagttaagaggaaattcaagcattttcaagaatttcacagagagctgctcaagtacaaagcctttatccgcatccccattcc

SEQ ID NO: 3140 - DNA, 4387 bp, Homo sapiens
attctccgcggcgcggcggcgagtgctggctgcggtaccctcccgctcgcttgtccgtctgcgcgcccgcgatgtgaccagccgactgggggcgggctggcggctctgcctgcggcagcgcatcggtttttctcctggcaggtccctaattgagccgtgattcccttggagccagagacacccaccaggggctcggagcgccgcgctccggggctggaggcagctgcagcgctcgggtccgcgcggccgggtgcagtagcctcagtcccagccgccgcctcgctgagtcgtgtgccctggcgaatgcccggcgcccggcacagctgagccaaggcgactggtgcagagcggcggcgcctggtcctgcacttgccgctgctgccgggctgtgccggggcggcggcgctgcgcgccggagtttgcagaggctgcctccgagcgccgtccgccaggaagactccctgcctcctgagtcccaaaaacacgagatttttctcctatttcagcagttggccacaacttcattgctgggaaaaggccaagaaagaagagagaactctcaccacaacatttcaaagggaatacattgccagaacttggaatactctactggacaaacatttcctccaaggacacagctctctgcctccatgtcaccacctttgaaggactgactgattccctcggctggtgccagtgcctgctcctgccatggggcccgcggggagcctgctgggcagcggacagatgcagatcaccctgtggggaagtctggctgctgtcgccattttcttcgtcatcaccttcctcatcttcctgtgctctagttgtgacagggaaaagaagccgcgacagcatagtggggaccatgagaacctgatgaacgtgccttcagacaaggagatgttcagccgttcagttactagcctggcaacagatgctcctgccagcagtgagcagaatggggcactcaccaatggggacattctttcagaggacagtactctgacctgcatgcagcattacgaggaagtccagacatcggcctcggatctgctggattcccaggacagcacagggaaaccaaaatgtcatcagagtcgggagctgcccagaatccctcccgagagcgcagtggataccatgctcacggcgagaagtgtggacggggaccaggggctggggatggaagggccctatgaagtgctcaaggacagctcctcccaagaaaacatggtggaggactgcttgtatgaaactgtgaaagagatcaaggaggtggctgcagctgcacacctggagaaaggccacagtggcaaggcaaaatctacttctgcctcgaaagagctcccagggccccagactgaaggcaaagctgagtttgctgaatatgcctcggtggacagaaacaaaaaatgtcgtcaaagtgttaatgtagagagtatccttggaaattcatgtgatccagaagaggaggccccaccacctgtccctgttaagcttctggacgagaatgaaaaccttcaggagaaggaagggggagaggcggaagagagtgccacagacacgaccagtgaaactaacaagagatttagctcattgtcatacaagtctcgggaagaagaccccactctcacagaagaagagatctcagctatgtactcatcagtaaataaacctggacagttagtgaataaatcggggcagtcgcttacagttccggagtccacctacacctccattcaaggggacccacagaggtcaccctcctcctgtaatgatctctatgctactgttaaagacttcgaaaaaactccaaacagcacacttccaccagcagggaggcccagcgaggagccagagcctgattatgaagcgatacagactctcaacagagaggaagaaaaggccaccctggggaccaatggccaccacggtctcgtcccaaaggagaacgactacgagagcataagtgacttgcagcaaggcagagatattaccaggctctagcaacccagaagacaaccctgggtagcctgtgatcagtgtctggagacgtttcttctgtggaagagaagaagtgacacaaacctatacttcatatgctgctttagtcacctgaagatggttggagaggccctgtcgactgttctcccagttgttcagtttctgagacagagaggtacggactaggctgcacctgagtgtgcccctgcctgccagatggacaggtacacccaagcacatctccctgctgcaccctcaccacccacaaaagatcccagctgtcagtggtctcatctcattagtgaggaaagccaagctgtatggaaaagctgcactcaccaaggaccacaatgcccccggcctaaagtactgccattcagaaaagcaggtttttcttcctctctttccttttctctgtctgctactgactttaaggctttttcccccttgaaatgtccagattcctgtggttcatcccaaggaaattttcacacaaagcttggcctttgccctcaatataggtgttttaggatggtgacaaaccatggctgctgctttctgcccagctcgccagtcctccccaaagagttgcgcatcagcacctggggatctggaccctgcgggtgaagggatggggagggacgtccctggagtctcttctgtctttgttccttcttattttggcattcgatatcagcagcctctccccaaagtacttgaagtcagttttagatgctttattttatttttctagtcaaaaacgtgtttcccccagtgtttgaaaactcgtccgaatcttttcagtattttccatgagtattgtggtacttctagacttgtttaagcccagaactcattccttcaaaacagagagccttaatctttatgttgggacacagaccacatatttggacggcagccatgcatccatcgctgaagggctgtggacatgaatgtgtatttcccatggtctccgctgcccacaccaacagtgtggcatctcataagttaactgctaccctaaggtaatctaagattaaaatgtaaacatttatttttgttatgtaagtttataagatgttttatgttcaatgcctaatttctcaaaagtgccagaaaaaaatgtatattagctattttgattttatgtacaatgatttatactctccttttgaaaagataccataaagcacataagctagatcactacaaggagctgttatcttttttctaatcaagtgtttaaaacactgatggtttttaaagactcacctttttaaatggtacttggagctcctgattcaaattacctagaccccctagagaaataaatggaatatacataaataatcattttcagtggtttatggtgggcaatattgcaatatttgaaatggtaaaaatggaaagaagaacaaaatatgatgagaggtggctgtgaattataaacctcataaaagtgtcataattccattaaggtttaattatattttttcagaaaacagtgatgaattctgtagtccagtgcttgccaatgcaaattgcctattggaatcttcttcctatattttacaaacatcagtggctgaaatagctcagagtaagagctcagcctggtttgaatttaatcatctctttagatcttataaggccagcattaggaaacttgttcacttttcattttcaaaggagcctagttgaagtgctattatgagtgtgggctatggaaagacagcttttcctacactgataaagaaaaaaaatgaggaaattatttcatccccttgtgacatctgtgactttttggatttaataatcttgctgtttttcctctttatgacaaagaatataattgggaggatgaagtgtcttaaaaattgtagagaccagctcactggaatgtttttccatccctgtattcatggcttgactttgtgactgctctacactgcatgtctgacattgcagagtgagctatgttgaggtaaactggttggttgtcattattttgcaatcagcctggtctctcccatgaagatgtcgtgtgcataagcacaatcatcactgattagaagatcacagcagaatacccttggattagagagaagttcgtaccttgcatttctctgaattctagtctctcataagcactgctttgctggatgattttcactgctttgtgttaatgactttgagcgatctctcacatgatggggttctttagtacatggtaacagccatgtcatcttacacacctagcattgtgaatgctgtagtgacatcctttataggcaccttacagctcaaaacttttgtttcatttcatgccttacttatcaaaaaggcaggaaagtaggtatgatctctaaagtaaaaaaaa

SEQ ID NO: 3141 - DNA, 2687 bp, Homo sapiens
atttgaaaaatttctagtttcggagcttagccacaggccggctacgatctgcttgttcatctgagtgtcggcacaaaccagcagaggcggtgacgatgctctcgggcatagaggcggcggcaggggaatatgaggactcggagctgcggtgccgcgtggctgtggaggagctgagcccgggcgggcagccgcgaaggcgccaggccctgcgcaccgcggagctgagcctgggtcgcaacgagcgccgcgagttgatgctgcggctgcaagcgccagggcccgcggggcggccgcgctgctttcctctgcgcgccgcgcgcctcttcacgcgtttcgccgaggccgggcgcagcaccctgcggctccccgcccacgacacccccggggccggcgcagtgcagctgctgctctcggactgccccccagaccgcctgcgccgcttcctgcgcacattgcgcctcaagctggctgcggccccgggtcccgggccggcctccgcccgagcgcagctgctgggcccgcggccccgcgacttcgtcaccatcagccctgtgcagcccgaggagcggcggctcagggcggccacccgggttccggacactacgctggtgaagcggcctgtggagccccaggctggggccgagcctagcacagaagccccaaggtggcccctgcctgtgaagaggctgagcttgccctccaccaagccacagctttctgaggaacaggctgctgtgctgagggccgtcctgaaaggccagagcatcttcttcactgggagtgcaggaacagggaagtcatatctgctaaagcgaatcctgggctcactgccccccacaggcactgtggccactgccagcactggggtggcagcctgccacatcgggggcaccaccctccatgcctttgcaggcatcggctcaggccaggctcctctagcccagtgtgtggccctggcccaaaggccaggcgtgcggcagggctggctgaactgccagcggttggtcattgacgagatctcaatggtggaggcagacctgtttgacaaactggaggccgtggccagagctgtccggcagcagaacaagccattcggagggatccagctcatcatctgtggggactttctgcagctgccacctgtgaccaagggctcccagcccccacggttctgcttccagtccaagagctggaagaggtgtgtgccagtgaccctggagctgaccaaggtgtggaggcaggcagaccagaccttcatctctctactgcaggccgtgaggctaggcaggtgttcagatgaggtgacccgccagctccaggccacagcttcccacaaggtggggcgagatgggattgtggccacgaggctctgcacccaccaggatgatgtggccctcaccaacgagaggcggcttcaggagctgccaggtaaggtacacagatttgaggctatggacagcaaccctgagctggccagtaccctggatgcccagtgtcctgttagccagctccttcaactaaagctgggggcccaggtgatgctggtgaaaaacttatcggtgtctcggggcctggtgaatggtgcccgaggggtggtagttgggttcgaggcagaagggagagggctaccccaggtgcggttcctgtgtggagtcactgaggtcatccacgctgaccgctggacggtgcaggccaccgggggccagctcctcagtcggcagcagctgcccctccagctggcctgggcgatgtccatccacaagagccaaggcatgaccctggattgtgtggagatttctctgggccgtgtgtttgccagtggccaggcctatgtggccctttctcgggcccgcagcctgcagggcctacgtgtgctggactttgaccccatggcggttcgctgtgacccccgtgtgctgcacttctatgccaccctgcggcggggcaggagcctcagtctggagtccccagatgatgatgaggcagcctcagaccaggagaacatggacccaatcctctgagcctcacccacaaagagaagacaaagggtggcctgtggcctccccgtcctcctgctccctagtggcccagggccccagggaataactggagtaggcaggcagtgtccccttctgtattttttagggactctcagcctcctggcagggttaaagggagagtactttaaacccatataccagctgtgcttcagtttctctcactttgccctgggtaagctgctgtagggtcagaagtaaccctttctgtgccagttgagaatgagcctgtgtggtagctgatgtcagaggacaaagctctctgcaagggctggacacagagctgcagagtcctgaacatccctcctttcaggctgcagaagggagaggcaatgaagacaggtgctccggaagcagcatcagggctcttggaggggactggtggggactcaggctgggtgcagcctccaaacagagaacggaacttaggtgtgtctctacagctaggcccagcctagcccagcccagaacaaacacccttcagagcctaaccaaagaacataagctgcaaaatgtgcacccatattttaagctgctttttcaggggataaatagtgtttggggacattgaaatggatgttctcaggttgtatttatttcggacaaataaactagagaattgtgtaaaaa

SEQ ID NO: 3142 - DNA, 2278 bp, Homo sapiens
atttgaaaaatttctagtttcggagcttagccacaggccggctacgatctgcttgttcatctgagtgtcggcacaaaccagcagaggcggtgacgatgctctcgggcatagaggcggcggcaggggaatatgaggactcggagctgcggtgccgcgtggctgtggaggagctgagcccgggcgggcagccgcgaaggcgccaggccctgcgcaccgcggagctgagcctgggtcgcaacgagcgccgcgagttgatgctgcggctgcaagcgccagggcccgcggggcggccgcgctgctttcctctgcgcgccgcgcgcctcttcacgcgtttcgccgaggccgggcgcagcaccctgcggctccccgcccacgacacccccggggccggcgcagtgcagctgctgctctcggactgccccccagaccgcctgcgccgcttcctgcgcacattgcgcctcaagctggctgcggccccgggtcccgggccggcctccgcccgagcgcagctgctgggcccgcggccccgcgacttcgtcaccatcagccctgtgcagcccgaggagcggcggctcagggcggccacccgggttccggacactacgctggtgaagcggcctgtggagccccaggctggggccgagcctagcacagaagccccaaggtggcccctgcctgtgaagaggctgagcttgccctccaccaagccacagctttctgaggaacaggctgctgtgctgagggccgtcctgaaaggccagagcatcttcttcactgggagtgcaggaacagggaagtcatatctgctaaagcgaatcctgggctcactgccccccacaggcactgtggccactgccagcactggggtggcagcctgccacatcgggggcaccaccctccatgcctttgcaggcatcggctcaggccaggctcctctagcccagtgtgtggccctggcccaaaggccaggcgtgcggcagggctggctgaactgccagcggttggtcattgacgagatctcaatggtggaggcagacctgtttgacaaactggaggccgtggccagagctgtccggcagcagaacaagccattcggagggatccagctcatcatctgtggggactttctgcagctgccacctgtgaccaagggctcccagcccccacggttctgcttccagtccaagagctggaagaggtgtgtgccagtgaccctggagctgaccaaggtgtggaggcaggcagaccagaccttcatctctctactgcaggccgtgaggctaggcaggtgttcagatgaggtgacccgccagctccaggccacagcttcccacaaggtggggcgagatgggattgtggccacgaggctctgcacccaccaggatgatgtggccctcaccaacgagaggcggcttcaggagctgccaggtaaggtacacagatttgaggctatggacagcaaccctgagctggccagtaccctggatgcccagtgtcctgttagccagctccttcaactaaagctgggggcccaggtgatgctggtgaaaaacttatcggtgtctcggggcctggtgaatggtgcccgaggggtggtagttgggttcgaggcagaagggagagggctaccccaggtgcggttcctgtgtggagtcactgaggtcatccacgctgaccgctggacggtgcaggccaccgggggccagctcctcagtcggcagcagctgcccctccagctggcctgggcgatgtccatccacaagagccaaggcatgaccctggattgtgtggagatttctctgggccgtgtgtttgccagtggccaggcctatgtggccctttctcgggcccgcagcctgcagggcctacgtgtgctggactttgaccccatggcggttcgctgtgacccccgtgtgctgcacttctatgccaccctgcggcggggcaggagcctcagtctggctgcagaagggagaggcaatgaagacaggtgctccggaagcagcatcagggctcttggaggggactggtggggactcaggctgggtgcagcctccaaacagagaacggaacttaggtgtgtctctacagctaggcccagcctagcccagcccagaacaaacacccttcagagcctaaccaaagaacataagctgcaaaatgtgcacccatattttaagctgctttttcaggggataaatagtgtttggggacattgaaatggatgttctcaggttgtatttatttcggacaaataaactagagaattgtgtaaaaa

SEQ ID NO: 3143 - DNA, 2677 bp, Homo sapiens
gccacaggccggctacgatctgcttgttcatctgagtgtcggcacaagtgagtgtctgcccgaacccagagaccagcagaggcggtgacgatgctctcgggcatagaggcggcggcaggggaatatgaggactcggagctgcggtgccgcgtggctgtggaggagctgagcccgggcgggcagccgcgaaggcgccaggccctgcgcaccgcggagctgagcctgggtcgcaacgagcgccgcgagttgatgctgcggctgcaagcgccagggcccgcggggcggccgcgctgctttcctctgcgcgccgcgcgcctcttcacgcgtttcgccgaggccgggcgcagcaccctgcggctccccgcccacgacacccccggggccggcgcagtgcagctgctgctctcggactgccccccagaccgcctgcgccgcttcctgcgcacattgcgcctcaagctggctgcggccccgggtcccgggccggcctccgcccgagcgcagctgctgggcccgcggccccgcgacttcgtcaccatcagccctgtgcagcccgaggagcggcggctcagggcggccacccgggttccggacactacgctggtgaagcggcctgtggagccccaggctggggccgagcctagcacagaagccccaaggtggcccctgcctgtgaagaggctgagcttgccctccaccaagccacagctttctgaggaacaggctgctgtgctgagggccgtcctgaaaggccagagcatcttcttcactgggagtgcaggaacagggaagtcatatctgctaaagcgaatcctgggctcactgccccccacaggcactgtggccactgccagcactggggtggcagcctgccacatcgggggcaccaccctccatgcctttgcaggcatcggctcaggccaggctcctctagcccagtgtgtggccctggcccaaaggccaggcgtgcggcagggctggctgaactgccagcggttggtcattgacgagatctcaatggtggaggcagacctgtttgacaaactggaggccgtggccagagctgtccggcagcagaacaagccattcggagggatccagctcatcatctgtggggactttctgcagctgccacctgtgaccaagggctcccagcccccacggttctgcttccagtccaagagctggaagaggtgtgtgccagtgaccctggagctgaccaaggtgtggaggcaggcagaccagaccttcatctctctactgcaggccgtgaggctaggcaggtgttcagatgaggtgacccgccagctccaggccacagcttcccacaaggtggggcgagatgggattgtggccacgaggctctgcacccaccaggatgatgtggccctcaccaacgagaggcggcttcaggagctgccaggtaaggtacacagatttgaggctatggacagcaaccctgagctggccagtaccctggatgcccagtgtcctgttagccagctccttcaactaaagctgggggcccaggtgatgctggtgaaaaacttatcggtgtctcggggcctggtgaatggtgcccgaggggtggtagttgggttcgaggcagaagggagagggctaccccaggtgcggttcctgtgtggagtcactgaggtcatccacgctgaccgctggacggtgcaggccaccgggggccagctcctcagtcggcagcagctgcccctccagctggcctgggcgatgtccatccacaagagccaaggcatgaccctggattgtgtggagatttctctgggccgtgtgtttgccagtggccaggcctatgtggccctttctcgggcccgcagcctgcagggcctacgtgtgctggactttgaccccatggcggttcgctgtgacccccgtgtgctgcacttctatgccaccctgcggcggggcaggagcctcagtctggagtccccagatgatgatgaggcagcctcagaccaggagaacatggacccaatcctctgagcctcacccacaaagagaagacaaagggtggcctgtggcctccccgtcctcctgctccctagtggcccagggccccagggaataactggagtaggcaggcagtgtccccttctgtattttttagggactctcagcctcctggcagggttaaagggagagtactttaaacccatataccagctgtgcttcagtttctctcactttgccctgggtaagctgctgtagggtcagaagtaaccctttctgtgccagttgagaatgagcctgtgtggtagctgatgtcagaggacaaagctctctgcaagggctggacacagagctgcagagtcctgaacatccctcctttcaggctgcagaagggagaggcaatgaagacaggtgctccggaagcagcatcagggctcttggaggggactggtggggactcaggctgggtgcagcctccaaacagagaacggaacttaggtgtgtctctacagctaggcccagcctagcccagcccagaacaaacacccttcagagcctaaccaaagaacataagctgcaaaatgtgcacccatattttaagctgctttttcaggggataaatagtgtttggggacattgaaatggatgttctcaggttgtatttatttcggacaaataaactagagaattgtgt

SEQ ID NO: 3144 - DNA, 1631 bp, Homo sapiens
acgatctgcttgttcatctgagtgtcggcacaaaccagcagaggcggtgacgatgctctcgggcatagaggcggcggcaggggaatatgaggactcggagctgcggtgccgcgtggctgtggaggagctgagcccgggcgggcagccgcgaaggcgccaggccctgcgcaccgcggagctgagcctgggtcgcaacgagcgccgcgagttgatgctgcggctgcaagcgccagggcccgcggggcggccgcgctgctttcctctgcgcgccgcgcgcctcttcacgcgtttcgccgaggccgggcgcagcaccctgcggctccccgcccacgacacccccggggccggcgcagtgcagctgctgctctcggactgccccccagaccgcctgcgccgcttcctgcgcacattgcgcctcaagctggctgcggccccgggtcccgggccggcctccgcccgagcgcagctgctgggcccgcggccccgcgacttcgtcaccatcagccctgtgcagcccgaggagcggcggctcagggcggccacccgggttccggacactacgctggtgaagcggcctgtggagccccaggctggggccgagcctagcacagaagccccaaggtggcccctgcctgtgaagaggctgagcttgccctccaccaagccacagctttctgaggaacaggctgctgtgctgagggccgtcctgaaaggccagagcatcttcttcactgggagtgcaggtagtgggggcagagaggaggtagggggacagtggtggggtgggatagaggaacagggagacctgtctaactttgcccctgtccaggaacagggaagtcatatctgctaaagcgaatcctgggctcactgccccccacaggcactgtggccactgccagcactggggtggcagcctgccacatcgggggcaccaccctccatgcctttgcaggtaagtaggaacccctagggcttgagctaagagcaagcccagcttctgggaagggagagaggggaggtctgcataaagagggagttttgggggctgggcgccgtggctcactcttgtaatcccaaaactttaggaggccaaggtgggaggatcgcttgagcccaggagtttgagaccagcctggccaacacagtaaaccctgtctccacaaaatttaaaaattagcggccgggcgcagtggctcacgcctgtaatcccagcactttgggaggccgaggcaggcggatcacaaggtcaggagatcaagactatcctggctaacacggtaaaaccctgtctctactaaaaatacaaaaaaattagccaggcatggtggcaagcgcctgtagtcccagctactctggaggctgaggcaggagaatggcgtgaacccaggaggcagagcttgcagtgagccgagatcacgccactgcacttgagcctgggcgacacagcgagactccatctcaaaacaaaacaaaacaaaattagctgagcatggtggtgtgtgcctgtagtcccagctactatggaggttgaggtgggaggatcgcttgagcccatgaggcccaggttacagtgagccaagatcgtgccactgcacttcagcctgggtgacagaaagagaccttctctc

SEQ ID NO: 3145 - DNA, 1545 bp, Homo sapiens
cgtccgctgcagtccgccggcgagggagttacgcacgtcctgattctcctggagtctccagcccgcccagtggccgcagtcacccaggtccagaggcggcggtatcacaggctctccgacatgtctatgctggctgaacgtcggcggaagcagaagtgggctgtggatcctcagaacactgcctggagtaatgacgattccaagtttggccagcggatgctagagaagatggggtggtctaaaggaaagggtttaggggctcaggagcaaggagccacagatcatattaaagttcaagtgaaaaataaccacctgggactcggagctaccatcaataatgaagacaactggattgcccatcaggatgattttaaccagcttctggccgaactgaacacttgccatgggcaggaaaccacagattcctcggacaagaaggaaaagaaatcttttagccttgaggaaaagtccaaaatctccaaaaaccgtgttcactatatgaaattcacaaaagggaaggatctgtcatctcggagcaaaacagatcttgactgcatttttgggaaaagacagagtaagaagactcccgagggcgatgccagtccctccactccagaggagaacgaaaccacgacaaccagcgccttcaccatccaggagtactttgccaagcggatggcagcactgaagaacaagccccaggttccagttccagggtctgacatttctgagacgcaggtggaacgtaaaagggggaagaaaagaaataaagaggccacaggtaaagatgtggaaagttacctccagcctaaggccaagaggcacacggagggaaagcccgagagggccgaggcccaggagcgagtggccaagaagaagagcgcgccagcagaagagcagctcagaggcccctgctgggaccagagttccaaggcctctgctcaggatgcaggggaccatgtgcagccgcctgagggccgggacttcaccctgaagcccaaaaagaggagagggaagaaaaagctgcaaaaaccagtagagatagcagaggacgctacactagaagaaacgctagtgaaaaagaagaagaagaaagattccaaatgaatccttcccagccggggccttccgaccactcagctgtcagggcactgcgggggcagacacctctggcctgaagtcacagcagagttcaccccagagcgcctgggcgcatcttgtggcatgcccatgggctgccgagtcctgccctctcgccacatttcccccaagttacattcccaggaggacctttttaatgttctcaatcgtggctctcagacacaaataaatttttttgtaaactctgagcccttcagcaagagagtttaattataatcattacaaatacatgcattcatgtaagtgtgcacacgtgtgtgtgcatgtgcgcatctgtgtgtgtgtgtgtgtgtcactatctccgtttgctctcggttcccttcaataacaatgaatggtgctttcttctgaaagactcagcctaattaaaggattaagaggcaa

SEQ ID NO: 3146 - DNA, 1466 bp, Homo sapiens
cgtccgctgcagtccgccggcgagggagttacgcacgtcctgattctcctggagtctccagcccgcccagtggccgcagtcacccaggtccagaggcggcggtatcacaggctctccgacatgtctatgctggctgaacgtcggcggaagcagaagtgggctgtggatcctcagaacactgcctggagtaatgacgattccaagtttggccagcggatgctagagaagatggggtggtctaaaggaaagggtttaggggctcaggagcaaggagccacagatcatattaaagttcaagtgaaaaataaccacctgggactcggagctaccatcaataatgaagacaactggattgcccatcaggatgattttaaccagcttctggccgaactgaacacttgccatgggcaggaaaccacagattcctcggacaagaaggaaaagaaatcttttagccttgaggaaaagtccaaaatctccaaaaaccgtgttcactatatgaaattcacaaaagggcgatgccagtccctccactccagaggagaacgaaaccacgacaaccagcgccttcaccatccaggagtactttgccaagcggatggcagcactgaagaacaagccccaggttccagttccagggtctgacatttctgagacgcaggtggaacgtaaaagggggaagaaaagaaataaagaggccacaggtaaagatgtggaaagttacctccagcctaaggccaagaggcacacggagggaaagcccgagagggccgaggcccaggagcgagtggccaagaagaagagcgcgccagcagaagagcagctcagaggcccctgctgggaccagagttccaaggcctctgctcaggatgcaggggaccatgtgcagccgcctgagggccgggacttcaccctgaagcccaaaaagaggagagggaagaaaaagctgcaaaaaccagtagagatagcagaggacgctacactagaagaaacgctagtgaaaaagaagaagaagaaagattccaaatgaatccttcccagccggggccttccgaccactcagctgtcagggcactgcgggggcagacacctctggcctgaagtcacagcagagttcaccccagagcgcctgggcgcatcttgtggcatgcccatgggctgccgagtcctgccctctcgccacatttcccccaagttacattcccaggaggacctttttaatgttctcaatcgtggctctcagacacaaataaatttttttgtaaactctgagcccttcagcaagagagtttaattataatcattacaaatacatgcattcatgtaagtgtgcacacgtgtgtgtgcatgtgcgcatctgtgtgtgtgtgtgtgtgtcactatctccgtttgctctcggttcccttcaataacaatgaatggtgctttcttctgaaagactcagcctaattaaaggattaagaggc

SEQ ID NO: 3147 - DNA, 1272 bp, Homo sapiens
cgtccgctgcagtccgccggcgagggagttacgcacgtcctgattctcctggagtctccagcccgcccagtggccgcagtcacccaggtccagaggcggcggtatcacaggctctccgacatgtctatgctggctgaacgtcggcggaagcagaagtgggctgtggatcctcagaacactgcctggagtaatgacgattccaagtttggccagcggatgctagagaagatggggtggtctaaaggaaagggtttaggggctcaggagcaaggagccacagatcatattaaagttcaagtgaaaaataaccacctgggactcggagctaccatcaataatgaagacaactggattgcccatcaggatgattttaaccagcttctggccgaactgaacacttgccatgggcaggaaaccacagattcctcggacaagaaggaaaagaaatcttttagccttgaggaaaagtccaaaatctccaaaaaccgtgttcactatatgaaattcacaaaagggcgatgccagtccctccactccagaggagaacgaaaccacgacaaccagcgccttcaccatccaggagtactttgccaagcggatggcagcactgaagaacaagccccaggttccagttccagggtctgacatttctgagacgcaggtggaacgtaaaagggggaagaaaagaaataaagaggccacaggtaaagatgtggaaagttacctccagcctaaggccaagaggcacacggagggaaagcccgagagggccgaggcccaggagcgagtggccaagaagaagagcgcgccagcagaagagcagctcagaggcccctgctgggaccagagttccaaggcctctgctcaggatgcaggggaccatgtgcagccgcctgagggccgggacttcaccctgaagcccaaaaagaggagagggaagaaaaagctgcaaaaaccagtagagatagcagaggacgctacactagaagaaacgctagtgaaaaagaagaagaagaaagattccaaatgaatccttcccagccggggccttccgaccactcagctgtcagggcactgcgggggcagacacctctggcctgaagtcacagcagagttcaccccagagcgcctgggcgcatcttgtggcatgcccatgggctgccgagtcctgccctctcgccacatttcccccaagttacattcccaggaggacctttttaatgttctcaatcgtggctctcagacacaaataaatttttttgtaaactctga

SEQ ID NO: 3148 - DNA, 3576 bp, Homo sapiens
cgcctcggcggcgcggcatagcccggctcggcctgtaaagcagtctcaagcctgccgcagggagaagatggcggtcgccgtgagaactttgcaggaacagctggaaaaggccaaagagagtcttaagaacgtggatgagaacattcgcaagctcaccgggcgggatccgaatgacgtgaggcccatccaagccagattgctggccctttctggtcctggtggaggtagaggacgtggtagtttattactgaggcgtggattctcagatagtggaggaggacccccagccaaacagagagaccttgaaggggcagtcagtaggctgggcggggagcgtcggaccagaagagaatcacgccaggaaagcgacccggaggatgatgatgttaaaaagccagcattgcagtcttcagttgtagctacctccaaagagcgcacacgtagagaccttatccaggatcaaaatatggatgaaaagggaaagcaaaggaaccggcgaatatttggcttgttgatgggtacccttcaaaaatttaaacaagaatccactgttgctactgaaaggcaaaagcggcgccaggaaattgaacaaaaacttgaagttcaggcagaagaagagagaaagcaggttgaaaatgaaaggagagaactgtttgaagagaggcgtgctaaacagacagaactgcggcttttggaacagaaagttgagcttgcgcagctgcaagaagaatggaatgaacataatgccaaaataattaaatatataagaactaagacaaagccccatttgttttatattcctggaagaatgtgtccagctacccaaaaactaatagaagagtcacagagaaaaatgaacgctttatttgaaggtagacgcatcgaatttgcagaacaaataaataaaatggaggctaggcctagaagacaatcaatgaaggaaaaagagcatcaggtggtgcgtaatgaagaacagaaggcggaacaagaagagggtaaggtggctcagcgagaggaagagttggaggagacaggtaatcagcacaatgatgtagaaatagaggaagcaggagaggaagaggaaaaggaaatagcgattgttcatagtgatgcagagaaagaacaggaggaggaagaacaaaaacaggaaatggaggttaagatggaggaggaaactgaggtaagggaaagtgagaagcagcaggatagtcagcctgaagaagttatggatgtgctagagatggttgagaatgtcaaacatgtaattgctgaccaggaggtaatggaaactaatcgagttgaaagtgtagaaccttcagaaaatgaagctagcaaagaattggaaccagaaatggaatttgaaattgagccagataaagaatgtaaaaccctttctcctgggaaagagaatgtcagtgctttagacatggaaaaggagtctgaggaaaaagaagaaaaagaatctgagccccaacctgagcctgtggctcaacctcagcctcagtctcagccccagcttcagcttcaatcccagtcccaaccagtactccagtcccagcctccctctcagcctgaggatttgtcattagctgttttacagccaacaccccaagttactcaggagcaagggcatttactacctgagaggaaggattttcctgtagagtctgtaaaactcactgaggtaccagtagagccagtcttgacagtacatccagagagcaagagcaaaaccaaaactaggagcagaagtagaggtcgagctagaaataaaacaagcaagagtagaagtcgaagcagtagcagtagcagttctagtagcagttcaaccagtagcagcagtggaagtagttccagcagtggaagtagtagcagtcgcagtagttccagtagcagctccagtacaagtggcagcagcagcagagatagtagcagtagcactagtagtagtagtgagagtagaagtcggagtaggggccggggacataatagagatagaaagcacagaaggagcgtggatcggaagagaagggatacttcaggactagaaagaagtcacaaatcttcaaaaggtggtagtagtagagatacaaaaggatcaaaggataagaattcccggtccgacagaaagaggtctatatcagagagtagtcgatcaggcaaaagatcttcaagaagtgaaagagaccgaaaatcagacaggaaagacaaaaggcgttaatggaagaagccaggctttcttagccattctttgcagcagaagatttcttgataaaaaaggattacctttccttgtaaagaggatgctgccttaagaattgcatgttgtaaaaaatctttttggaaaatacagactgtttgtttaccagacattcttgtactttttgcataattttgtaagagttatttatcaaaattatgtgaggttccaaaatatgtaaaaatgataataataaaaaaagattaacatcccttgtcatcttttttaaatatcctatactcttcagtaagaatctgtatattttaataggcaaatctttaagtctgttcccttctaattctgtatcatacattgcttttgtagaaataaatgtgtgtttatttcattatttttgggatgtcctcgttgacacttgtataataaatatcctctttatcattttcagcttttaacactagatactgcacgtgattagaatgtttttgaaggtttcctcgtttttatttgccttggacagtttttagttgtcagagtcagagctttgcagctttgagggggaacagttctctttaaaatcatttgctattttctattctcccttgttattttaatctaagcattttcccccgtttctcatattttaaccatatgttcggtagataactaaacagtatgatctggttggcattttcttcctgatgatgggagcgtcattcttttgtcttcatggttacttgtgtgatataacatacatctgttaaagaaaatcacttctttctaggggagggaggtagaaaagtatctttcaaacttggtttttgagtttgtgtcttgtcttaactttgtgttggctctaacttaaacatgctgatatgtgttttcaagaattttgtttaaggaagtattgtatggaagtccacaaaatgaaggaagttcatctaggttttaatatgtaagcaagataacacacaagtgtaccaagtgattattaactttgttgttttacaaatttgtatgaacttggagtatctgttggccattactatacatgtgcaaataaatgtggcttagacttgtgtgactgcttaagactagtacttgtattaactttctgatgctttatacaagagagcacttaaattgcatccttctttgagtttaacactgtagctttagccttgactttgaatattcattttgccttcccttgacaagtaaatggttacagtgaaaatgtgaagaagtatttccagttagtttttgtgtgtatataactcacttgtgtaagtggatgtgttaaaagatctctttttaaaaatccttttattggagtaattattaaaacagtaaatgca

SEQ ID NO: 3149 - DNA, 666 bp, Homo sapiens
atgccggtcatgaggctgttcccttgcttcctgcagctcctggccgggctggcgctgcctgctgtgcccccccagcagtgggccttgtctgctgggaacggctcgtcagaggtggaagtggtacccttccaggaagtgtggggccgcagctactgccgggcgctggagaggctggtggacgtcgtgtccgagtaccccagcgaggtggagcacatgttcagcccatcctgtgtctccctgctgcgctgcaccggctgctgcggcgatgagaatctgcactgtgtgccggtggagacggccaatgtcaccatgcagctcctaaagatccgttctggggaccggccctcctacgtggagctgacgttctctcagcacgttcgctgcgaatgccgccacagccctgggaggcagagcccagacatgcctggtgacttcagggctgatgctccctccttcctcccaccccgtcgctcactccccatgttgttccggatggagtggggctgtgccctgacaggcagccagtccgctgtctggccatcatctcctgtccctgaggaaattcccagaatgcaccctggaaggaacggaaaaaagcagcaaagaaagcctctgcgggagaagatgaagccggaaaggtgcggcgatgctgttccccggaggtaa

SEQ ID NO: 3150 - DNA, 1699 bp, Homo sapiens
aaacccaggcgcggaccggctgcagtctcagaagggagctgctgtctgcggaggaaactgcatcgacggacggccgcccagctacgggaggacctggagtggcactgggcgcccgacggaccatccccgggacccgcctgcccctcggcgccccgccccgccgggccgctccccgtcgggttccccagccacagccttacctacgggctcctgactccgcaaggcttccagaagatgctcgaaccaccggccggggcctcggggcagcagtgagggaggcgtccagccccccactcagctcttctcctcctgtgccaggggctccccgggggatgagcatggtggttttccctcggagccccctggctcgggacgtctgagaagatgccggtcatgaggctgttcccttgcttcctgcagctcctggccgggctggcgctgcctgctgtgcccccccagcagtgggccttgtctgctgggaacggctcgtcagaggtggaagtggtacccttccaggaagtgtggggccgcagctactgccgggcgctggagaggctggtggacgtcgtgtccgagtaccccagcgaggtggagcacatgttcagcccatcctgtgtctccctgctgcgctgcaccggctgctgcggcgatgagaatctgcactgtgtgccggtggagacggccaatgtcaccatgcagctcctaaagatccgttctggggaccggccctcctacgtggagctgacgttctctcagcacgttcgctgcgaatgccggcctctgcgggagaagatgaagccggaaaggtgcggcgatgctgttccccggaggtaacccaccccttggaggagagagaccccgcacccggctcgtgtatttattaccgtcacactcttcagtgactcctgctggtacctgccctctatttattagccaactgtttccctgctgaatgcctcgctcccttcaagacgaggggcagggaaggacaggaccctcaggaattcagtgccttcaacaacgtgagagaaagagagaagccagccacagacccctgggagcttccgctttgaaagaagcaagacacgtggcctcgtgaggggcaagctaggccccagaggccctggaggtctccaggggcctgcagaaggaaagaagggggccctgctacctgttcttgggcctcaggctctgcacagacaagcagcccttgctttcggagctcctgtccaaagtagggatgcggatcctgctggggccgccacggcctggctggtgggaaggccggcagcgggcggaggggatccagccacttccccctcttcttctgaagatcagaacattcagctctggagaacagtggttgcctgggggcttttgccactccttgtcccccgtgatctcccctcacactttgccatttgcttgtactgggacattgttctttccggccaaggtgccaccaccctgccccccctaagagacacatacagagtgggccccgggctggagaaagagctgcctggatgagaaacagctcagccagtggggatgaggtcaccaggggaggagcctgtgcgtcccagctgaaggcagtggcaggggagcaggttccccaagggccctggcacccccacaagctgtccctgcagggccatctgactgccaagccagattctcttgaataaagtattctagt

SEQ ID NO: 3151 - DNA, 1927 bp, Homo sapiens
gtctggacctgccgagagcccctcgcacgcactgcgggctccggcgctgcgggctggccgggcgctgcgggctgaccgggcgctccgggaactcggctcgggaacctcgtctgcggtgggcggggccggcccggagccccgccccggctcagtccctgaaacccaggcgcggaccggctgcagtctcagaagggagctgctgtctgcggaggaaactgcatcgacggacggccgcccagctacgggaggacctggagtggcactgggcgcccgacggaccatccccgggacccgcctgcccctcggcgccccgccccgccgggccgctccccgtcgggttccccagccacagccttacctacgggctcctgactccgcaaggcttccagaagatgctcgaaccaccggccggggcctcggggcagcagtgagggaggcgtccagccccccactcagctcttctcctcctgtgccaggggctccccgggggatgagcatggtggttttccctcggagccccctggctcgggacgtctgagaagatgccggtcatgaggctgttcccttgcttcctgcagctcctggccgggctggcgctgcctgctgtgcccccccagcagtgggccttgtctgctgggaacggctcgtcagaggtggaagtggtacccttccaggaagtgtggggccgcagctactgccgggcgctggagaggctggtggacgtcgtgtccgagtaccccagcgaggtggagcacatgttcagcccatcctgtgtctccctgctgcgctgcaccggctgctgcggcgatgagaatctgcactgtgtgccggtggagacggccaatgtcaccatgcagctcctaaagatccgttctggggaccggccctcctacgtggagctgacgttctctcagcacgttcgctgcgaatgccggcctctgcgggagaagatgaagccggaaaggaggagacccaagggcagggggaagaggaggagagagaagcagagacccacagactgccacctgtgcggcgatgctgttccccggaggtaacccaccccttggaggagagagaccccgcacccggctcgtgtatttattaccgtcacactcttcagtgactcctgctggtacctgccctctatttattagccaactgtttccctgctgaatgcctcgctcccttcaagacgaggggcagggaaggacaggaccctcaggaattcagtgccttcaacaacgtgagagaaagagagaagccagccacagacccctgggagcttccgctttgaaagaagcaagacacgtggcctcgtgaggggcaagctaggccccagaggccctggaggtctccaggggcctgcagaaggaaagaagggggccctgctacctgttcttgggcctcaggctctgcacagacaagcagcccttgctttcggagctcctgtccaaagtagggatgcggatcctgctggggccgccacggcctggctggtgggaaggccggcagcgggcggaggggatccagccacttccccctcttcttctgaagatcagaacattcagctctggagaacagtggttgcctgggggcttttgccactccttgtcccccgtgatctcccctcacactttgccatttgcttgtactgggacattgttctttccggccaaggtgccaccaccctgccccccctaagagacacatacagagtgggccccgggctggagaaagagctgcctggatgagaaacagctcagccagtggggatgaggtcaccaggggaggagcctgtgcgtcccagctgaaggcagtggcaggggagcaggttccccaagggccctggcacccccacaagctgtccctgcagggccatctgactgccaagccagattctcttgaataaagtattctagtgtggaaa

SEQ ID NO: 3152 - DNA, 1633 bp, Homo sapiens
aatcaagagagtctcagcctttaggtagctgacactgtgataagagcatcctgtgaactacccaaataaggaggaaaacgaacgcagctgagcatgggatgccatataaaaatcacttaaaccagtcgccactccttgtttcctgagttgtcctgtgctggaggtctgctcagacgaaggtctccatggcgttagaagtcttgatgctcctcgctgtcttgatttggaccggtgctgagaacctccatgtgaaaataagttgctctctggactggttgatggtctcagttatcccagttgcagaaagcagaaatctgtatatatttgcggatgaattacatctgggaatgggctgccctgcaaatcggatacatacatatgtatatgagtttatatatcttgttcgtgattgtggcatcaggacaagggtagtttctgaggaaactctcctttttcaaaccgagctgtactttaccccaaggaatatagatcatgaccctcaggaaatccatttggagtgttccacctctaggaaatcagtgtggcttacaccagtttctactgagaatgaaataaaattggatcctagtccttttattgctgactttcagacaacagcagaagagttaggattattatcttctagtccaaacttgctctgagctaaaggagaaatggaaacttgaagctggtgttatgtattttgcaggaaaacagtttcattttttcatagcaaaaatatagttggtgtatatctctccttaagtctctggtttctaaaaaccctacttcagtaaaggtcctgattagttgattagtgaatgtgtatttctaaatatttgtattcagtaggggtatggctgattaatttaacattaactattaggtaattcatattatacatttaagttctttctgttctgtgtagaagattcagaaatatgtcttcaaagacaatgacttgatctaattgataagaacctccaataaatatgttctaatatttttcaggaagaataaagaatagagagagacatataaatgtgcaagaggcaaaactttgagcatagtgtaaaatttaacatattaactctcacgaaaggcaaaatccttttatgtgcagatactttaattcatgtagattttcctattaatcagtaaagttgaatcctaacaataatgccatgtgacaacctatttagattattccagaattaaattcaatttattttctagagctcaagtaaccactaccttaactgaaatttgatgttaggtttcccttgttcctccgaatggttcttccacactcaaaataattgaatggttgagttggttaagcaaagagttatcctgccacctaagagcattcattaaatgattatttattaccacctactttatactatcttcctttctttaaacatggagtctaaatatgtaatatatcaaaaaatacttctgatttggtagatttcttatatcaagggtgagaattgaactgtgccattggctattcaatagcttattgaatgtatgttttggatgccacatcctcctggaagcaaattttgccaagatactgtttattattatttttaattaaagtgatactattccattttcaattaaa

SEQ ID NO: 3153 - DNA, 1188 bp, Homo sapiens
atgagagccctgctggcgcgcctgcttctctgcgtcctggtcgtgagcgactccaaaggcagcaatgaacttcatcaagttccatataagtcaaaaacctgctatgaggggaatggtcacttttaccgaggaaaggccagcactgacaccatgggccggccctgcctgccctggaactctgccactgtccttcagcaaacgtaccatgcccacagatctgatgctcttcagctgggcctggggaaacataattactgcaggaacccagacaaccggaggcgaccctggtgctatgtgcaggtgggcctaaagctgcttgtccaagagtgcatggtgcatgactgcgcagatggaaaaaagccctcctctcctccagaagaattaaaatttcagtgtggccaaaagactctgaggccccgctttaagattattgggggagaattcaccaccatcgagaaccagccctggtttgcggccatctacaggaggcaccgggggggctctgtcacctacgtgtgtggaggcagcctcatcagcccttgctgggtgatcagcgccacacactgcttcattgattacccaaagaaggaggactacatcgtctacctgggtcgctcaaggcttaactccaacacgcaaggggagatgaagtttgaggtggaaaacctcatcctacacaaggactacagcgctgacacgcttgctcaccacaacgacattgccttgctgaagatccgttccaaggagggcaggtgtgcgcagccatcccggactatacagaccatctgcctgccctcgatgtataacgatccccagtttggcacaagctgtgagatcactggctttggaaaagagaattctaccgactatctctatccggagcagctgaaaatgactgttgtgaagctgatttcccaccgggagtgtcagcagccccactactacggctctgaagtcaccaccaaaatgctgtgtgctgctgacccacagtggaaaacagattcctgccagggagactcagggggacccctcgtctgttccctccaaggccgcatgactttgactggaattgtgagctggggccgtggatgtgccctgaaggacaagccaggcgtctacacgagagtctcacacttcttaccctggatccgcagtcacaccaaggaagagaatggcctggccctctga

SEQ ID NO: 3154 - DNA, 2211 bp, Homo sapiens
cccgggccagggtccacctgtccccgcagcgccggctcgcgccctcctgccgcagccaccgagccgccgtctagcgccccgacctcgccaccatgagagccctgctggcgcgcctgcttctctgcgtcctggtcgtgagcgactccaaaggcagcaatgaacttcatcaagttccatataagtcaaaaacctgctatgaggggaatggtcacttttaccgaggaaaggccagcactgacaccatgggccggccctgcctgccctggaactctgccactgtccttcagcaaacgtaccatgcccacagatctgatgctcttcagctgggcctggggaaacataattactgcaggaacccagacaaccggaggcgaccctggtgctatgtgcaggtgggcctaaagctgcttgtccaagagtgcatggtgcatgactgcgcagatggaaaaaagccctcctctcctccagaagaattaaaatttcagtgtggccaaaagactctgaggccccgctttaagattattgggggagaattcaccaccatcgagaaccagccctggtttgcggccatctacaggaggcaccgggggggctctgtcacctacgtgtgtggaggcagcctcatcagcccttgctgggtgatcagcgccacacactgcttcattgattacccaaagaaggaggactacatcgtctacctgggtcgctcaaggcttaactccaacacgcaaggggagatgaagtttgaggtggaaaacctcatcctacacaaggactacagcgctgacacgcttgctcaccacaacgacattgccttgctgaagatccgttccaaggagggcaggtgtgcgcagccatcccggactatacagaccatctgcctgccctcgatgtataacgatccccagtttggcacaagctgtgagatcactggctttggaaaagagaattctaccgactatctctatccggagcagctgaaaatgactgttgtgaagctgatttcccaccgggagtgtcagcagccccactactacggctctgaagtcaccaccaaaatgctgtgtgctgctgacccacagtggaaaacagattcctgccagggagactcagggggacccctcgtctgttccctccaaggccgcatgactttgactggaattgtgagctggggccgtggatgtgccctgaaggacaagccaggcgtctacacgagagtctcacacttcttaccctggatccgcagtcacaccaaggaagagaatggcctggccctctgagggtccccagggaggaaacgggcaccacccgctttcttgctggttgtcatttttgcagtagagtcatctccatcagctgtaagaagagactgggaagataggctctgcacagatggatttgcctgtgccacccaccagggcgaacgacaatagctttaccctcaggcataggcctgggtgctggctgcccagacccctctggccaggatggaggggtggtcctgactcaacatgttactgaccagcaacttgtctttttctggactgaagcctgcaggagttaaaaagggcagggcatctcctgtgcatgggtgaagggagagccagctcccccgacggtgggcatttgtgaggcccatggttgagaaatgaataatttcccaattaggaagtgtaacagctgaggtctcttgagggagcttagccaatgtgggagcagcggtttggggagcagagacactaacgacttcagggcagggctctgatattccatgaatgtatcaggaaatatatatgtgtgtgtatgtttgcacacttgtgtgtgggctgtgagtgtaagtgtgagtaagagctggtgtctgattgttaagtctaaatatttccttaaactgtgtggactgtgatgccacacagagtggtctttctggagaggttataggtcactcctggggcctcttgggtcccccacgtgacagtgcctgggaatgtattattctgcagcatgacctgtgaccagcactgtctcagtttcactttcacatagatgtccctttcttggccagttatcccttccttttagcctagttcatccaatcctcactgggtggggtgaggaccactcctgtacactgaatatttatatttcactatttttatttatatttttgtaattttaaataaaagtgatcaataaaatgtgatttttctgatg

SEQ ID NO: 3155 - DNA, 2321 bp, Homo sapiens
gcccgggccagggtccacctgtccccgcagcgccggctcgcgccctcctgccgcagccaccgagccgccgtctagcgccccgacctcgccaccatgagagccctgctggcgcgcctgcttctctgcgtcctggtcgtgagcgactccaaaggcagcaatgaacttcatcaagttccatcgaactgtgactgtctaaatggaggaacatgtgtgtccaacaagtacttctccaacattcactggtgcaactgcccaaagaaattcggagggcagcactgtgaaatagataagtcaaaaacctgctatgaggggaatggtcacttttaccgaggaaaggccagcactgacaccatgggccggccctgcctgccctggaactctgccactgtccttcagcaaacgtaccatgcccacagatctgatgctcttcagctgggcctggggaaacataattactgcaggaacccagacaaccggaggcgaccctggtgctatgtgcaggtgggcctaaagctgcttgtccaagagtgcatggtgcatgactgcgcagatggaaaaaagccctcctctcctccagaagaattaaaatttcagtgtggccaaaagactctgaggccccgctttaagattattgggggagaattcaccaccatcgagaaccagccctggtttgcggccatctacaggaggcaccgggggggctctgtcacctacgtgtgtggaggcagcctcatcagcccttgctgggtgatcagcgccacacactgcttcattgattacccaaagaaggaggactacatcgtctacctgggtcgctcaaggcttaactccaacacgcaaggggagatgaagtttgaggtggaaaacctcatcctacacaaggactacagcgctgacacgcttgctcaccacaacgacattgccttgctgaagatccgttccaaggagggcaggtgtgcgcagccatcccggactatacagaccatctgcctgccctcgatgtataacgatccccagtttggcacaagctgtgagatcactggctttggaaaagagaattctaccgactatctctatccggagcagctgaaaatgactgttgtgaagctgatttcccaccgggagtgtcagcagccccactactacggctctgaagtcaccaccaaaatgctgtgtgctgctgacccacagtggaaaacagattcctgccagggagactcagggggacccctcgtctgttccctccaaggccgcatgactttgactggaattgtgagctggggccgtggatgtgccctgaaggacaagccaggcgtctacacgagagtctcacacttcttaccctggatccgcagtcacaccaaggaagagaatggcctggccctctgagggtccccagggaggaaacgggcaccacccgctttcttgctggttgtcatttttgcagtagagtcatctccatcagctgtaagaagagactgggaagataggctctgcacagatggatttgcctgtgccacccaccagggcgaacgacaatagctttaccctcaggcataggcctgggtgctggctgcccagacccctctggccaggatggaggggtggtcctgactcaacatgttactgaccagcaacttgtctttttctggactgaagcctgcaggagttaaaaagggcagggcatctcctgtgcatgggtgaagggagagccagctcccccgacggtgggcatttgtgaggcccatggttgagaaatgaataatttcccaattaggaagtgtaacagctgaggtctcttgagggagcttagccaatgtgggagcagcggtttggggagcagagacactaacgacttcagggcagggctctgatattccatgaatgtatcaggaaatatatatgtgtgtgtatgtttgcacacttgtgtgtgggctgtgagtgtaagtgtgagtaagagctggtgtctgattgttaagtctaaatatttccttaaactgtgtggactgtgatgccacacagagtggtctttctggagaggttataggtcactcctggggcctcttgggtcccccacgtgacagtgcctgggaatgtattattctgcagcatgacctgtgaccagcactgtctcagtttcactttcacatagatgtccctttcttggccagttatcccttccttttagcctagttcatccaatcctcactgggtggggtgaggaccactcctgtacactgaatatttatatttcactatttttatttatatttttgtaattttaaataaaagtgatcaataaaatgtgatttttctgatga

SEQ ID NO: 3156 - DNA, 2658 bp, Homo sapiens
atatagagcaggcgccgcgggtcgcagcacagtgcggagaccgcagccccggagcccgggccagggtccacctgtccccgcagcgccggctcgcgccctcctgccgcagccaccgagccgccgtctagcgccccgacctcgccaccatgagagccctgctggcgcgcctgcttctctgcgtcctggtcgtgagcgactccaaagtgagtgcgctcttgctttgactgatgctgcccaaggacctctgatcagcaccaggggagaggaggggctgctcagggagctggggtcctccggattccatccacagcagggccagactctccccaggaaatgggacagggtggcagcggaggcttgagaaccacgggggttggcactggctggcaagggaggaagaggccgccgggactgccccagcctgcgggcatctggtagatgaagcttgcttgggtcaatccatttctcctggctggaaacccatggtcttccatttgagaactagatacgaacaggcgaactgtgactgtctaaatggaggaacatgtgtgtccaacaagtacttctccaacattcactggtgcaactgcccaaagaaattcggagggcagcactgtgaaatagataagtcaaaaacctgctatgaggggaatggtcacttttaccgaggaaaggccagcactgacaccatgggccggccctgcctgccctggaactctgccactgtccttcagcaaacgtaccatgcccacagatctgatgctcttcagctgggcctggggaaacataattactgcaggaacccagacaaccggaggcgaccctggtgctatgtgcaggtgggcctaaagctgcttgtccaagagtgcatggtgcatgactgcgcagatggaaaaaagccctcctctcctccagaagaattaaaatttcagtgtggccaaaagactctgaggccccgctttaagattattgggggagaattcaccaccatcgagaaccagccctggtttgcggccatctacaggaggcaccgggggggctctgtcacctacgtgtgtggaggcagcctcatcagcccttgctgggtgatcagcgccacacactgcttcattgattacccaaagaaggaggactacatcgtctacctgggtcgctcaaggcttaactccaacacgcaaggggagatgaagtttgaggtggaaaacctcatcctacacaaggactacagcgctgacacgcttgctcaccacaacgacattgccttgctgaagatccgttccaaggagggcaggtgtgcgcagccatcccggactatacagaccatctgcctgccctcgatgtataacgatccccagtttggcacaagctgtgagatcactggctttggaaaagagaattctaccgactatctctatccggagcagctgaaaatgactgttgtgaagctgatttcccaccgggagtgtcagcagccccactactacggctctgaagtcaccaccaaaatgctgtgtgctgctgacccacagtggaaaacagattcctgccagggagactcagggggacccctcgtctgttccctccaaggccgcatgactttgactggaattgtgagctggggccgtggatgtgccctgaaggacaagccaggcgtctacacgagagtctcacacttcttaccctggatccgcagtcacaccaaggaagagaatggcctggccctctgagggtccccagggaggaaacgggcaccacccgctttcttgctggttgtcatttttgcagtagagtcatctccatcagctgtaagaagagactgggaagataggctctgcacagatggatttgcctgtgccacccaccagggcgaacgacaatagctttaccctcaggcataggcctgggtgctggctgcccagacccctctggccaggatggaggggtggtcctgactcaacatgttactgaccagcaacttgtctttttctggactgaagcctgcaggagttaaaaagggcagggcatctcctgtgcatgggtgaagggagagccagctcccccgacggtgggcatttgtgaggcccatggttgagaaatgaataatttcccaattaggaagtgtaacagctgaggtctcttgagggagcttagccaatgtgggagcagcggtttggggagcagagacactaacgacttcagggcagggctctgatattccatgaatgtatcaggaaatatatatgtgtgtgtatgtttgcacacttgtgtgtgggctgtgagtgtaagtgtgagtaagagctggtgtctgattgttaagtctaaatatttccttaaactgtgtggactgtgatgccacacagagtggtctttctggagaggttataggtcactcctggggcctcttgggtcccccacgtgacagtgcctgggaatgtattattctgcagcatgacctgtgaccagcactgtctcagtttcactttcacatagatgtccctttcttggccagttatcccttccttttagcctagttcatccaatcctcactgggtggggtgaggaccactcctgtacactgaatatttatatttcactatttttatttatatttttgtaattttaaataaaagtgatcaataaaatgtgatttttctgatg

SEQ ID NO: 3157 - DNA, 1413 bp, Homo sapiens
cagggccgagccagccccttcaccaccagccggccgcgccccgggaagggaagtttgtggcggaggaggttcgtacgggaggagggggaggcgcccacgcatctggggctgactcgctctttcgcaaaacgtctgggaggagtccctggggccacaaaactgcctccttcctgaggccagaaggagagaagacgtgcagggaccccgcgcacaggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagtcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacgaaccgaaaaaccaaagctatatggtaagaggctgtgcaaccgcctcaatgtgccaacatgcccacctgggtgacgccttcagcatgaaccacattgatgtctcctgctgtactaaaagtggctgtaaccacccagacctggatgtccagtaccgcagtggggctgctcctcagcctggccctgcccatctcagcctcaccatcaccctgctaatgactgccagactgtggggaggcactctcctctggacctaaacctgaaatccccctctctgccctggctggatccgggggacccctttgcccttccctcggctcccagccctacagacttgctgtgtgacctcaggccagtgtgccgacctctctgggcctcagttttcccagctatgaaaacagctatctcacaaagttgtgtgaagcagaagagaaaagctggaggaaggccgtgggccaatgggagagctcttgttattattaatattgttgccgctgttgtgttgttgttattaattaatattcatattatttattttatacttacataaagattttgtaccagtgg

SEQ ID NO: 3158 - DNA, 1414 bp, Homo sapiens
cagggccgagccagccccttcaccaccagccggccgcgccccgggaagggaagtttgtggcggaggaggttcgtacgggaggagggggaggcgcccacgcatctggggctgactcgctctttcgcaaaacgtctgggaggagtccctggggccacaaaactgcctccttcctgaggccagaaggagagaagacgtgcagggaccccgcgcacaggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaatcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacgaacgctcactctggggaagctggttgccatgtaaaagtactactgccctgagaccaccatgctgtgaggaagcccaagctactcatgtataaatgccatgtggagatagagccccagatgtttcagccatctcagcccaggcaccagacaagtgggtgaagaagccaccttggacatgtagccccagcagatgtgatatagagaagaaacaggaaacttggctatattagtttcctagggctgcctgtgataaattattacaaactttataaactaacacattgtgtgcctatatcaaaacatcatggaaggacaggcacagtggctcatgcctgtagtcctagcactttgggagggtgagaaaggaagatctcttgagctcaggagttcaagatcagcctgggcaacacagtgagacctcatctccact

SEQ ID NO: 3159 - DNA, 1548 bp, Homo sapiens
cagggccgagccagccccttcaccaccagccggccgcgccccgggaagggaagtttgtggcggaggaggttcgtacgggaggagggggaggcgcccacgcatctggggctgactcgctctttcgcaaaacgtctgggaggagtccctggggccacaaaactgcctccttcctgaggccagaaggagagaagacgtgcagggaccccgcgcacaggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaatcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacgaaccgaaaaaccaaagctatatggtaagaggctgtgcaaccgcctcaatgtgccaacatgcccacctgggtgacgccttcagcatgaaccacattgatgtctcctgctgtactaaaagtggctgtaaccacccagacctggatgtccagtaccgcagtggggctgctcctcagcctggccctgcccatctcagcctcaccatcaccctgctaatgactgccagactgtggggaggcactctcctctggacctaaacctgaaatccccctctctgccctggctggatccgggggacccctttgcccttccctcggctcccagccctacagacttgctgtgtgacctcaggccagtgtgccgacctctctgggcctcagttttcccagctatgaaaacagctatctcacaaagttgtgtgaagcagaagagaaaagctggaggaaggccgtgggccaatgggagagctcttgttattattaatattgttgccgctgttgtgttgttgttattaattaatattcatattatttattttatacttacataaagattttgtaccagtgg

SEQ ID NO: 3160 - DNA, 4165 bp, Homo sapiens
gcccggagagccgcatctattggcagctttgttattgatcagaaactgctcgccgccgacttggcttccagtctggctgcgggcaacccttgagttttcgcctctgtcctgtcccccgaactgacaggtgctcccagcaacttgctggggacttctcgccgctcccccgcgtccccaccccctcattcctccctcgccttcacccccacccccaccacttcgccacagctcaggatttgtttaaaccttgggaaactggttcaggtccaggttttgctttgatccttttcaaaaactggagacacagaagagggctctaggaaaaagttttggatgggattatgtggaaactaccctgcgattctctgctgccagagcaggctcggcgcttccaccccagtgcagccttcccctggcggtggtgaaagagactcgggagtcgctgcttccaaagtgcccgccgtgagtgagctctcaccccagtcagccaaatgagcctcttcgggcttctcctgctgacatctgccctggccggccagagacaggggactcaggcggaatccaacctgagtagtaaattccagttttccagcaacaaggaacagaacggagtacaagatcctcagcatgagagaattattactgtgtctactaatggaagtattcacagcccaaggtttcctcatacttatccaagaaatacggtcttggtatggagattagtagcagtagaggaaaatgtatggatacaacttacgtttgatgaaagatttgggcttgaagacccagaagatgacatatgcaagtatgattttgtagaagttgaggaacccagtgatggaactatattagggcgctggtgtggttctggtactgtaccaggaaaacagatttctaaaggaaatcaaattaggataagatttgtatctgatgaatattttccttctgaaccagggttctgcatccactacaacattgtcatgccacaattcacagaagctgtgagtccttcagtgctacccccttcagctttgccactggacctgcttaataatgctataactgcctttagtaccttggaagaccttattcgatatcttgaaccagagagatggcagttggacttagaagatctatataggccaacttggcaacttcttggcaaggcttttgtttttggaagaaaatccagagtggtggatctgaaccttctaacagaggaggtaagattatacagctgcacacctcgtaacttctcagtgtccataagggaagaactaaagagaaccgataccattttctggccaggttgtctcctggttaaacgctgtggtgggaactgtgcctgttgtctccacaattgcaatgaatgtcaatgtgtcccaagcaaagttactaaaaaataccacgaggtccttcagttgagaccaaagaccggtgtcaggggattgcacaaatcactcaccgacgtggccctggagcaccatgaggagtgtgactgtgtgtgcagagggagcacaggaggatagccgcatcaccaccagcagctcttgcccagagctgtgcagtgcagtggctgattctattagagaacgtatgcgttatctccatccttaatctcagttgtttgcttcaaggacctttcatcttcaggatttacagtgcattctgaaagaggagacatcaaacagaattaggagttgtgcaacagctcttttgagaggaggcctaaaggacaggagaaaaggtcttcaatcgtggaaagaaaattaaatgttgtattaaatagatcaccagctagtttcagagttaccatgtacgtattccactagctgggttctgtatttcagttctttcgatacggcttagggtaatgtcagtacaggaaaaaaactgtgcaagtgagcacctgattccgttgccttgcttaactctaaagctccatgtcctgggcctaaaatcgtataaaatctggatttttttttttttttttgctcatattcacatatgtaaaccagaacattctatgtactacaaacctggtttttaaaaaggaactatgttgctatgaattaaacttgtgtcgtgctgataggacagactggatttttcatatttcttattaaaatttctgccatttagaagaagagaactacattcatggtttggaagagataaacctgaaaagaagagtggccttatcttcactttatcgataagtcagtttatttgtttcattgtgtacatttttatattctccttttgacattataactgttggcttttctaatcttgttaaatatatctatttttaccaaaggtatttaatattcttttttatgacaacttagatcaactatttttagcttggtaaatttttctaaacacaattgttatagccagaggaacaaagatgatataaaatattgttgctctgacaaaaatacatgtatttcattctcgtatggtgctagagttagattaatctgcattttaaaaaactgaattggaatagaattggtaagttgcaaagactttttgaaaataattaaattatcatatcttccattcctgttattggagatgaaaataaaaagcaacttatgaaagtagacattcagatccagccattactaacctattccttttttggggaaatctgagcctagctcagaaaaacataaagcaccttgaaaaagacttggcagcttcctgataaagcgtgctgtgctgtgcagtaggaacacatcctatttattgtgatgttgtggttttattatcttaaactctgttccatacacttgtataaatacatggatatttttatgtacagaagtatgtctcttaaccagttcacttattgtactctggcaatttaaaagaaaatcagtaaaatattttgcttgtaaaatgcttaatatcgtgcctaggttatgtggtgactatttgaatcaaaaatgtattgaatcatcaaataaaagaatgtggctattttggggagaaaattatgtgtgtgtgtgctcaagatttatttcttggactctgagaaaatgaaagataaaattttctgttatgattttcatttagcaaaagcatatgtcaattcaaaagacaaaaaaagggaagatacctgtgagccttctctgcctcttgtttccaatgcctttgagcaatggttttatttttcttactggtcttaatacagatttctggtaatttaagtttcacctgacttgaaagttgtatggtttatgaaatgcttggtgataggtggtatggtagtatgaaactggaaaaaaacttgcaggtttccactcatgtcttcattgtcactggcaactactaaatggggtgagcataaattgatttggtgcatggattattgtacattgcacacttcaagatatggttcctcagttccagacatagattcctattcagggctggtatcttcagcatcctttcctcagcctttcaacttggcagagatgtctagtgtccagggccttctgtcttcagactgctcttcaggcaagcacccttttcctgtgctttgacacctgcagttctgccctgcctccaactatgtggaaaacaaagaaacaaaatgagcctatgtgttctgtcttacttccttaccttttcctggttttgtcctatccatatagaggccaactagatatatggaatatgcaacgtagtaagtagttggcagtttacaactttcattagtatagtaaagactactaagtcttagtaaatagcctgtttaactgtgtttaatccattgtttcccatctttgaacgaaatatattttcccttttttaatatttattttttgtttacttataaaatcttgacagccagaagagatcataagggtagcagtcctcagttgccagtcggtgagtggttaccatgtgaggactaaccactttataatcacttactcatagatcgtcctgtgtattttactaaacacacacacacacacacacacacataaatagcacatgaccctaatttctgagaagtacagtaagtattgactgtattgaccacacaccgttttgtgtatgatatctgtttcaagcctttgtccttgagacatgggctgttttgcccagtgatgtttactaaaataaaagcaagccttaaatgtca

SEQ ID NO: 3161 - DNA, 1354 bp, Homo sapiens
aggaaaaagttttggatgggattatgtggaaactaccctgcgattctctgctgccagagcaggctcggcgcttccaccccagtgcagccttcccctggcggtggtgaaagagactcgggagtcgctgcttccaaagtgcccgccgtgagtgagctctcaccccagtcagccaaatgagcctcttcgggcttctcctgctgacatctgccctggccggccagagacaggggactcaggcggaatccaacctgagtagtaaattccagttttccagcaacaaggaacagaacggtatgattttgtagaagttgaggaacccagtgatggaactatattagggcgctggtgtggttctggtactgtaccaggaaaacagatttctaaaggaaatcaaattaggataagatttgtatctgatgaatattttccttctgaaccagggttctgcatccactacaacattgtcatgccacaattcacagaagctgtgagtccttcagtgctacccccttcagctttgccactggacctgcttaataatgctataactgcctttagtaccttggaagaccttattcgatatcttgaaccagagagatggcagttggacttagaagatctatataggccaacttggcaacttcttggcaaggcttttgtttttggaagaaaatccagagtggtggatctgaaccttctaacagaggaggtaagattatacagctgcacacctcgtaacttctcagtgtccataagggaagaactaaagagaaccgataccattttctggccaggttgtctcctggttaaacgctgtggtgggaactgtgcctgttgtctccacaattgcaatgaatgtcaatgtgtcccaagcaaagttactaaaaaataccacgaggtccttcagttgagaccaaagaccggtgtcaggggattgcacaaatcactcaccgacgtggccctggagcaccatgaggagtgtgactgtgtgtgcagagggagcacaggaggatagccgcatcaccaccagcagctcttgcccagagctgtgcagtgcagtggctgattctattagagaacgtatgcgttatctccatccttaatctcagttgtttgcttcaaggacctttcatcttcaggatttacagtgcattctgaaagaggagacatcaaacagaattaggagttgtgcaacagctcttttgagaggaggcctaaaggacaggagaaaaggtcttcaatcgtggaaagaaaattaaatgttgtattaaatagatcaccagctagtttcagagttaccatgtacgtattccactagctgggttctgtatttcagttctttcgatacggctta

SEQ ID NO: 3162 - DNA, 1014 bp, Homo sapiens
ttacgtttgatgaaagatttgggcttgaagacccagaagatgacatatgcaagtatgattttgtagaagttgaggaacccagtgatggaactatattagggcgctggtgtggttctgggttctgcatccactacaacattgtcatgccaaacctcccgtgagttgttcctggcaggcatttgtgtctgcatgccctgtctgctgcttaggctctttaaaagatttgtgtgatacttgtttggttacttgtgtgattcataatagcagattctcgttttggcaagagaaaactctcttctatgatgcagtatacttggcttctcacaaagcaattcacagaagctgtgagtccttcagtgctacccccttcagctttgccactggacctgcttaataatgctataactgcctttagtaccttggaagaccttattcgatatcttgaaccagagagatggcagttggacttagaagatctatataggccaacttggcaacttcttggcaaggcttttgtttttggaagaaaatccagagtggtggatctgaaccttctaacagaggaggtaagattatacagctgcacacctcgtaacttctcagtgtccataagggaagaactaaagagaaccgataccattttctggccaggttgtctcctggttaaacgctgtggtgggaactgtgcctgttgtctccacaattgcaatgaatgtcaatgtgtcccaagcaaagttactaaaaaataccacgaggtccttcagttgagaccaaagaccggtgtcaggggattgcacaaatcactcaccgacgtggccctggagcaccatgaggagtgtgactgtgtgtgcagagggagcacaggaggatagccgcatcaccaccagcagctcttgcccagagctgtgcagtgcagtggctgattctattagagaacgtatgcgttatctccatccttaatctcagttgtttgcttcaaggacctttcatcttcaggatttacagtgcattctg

SEQ ID NO: 3163 - DNA, 995 bp, Homo sapiens
gcccggagagccgcatctattggcagctttgttattgatcagaaactgctcgccgccgacttggcttccagtctggctgcgggcaacccttgagttttcgcctctgtcctgtcccccgaactgacaggtgctcccagcaacttgctggggacttctcgccgctcccccgcgtccccaccccctcattcctccctcgccttcacccccacccccaccacttcgccacagctcaggatttgtttaaaccttgggaaactggttcaggtccaggttttgctttgatccttttcaaaaactggagacacagaagagggctctaggaaaaagttttggatgggattatgtggaaactaccctgcgattctctgctgccagagcaggctcggcgcttccaccccagtgcagccttcccctggcggtggtgaaagagactcgggagtcgctgcttccaaagtgcccgccgtgagtgagctctcaccccagtcagccaaatgagcctcttcgggcttctcctgctgacatctgccctggccggccagagacaggggactcaggcggaatccaacctgagtagtaaattccagttttccagcaacaaggaacagaacggagtacaagatcctcagcatgagagaattattactgtgtctactaatggaagtattcacagcccaaggtttcctcatacttatccaagaaatacggtcttggtatggagattagtagcagtagaggaaaatgtatggatacaacttacgtttgatgaaagatttgggcttgaagacccagaagatgacatatgcaagtatgattttgtagaagttgaggaacccagtgatggaactatattagggcgctggtgtggttctggtactgtaccaggaaaacagatttctaaaggaaatcaaattaggataagatttgtatctgatgaatattttccttctgaaccttctaacagaggaggtaagattatacagctgcacacctcgtaa

SEQ ID NO: 3164 - DNA, 579 bp, Homo sapiens
tactctgtttccacatcactttaactccatgagcatcgaagcttctggaatcaacatgtttcttatgtttcttgcaggttcaagccttgagggtcaagaaaactctttcacaatcaacagtgttgacatgaagagcctgccggactggacggtgcaaaatgggaagaacctgaccctgcagtgcttcgcggatgtcagcaccacctctcacgtcaagcctcagcaccagatgctgttctataaggatgacgtgctgttttacaacatctcctccatgaagagcacagagagttattttattcctgaagtccggatctatgactcagggacatataaatgtactgtgattgtgaacaacaaagagaaaaccactgcagagtaccaggtgttggtggaaggagtgcccagtcccagggtgacactggacaagaaagaggccatccaaggtgggatcgtgagggtcaactgttctgtcccagaggaaaaggccccaatacacttcacaattgaaaaacttgaactaaatgaaaaaatggtcaagctgaaaagagagaagaattctcgagaccagaattttgt

SEQ ID NO: 3165 - DNA, 3743 bp, Homo sapiens
ccaggccccattgttcccggtttccagccatggctgccattacctgaccagcgccacagccggtctctctgcaggcgccgggagaagtgaccagagcaatttctgcttttcacagggcgggtttctcaacggtgacttgtgggcagtgccttctgctgagcgagtcatggcccgaaggcagaactaactgtgcctgcagtcttcactctcaggatgcagccgaggtgggcccaaggggccacgatgtggcttggagtcctgctgacccttctgctctgttcaagccttgagggtcaagaaaactctttcacaatcaacagtgttgacatgaagagcctgccggactggacggtgcaaaatgggaagaacctgaccctgcagtgcttcgcggatgtcagcaccacctctcacgtcaagcctcagcaccagatgctgttctataaggatgacgtgctgttttacaacatctcctccatgaagagcacagagagttattttattcctgaagtccggatctatgactcagggacatataaatgtactgtgattgtgaacaacaaagagaaaaccactgcagagtaccaggtgttggtggaaggagtgcccagtcccagggtgacactggacaagaaagaggccatccaaggtgggatcgtgagggtcaactgttctgtcccagaggaaaaggccccaatacacttcacaattgaaaaacttgaactaaatgaaaaaatggtcaagctgaaaagagagaagaattctcgagaccagaattttgtgatactggaattccccgttgaggaacaggaccgcgttttatccttccgatgtcaagctaggatcatttctgggatccatatgcagacctcagaatctaccaagagtgaactggtcaccgtgacggaatccttctctacacccaagttccacatcagccccaccggaatgatcatggaaggagctcagctccacattaagtgcaccattcaagtgactcacctggcccaggagtttccagaaatcataattcagaaggacaaggcgattgtggcccacaacagacatggcaacaaggctgtgtactcagtcatggccatggtggagcacagtggcaactacacgtgcaaagtggagtccagccgcatatccaaggtcagcagcatcgtggtcaacataacagaactattttccaagcccgaactggaatcttccttcacacatctggaccaaggtgaaagactgaacctgtcctgctccatcccaggagcacctccagccaacttcaccatccagaaggaagatacgattgtgtcacagactcaagatttcaccaagatagcctcaaagtcggacagtgggacgtatatctgcactgcaggtattgacaaagtggtcaagaaaagcaacacagtccagatagtcgtatgtgaaatgctctcccagcccaggatttcttatgatgcccagtttgaggtcataaaaggacagaccatcgaagtccgttgcgaatcgatcagtggaactttgcctatttcttaccaacttttaaaaacaagtaaagttttggagaatagtaccaagaactcaaatgatcctgcggtattcaaagacaaccccactgaagacgtcgaataccagtgtgttgcagataattgccattcccatgccaaaatgttaagtgaggttctgagggtgaaggtgatagccccggtggatgaggtccagatttctatcctgtcaagtaaggtggtggagtctggagaggacattgtgctgcaatgtgctgtgaatgaaggatctggtcccatcacctataagttttacagagaaaaagagggcaaacccttctatcaaatgacctcaaatgccacccaggcattttggaccaagcagaaggctagcaaggaacaggagggagagtattactgcacagccttcaacagagccaaccacgcctccagtgtccccagaagcaaaatactgacagtcagagtcattcttgccccatggaagaaaggacttattgcagtggttatcatcggagtgatcattgctctcttgatcattgcggccaaatgttattttctgaggaaagccaaggccaagcagatgccagtggaaatgtccaggccagcagtaccacttctgaactccaacaacgagaaaatgtcagatcccaatatggaagctaacagtcattacggtcacaatgacgatgtcagaaaccatgcaatgaaaccaataaatgataataaagagcctctgaactcagacgtgcagtacacggaagttcaagtgtcctcagctgagtctcacaaagatctaggaaagaaggacacagagacagtgtacagtgaagtccggaaagctgtccctgatgccgtggaaagcagatactctagaacggaaggctcccttgatggaacttagacagcaaggccagatgcacatccctggaaggacatccatgttccgagaagaacagataatccctgtatttcaagacctctgtgcacttatttatgaacctgccctgctcccacagaacacagcaattcctcaggctaagctgccggttcttaaatccatcctgctaagttaatgttgggtagaaagagatacagaggggctgttgaatttcccacataccctccttccaccaagttggaacatccttggaaattggaagagcacaagaggagatccagggcaaggccattgggatattctgaaacttgaatattttgttttgtgcagagataaagaccttttccatgcaccctcatacacagaaaccaattttcttttttatactcaatcatttctagcgcatggcctggttagaggctggttttttctcttttcctttggtccttcaaaggcttgtagttttggctagtccttgttctttggaaatacacagtgctgaccagacagcctccccctgtcccctctatgacctcgccctccacaaatgggaaaaccagactacttgggagcaccgcctgtgaaataccaacctgaagacaccgttcattcaggcaacgcacaaaacagaaaatgaaggtggaacaagcacagatgttcttcaactgtttttgtctacactctttctcttttcctctaccatgctgaaggctgaaagacaggaagatggtgccatcagcaaatattattcttaattgaaaacttgaaatgtgtatgtttcttactaatttttaaaaatgtattccttgccagggcaggcaaggtggctcacgcctgtaatcccagcacttcaggaggctgaggtgggcggatcacctgaggtcaggagtttgagaccagcctgatgaaaccctgtctctactaaaaatacaagaattagccgggcgtggtggcgcatgcctgtagtatcagctactcaagaggctgaggtgagattatcgcttgaacccaggaaacggaggttgtagtgagcggagatcgcgccactgcactccagcctgagtgacagagtgagaatccatctcaaaaaaaacaaaaaacaaaattgcttgctaaagaagtggtctcctgaggtcttaagacattcctgacagtgtcttgagtgggtgggagagaggctgctgtcattgcgctgtggaatttcacagatgagaaccacgcctagccaaaatcacttttcctgtttgcctcagtgacacagctgcagggaccctcgtggatgttgtattaaataaatttgacctttgctctttgca

SEQ ID NO: 3166 - DNA, 852 bp, Homo sapiens
gaggagagtggctgcccaaggtggggtttgtcttttgccgtctgagtggcccctgggatgcagggcgggtttctcaacggtgacttgtgggcagtgccttctgctgagcgagtcatggcccgaaggcagaactaactgtgcctgcagtcttcactctcaggatgcagccgaggtgggcccaaggggccacgatgtggcttggagtcctgctgacccttctgctctgttcaagccttgagggtcaagaaaactctttcacaatcaacagtgttgacatgaagagcctgccggactggacggtgcaaaatgggaagaacctgaccctgcagtgcttcgcggatgtcagcaccacctctcacgtcaagcctcagcaccagatgctgttctataaggatgacgtgctgttttacaacatctcctccatgaagagcacagagagttattttattcctgaagtccggatctatgactcagggacatataaatgtactgtgattgtgaacaacaaagagaaaaccactgcagagtaccaggtgttggtggaaggagtgcccagtcccagggtgacactggacaagaaagaggccatccaaggtgggatcgtgagggtcaactgttctgtcccagaggaaaaggccccaatacacttcacaattgaaaaacttgaactaaatgaaaaaatggtcaagctgaaaagagagaagaattctcgagaccagaattttgtgatactggaattccccgttgaggaacaggaccgcgttttatccttccgatgtcaagctaggatcatttctgggatccatatgcagacctcagaatctaccaagagtgaactggtcaccgtgacgg

SEQ ID NO: 3167 - DNA, 580 bp, Homo sapiens
tttttctgtgcagttaacgagtcgctatgtttcggatctgcgttacttccccggtatttgaaggcaggagcactgcagggcgggtttctcaacggtgacttgtgggcagtgccttctgctgagcgagtcatggcccgaaggcagaactaactgtgcctgcagtcttcactctcaggatgcagccgaggtgggcccaaggggccacgatgtggcttggagtcctgctgacccttctgctctgttcaagccttgagggtcaagaaaactctttcacaatcaacagtgttgacatgaagagcctgccggactggacggtgcaaaatgggaagaacctgaccctgcagtgcttcgcggatgtcagcaccacctctcacgtcaagcctcagcaccagatgctgttctataaggatgacgtgctgttttacaacatctcctccatgaagagcacagagagttattttattcctgaagtccggatctatgactcagggacatataaatgtactgtgattgtgaacaacaaagagaaaaccactgcagagtaccaggtgttggtggaaggagtgcccagtcccagggt

SEQ ID NO: 3168 - DNA, 1308 bp, Homo sapiens
tccgcaaatatgcagaattaccggccgggtcgctcctgaagccagcgcggggagcgagcgcggcggcggccagcaccgggaacgcaccgaggaagaagcccagcccccgccctccgccccttccgtccccaccccctacccggcggcccaggaggctccccgcgctgcgggcgcgcactccctgtttctcctcctcctggctggcgctgcctgcctctccgcactcactgctcgcgccgggcgcgctccgccagctccgtgctccccgcgccaccctcctccgggccgcgctccctaagggatggtactgaatttcgccgccacaggagaccggctggagcgcccgccccgcggcctcgcctctcctccgagcagccagcgcctcgggacgcgatgaggaccttggcttgcctgctgctcctcggctgcggatacctcgcccatgttctggccgaggaagccgagatcccccgcgaggtgatcgagaggctggcccgcagtcagatccacagcatccgggacctccagcgactcctggagatagactccgtagggagtgaggattctttggacaccagcctgagagctcacggggtccatgccactaagcatgtgcccgagaagcggcccctgcccattcggaggaagagaagcatcgaggaagctgtccccgctgtctgcaagaccaggacggtcatttacgagattcctcggagtcaggtcgaccccacgtccgccaacttcctgatctggcccccgtgcgtggaggtgaaacgctgcaccggctgctgcaacacgagcagtgtcaagtgccagccctcccgcgtccaccaccgcagcgtcaaggtggccaaggtggaatacgtcaggaagaagccaaaattaaaagaagtccaggtgaggttagaggagcatttggagtgcgcctgcgcgaccacaagcctgaatccggattatcgggaagaggacacgggaaggcctagggagtcaggtaaaaaacggaaaagaaaaaggttaaaacccacctaaagcagccaaccagatgtgaggtgaggatgagccgcagccctttcctgggacatggatgtacatggcgtgttacattcctgaacctactatgtacggtgctttattgccagtgtgcggtctttgttctcctccgtgaaaaactgtgtccgagaacactcgggagaacaaagagacagtgcacatttgtttaatgtgacatcaaagcaagtattgtagcactcggtgaagcagtaagaagcttccttgtcaaaaagagagagagagaaagagagagagaaa

SEQ ID NO: 3169 - DNA, 2305 bp, Homo sapiens
ttcttggggctgatgtccgcaaatatgcagaattaccggccgggtcgctcctgaagccagcgcggggagcgagcgcggcggcggccagcaccgggaacgcaccgaggaagaagcccagcccccgccctccgccccttccgtccccaccccctacccggcggcccaggaggctccccgcgctgcgggcgcgcactccctgtttctcctcctcctggctggcgctgcctgcctctccgcactcactgctcgcgccgggcgcgctccgccagctccgtgctccccgcgccaccctcctccgggccgcgctccctaagggatggtactgaatttcgccgccacaggagaccggctggagcgcccgccccgcggcctcgcctctcctccgagcagccagcgcctcgggacgcgatgaggaccttggcttgcctgctgctcctcggctgcggatacctcgcccatgttctggccgaggaagccgagatcccccgcgaggtgatcgagaggctggcccgcagtcagatccacagcatccgggacctccagcgactcctggagatagactccgtagggagtgaggattctttggacaccagcctgagagctcacggggtccatgccactaagcatgtgcccgagaagcggcccctgcccattcggaggaagagaagcatcgaggaagctgtccccgctgtctgcaagaccaggacggtcatttacgagattcctcggagtcaggtcgaccccacgtccgccaacttcctgatctggcccccgtgcgtggaggtgaaacgctgcaccggctgctgcaacacgagcagtgtcaagtgccagccctcccgcgtccaccaccgcagcgtcaaggtggccaaggtggaatacgtcaggaagaagccaaaattaaaagaagtccaggtgaggttagaggagcatttggagtgcgcctgcgcgaccacaagcctgaatccggattatcgggaagaggacacggatgtgaggtgaggatgagccgcagccctttcctgggacatggatgtacatggcgtgttacattcctgaacctactatgtacggtgctttattgccagtgtgcggtctttgttctcctccgtgaaaaactgtgtccgagaacactcgggagaacaaagagacagtgcacatttgtttaatgtgacatcaaagcaagtattgtagcactcggtgaagcagtaagaagcttccttgtcaaaaagagagagagagaaagagagagagaaaacaaaaccacaaatgacaaaaacaaaacggactcacaaaaatatctaaactcgatgagatggagggtcgccccgtgggatggaagtgcagaggtctcagcagactggatttctgtccgggtggtcacaggtgcttttttgccgaggatgcagagcctgctttgggaacgactccagaggggtgctggtgggctctgcaggggcccgcaggaagcaggaatgtcttggaaaccgccacgcgaactttagaaaccacacctcctcgctgtagtatttaagcccatacagaaaccttcctgagagccttaagtggtttttttttttgtttttgttttgttttttttttttttgtttttttttttttttttttacaccataaagtgattattaagctttcctttttactctttggctagctttttttttttttttttttttttaattatctcttggatgacatttacaccgataacacacaggctgctgtaactgtcaggacagtgcgacggtatttttcctagcaagatgcaaactaatgagatgtattaaaataaacatggtatacctacctatgcatcatttcctaaatgtttctggctttgtgtttctcccttaccctgctttatttgttaatttaagccattttgaaagaactatgcgtcaaccaatcgtacgccgtccctgcggcacctgccccagagcccgtttgtggctgagtgacaacttgttccccgcagtgcacacctagaatgctgtgttcccacgcggcacgtgagatgcattgccgcttctgtctgtgttgttggtgtgccctggtgccgtggtggcggtcactccctctgctgccagtgtttggacagaacccaaattctttatttttggtaagatattgtgctttacctgtattaacagaaatgtgtgtgtgtggtttgtttttttgtaaaggtgaagtttgtatgtttacctaatattacctgttttgtatacctgagagcctgctatgttctttttttgttgatccaaaattaaaaaaaaaaataccaccaacaaaa

SEQ ID NO: 3170 - DNA, 564 bp, Homo sapiens
cggccggagcgccggggcgggggcggggaccggctctctggccctttttggcgcagcagctctgggcgctgcccgctgccgccgctggggcccgagagaggcgagccggcgacggcggcgcttctgcggcggcctcctccctccccacccggtgccgcaggattgcagctggcactggagggtgggcaagctcgagggaggggcgcggagccccggcgcggagccgggcgcggggctttgatggatttagctgcttgcgcgagcgcgtgtgtgctccctgccgcggcggcggcgcccgggccctgccgggtccgcacgaaccccgagcgcttccgaggagaccggctggagcgcccgccccgcggcctcgcctctcctccgagcagccagcgcctcgggacgcgatgaggaccttggcttgcctgctgctcctcggctgcggatacctcgcccatgttctggccgaggaagccgagatcccccgcgaggtgatcgagaggctggcccgcagtcagatccacagcatccgggacctccagcgactcctggagatagactccgtag

SEQ ID NO: 3171 - DNA, 6576 bp, Homo sapiens
aagagcaaaaagcgaaggcgcaatctggacactgggagattcggagcgcagggagtttgagagaaacttttattttgaagagaccaaggttgagggggggcttatttcctgacagctatttacttagagcaaatgattagttttagaaggatggactataacattgaatcaattacaaaacgcggtttttgagcccattactgttggagctacagggagagaaacagaggaggagactgcaagagatcattggaggccgtgggcacgctctttactccatgtgtgggacattcattgcggaataacatcggaggagaagtttcccagagctatggggacttcccatccggcgttcctggtcttaggctgtcttctcacagggctgagcctaatcctctgccagctttcattaccctctatccttccaaatgaaaatgaaaaggttgtgcagctgaattcatccttttctctgagatgctttggggagagtgaagtgagctggcagtaccccatgtctgaagaagagagctccgatgtggaaatcagaaatgaagaaaacaacagcggcctttttgtgacggtcttggaagtgagcagtgcctcggcggcccacacagggttgtacacttgctattacaaccacactcagacagaagagaatgagcttgaaggcaggcacatttacatctatgtgccagacccagatgtagcctttgtacctctaggaatgacggattatttagtcatcgtggaggatgatgattctgccattataccttgtcgcacaactgatcccgagactcctgtaaccttacacaacagtgagggggtggtacctgcctcctacgacagcagacagggctttaatgggaccttcactgtagggccctatatctgtgaggccaccgtcaaaggaaagaagttccagaccatcccatttaatgtttatgctttaaaagcaacatcagagctggatctagaaatggaagctcttaaaaccgtgtataagtcaggggaaacgattgtggtcacctgtgctgtttttaacaatgaggtggttgaccttcaatggacttaccctggagaagtgaaaggcaaaggcatcacaatgctggaagaaatcaaagtcccatccatcaaattggtgtacactttgacggtccccgaggccacggtgaaagacagtggagattacgaatgtgctgcccgccaggctaccagggaggtcaaagaaatgaagaaagtcactatttctgtccatgagaaaggtttcattgaaatcaaacccaccttcagccagttggaagctgtcaacctgcatgaagtcaaacattttgttgtagaggtgcgggcctacccacctcccaggatatcctggctgaaaaacaatctgactctgattgaaaatctcactgagatcaccactgatgtggaaaagattcaggaaataaggtatcgaagcaaattaaagctgatccgtgctaaggaagaagacagtggccattatactattgtagctcaaaatgaagatgctgtgaagagctatacttttgaactgttaactcaagttccttcatccattctggacttggtcgatgatcaccatggctcaactgggggacagacggtgaggtgcacagctgaaggcacgccgcttcctgatattgagtggatgatatgcaaagatattaagaaatgtaataatgaaacttcctggactattttggccaacaatgtctcaaacatcatcacggagatccactcccgagacaggagtaccgtggagggccgtgtgactttcgccaaagtggaggagaccatcgccgtgcgatgcctggctaagaatctccttggagctgagaaccgagagctgaagctggtggctcccaccctgcgttctgaactcacggtggctgctgcagtcctggtgctgttggtgattgtgatcatctcacttattgtcctggttgtcatttggaaacagaaaccgaggtatgaaattcgctggagggtcattgaatcaatcagcccagatggacatgaatatatttatgtggacccgatgcagctgccttatgactcaagatgggagtttccaagagatggactagtgcttggtcgggtcttggggtctggagcgtttgggaaggtggttgaaggaacagcctatggattaagccggtcccaacctgtcatgaaagttgcagtgaagatgctaaaacccacggccagatccagtgaaaaacaagctctcatgtctgaactgaagataatgactcacctggggccacatttgaacattgtaaacttgctgggagcctgcaccaagtcaggccccatttacatcatcacagagtattgcttctatggagatttggtcaactatttgcataagaatagggatagcttcctgagccaccacccagagaagccaaagaaagagctggatatctttggattgaaccctgctgatgaaagcacacggagctatgttattttatcttttgaaaacaatggtgactacatggacatgaagcaggctgatactacacagtatgtccccatgctagaaaggaaagaggtttctaaatattccgacatccagagatcactctatgatcgtccagcctcatataagaagaaatctatgttagactcagaagtcaaaaacctcctttcagatgataactcagaaggccttactttattggatttgttgagcttcacctatcaagttgcccgaggaatggagtttttggcttcaaaaaattgtgtccaccgtgatctggctgctcgcaacgtcctcctggcacaaggaaaaattgtgaagatctgtgactttggcctggccagagacatcatgcatgattcgaactatgtgtcgaaaggcagtacctttctgcccgtgaagtggatggctcctgagagcatctttgacaacctctacaccacactgagtgatgtctggtcttatggcattctgctctgggagatcttttcccttggtggcaccccttaccccggcatgatggtggattctactttctacaataagatcaagagtgggtaccggatggccaagcctgaccacgctaccagtgaagtctacgagatcatggtgaaatgctggaacagtgagccggagaagagaccctccttttaccacctgagtgagattgtggagaatctgctgcctggacaatataaaaagagttatgaaaaaattcacctggacttcctgaagagtgaccatcctgctgtggcacgcatgcgtgtggactcagacaatgcatacattggtgtcacctacaaaaacgaggaagacaagctgaaggactgggagggtggtctggatgagcagagactgagcgctgacagtggctacatcattcctctgcctgacattgaccctgtccctgaggaggaggacctgggcaagaggaacagacacagctcgcagacctctgaagagagtgccattgagacgggttccagcagttccaccttcatcaagagagaggacgagaccattgaagacatcgacatgatggatgacatcggcatagactcttcagacctggtggaagacagcttcctgtaactggcggattcgaggggttccttccacttctggggccacctctggatcccgttcagaaaaccactttattgcaatgcagaggttgagaggaggacttggttgatgtttaaagagaagttcccagccaagggcctcggggagcgttctaaatatgaatgaatgggatattttgaaatgaactttgtcagtgttgcctcttgcaatgcctcagtagcatctcagtggtgtgtgaagtttggagatagatggataagggaataataggccacagaaggtgaactttgtgcttcaaggacattggtgagagtccaacagacacaatttatactgcgacagaacttcagcattgtaattatgtaaataactctaaccaaggctgtgtttagattgtattaactatcttctttggacttctgaagagaccactcaatccatccatgtacttccctcttgaaacctgatgtcagctgctgttgaactttttaaagaagtgcatgaaaaaccatttttgaaccttaaaaggtactggtactatagcattttgctatcttttttagtgttaaagagataaagaataataattaaccaaccttgtttaatagatttgggtcatttagaagcctgacaactcattttcatattgtaatctatgtttataatactactactgttatcagtaatgctaaatgtgtaataatgtaacatgatttccctccagagaaagcacaatttaaaacaatccttactaagtaggtgatgagtttgacagtttttgacatttatattaaataacatgtttctctataaagtatggtaatagctttagtgaattaaatttagttgagcatagagaacaaagtaaaagtagtgttgtccaggaagtcagaatttttaactgtactgaataggttccccaatccatcgtattaaaaaacaattaactgccctctgaaataatgggattagaaacaaacaaaactcttaagtcctaaaagttctcaatgtagaggcataaacctgtgctgaacataacttctcatgtatattacccaatggaaaatataatgatcagcaaaaagactggatttgcagaagttttttttttttttttcttcatgcctgatgaaagctttggcgaccccaatatatgtattttttgaatctatgaacctgaaaagggtcagaaggatgcccagacatcagcctccttctttcaccccttaccccaaagagaaagagtttgaaactcgagaccataaagatattctttagtggaggctggatgtgcattagcctggatcctcagttctcaaatgtgtgtggcagccaggatgactagatcctgggtttccatccttgagattctgaagtatgaagtctgagggaaaccagagtctgtatttttctaaactccctggctgttctgatcggccagttttcggaaacactgacttaggtttcaggaagttgccatgggaaacaaataatttgaactttggaacagggttggcattcaaccacgcaggaagcctactatttaaatccttggcttcaggttagtgacatttaatgccatctagctagcaattgcgaccttaatttaactttccagtcttagctgaggctgagaaagctaaagtttggttttgacaggttttccaaaagtaaagatgctacttcccactgtatgggggagattgaactttccccgtctcccgtcttctgcctcccactccataccccgccaaggaaaggcatgtacaaaaattatgcaattcagtgttccaagtctctgtgtaaccagctcagtgttttggtggaaaaaacattttaagttttactgataatttgaggttagatgggaggatgaattgtcacatctatccacactgtcaaacaggttggtgtgggttcattggcattctttgcaatactgcttaattgctgataccatatgaatgaaacatgggctgtgattactgcaatcactgtgctatcggcagatgatgctttggaagatgcagaagcaataataaagtacttgactacctactggtgtaatctcaatgcaagccccaactttcttatccaactttttcatagtaagtgcgaagactgagccagattggccaattaaaaacgaaaacctgactaggttctgtagagccaattagacttgaaatacgtttgtgtttctagaatcacagctcaagcattctgtttatcgctcactctcccttgtacagccttattttgttggtgctttgcattttgatattgctgtgagccttgcatgacatcatgaggccggatgaaacttctcagtccagcagtttccagtcctaacaaatgctcccacctgaatttgtatatgactgcatttgtgtgtgtgtgtgtgttttcagcaaattccagatttgtttccttttggcctcctgcaaagtctccagaagaaaatttgccaatctttcctactttctatttttatgatgacaatcaaagccggcctgagaaacactatttgtgactttttaaacgattagtgatgtccttaaaatgtggtctgccaatctgtacaaaatggtcctatttttgtgaagagggacataagataaaatgatgttatacatcaatatgtatatatgtatttctatatagacttggagaatactgccaaaacatttatgacaagctgtatcactgccttcgtttatatttttttaactgtgataatccccacaggcacattaactgttgcacttttgaatgtccaaaatttatattttagaaataataaaaagaaagatacttacatgttcccaaaacaatggtgtggtgaatgtgtgagaaaaactaacttgatagggtctaccaatacaaaatgtattacgaatgcccctgttcatgtttttgttttaaaacgtgtaaatgaagatctttatatttcaataaatgatatataatttaaagttata

SEQ ID NO: 3172 - DNA, 586 bp, Homo sapiens
gacaggttttaaatgagtgttttcattcctcgcctgcggtttggcgggacagcgctgcagcccatggtgtggagcgcggctgggggaccagggggagtttcccagagctatggggacttcccatccggcgttcctggtcttaggctgtcttctcacagggctgagcctaatcctctgccagctttcattaccctctatccttccaaatgaaaatgaaaaggttgtgcagctgaattcatccttttctctgagatgctttggggagagtgaagtgagctggcagtaccccatgtctgaagaagagagctccgatgtggaaatcagaaatgaagaaaacaacagcggcctttttgtgacggtcttggaagtgagcagtgcctcggcggcccacacagggttgtacacttgctattacaaccacactcagacagaagagaatgagcttgaaggcaggcacatttacatctatgtgccagacccagatgtagcctttgtacctctaggaatgacggattatttagtcatcgtggaggatgatgattctgccattataccttgtcgcacaactgatcccgagactcctgta

SEQ ID NO: 3173 - DNA, 771 bp, Homo sapiens
catttggccctgagtgaagaagtcgtcgtcgcctcgcattccagcaactgggatttgaggaatttcgaaccgcacaccaaggggccctcattgtgctccgtggcccccgcccccgcctgtcttcccgcgccccctcctcggtggaatcatttctgcattgcccgggggctctgctttcgctcagttctggccgcaggcaggaagagaggaaaggtctccaggaaggtgccgaacttcttgtgaggaagttagggacgacttggaactggggaaacttgtttgcagtttcccagagctatggggacttcccatccggcgttcctggtcttaggctgtcttctcacagggctgagcctaatcctctgccagctttcattaccctctatccttccaaatgaaaatgaaaaggttgtgcagctgaattcatccttttctctgagatgctttggggagagtgaagtgagctggcagtaccccatgtctgaagaagagagctccgatgtggaaatcagaaatgaagaaaacaacagcggcctttttgtgacggtcttggaagtgagcagtgcctcggcggcccacacagggttgtacacttgctattacaaccacactcagacagaagagaatgagcttgaaggcaggcacatttacatctatgtgccagacccagatgtagcctttgtacctctaggaatgacggattatttagtcatcgtggaggatgatgattctgccattataccttgtcgcacaactgatcccgagactcct

SEQ ID NO: 3174 - DNA, 2202 bp, Homo sapiens
ggtttttgagcccattactgttggagctacagggagagaaacagaggaggagactgcaagagatcattggaggccgtgggcacgctctttactccatgtgtgggacattcattgcggaataacatcggaggagaagtttcccagagctatggggacttcccatccggcgttcctggtcttaggctgtcttctcacagggctgagcctaatcctctgccagctttcattaccctctatccttccaaatgaaaatgaaaaggttgtgcagctgaattcatccttttctctgagatgctttggggagagtgaagtgagctggcagtaccccatgtctgaagaagagagctccgatgtggaaatcagaaatgaagaaaacaacagcggcctttttgtgacggtcttggaagtgagcagtgcctcggcggcccacacagggttgtacacttgctattacaaccacactcagacagaagagaatgagcttgaaggcaggcacatttacatctatgtgccagacccagatgtagcctttgtacctctaggaatgacggattatttagtcatcgtggaggatgatgattctgccattataccttgtcgcacaactgatcccgagactcctgtaaccttacacaacagtgagggggtggtacctgcctcctacgacagcagacagggctttaatgggaccttcactgtagggccctatatctgtgaggccaccgtcaaaggaaagaagttccagaccatcccatttaatgtttatgctttaaaaggtacttgtatcatctccttccttctttaaataagagtaacaggcaaaatcataaggtgcgtgtaggatttttttttttttttaaatcatcatcactggtgatcctaaattctgatttggggatttaggaccccagctaatacaatgtctgtggctataataataagcttaaaattactaaaggccaaagcttgattacccatgcaagatttcatgtttcatcagttgacttcaaaatactgtaaggaattcttttcttacataagcctcttactttcattcacattcctgactatggcggccctaaaaacaaacatacacccagggggttagatgcctagattaattttagtaacttaagaaaagtgatttgaagaaagtagtttagacttcaaccctttgatgtccacagttagtacgcttggggaagtataatacatgctgaggtcaacagatatttcctgaacactatattacatggaggaatgggtagcagcaagagtacactgttttaaaatcagagcacagctaattttgtgccaggcactgtgctaggttctgggaaagtactgagaataactgaggagcagagtggaagagaagaagagaagaaacaattggatagaaacaaagtgtctagagcagtgtggatcagcaaatgttggttgattaaatgaataaatttattagtcaaggagattgtggacgagtataaccataactaacccactgctgaggaatgcggtgttctgtttgattggaatttatttttattgttattattttgtaattctgtattataactatatgcctaattgttgtacaccatctcacaatcaagccttgtgagattttccaaattttatcttgatcaaactggtttgcaaattatttttcagggttttcttaaaaaaaaaaaaaaaaacccaaactttataagatcctggctatcctgtggatttttaggcccttgtatttgttcttttttatagcaacatcagagctggatctagaaatggaagctcttaaaaccgtgtataagtcaggggaaacgattgtggtcacctgtgctgtttttaacaatgaggtggttgaccttcaatggacttaccctggagaagtggtaggtaccctcaaaacgtgcaatggcttggagcagagcaacagggctcagaagacctgcatttgagctcggtctgtcactgatgggcacatcactgagtttctctagaccttagcttcccacctctgggatgaacacatttgattaaatggcctttaggactccttgatcaatgggagagtttgaaatgatagttcctggaccaggcccttcagaatacataaagagtgtgccgtaagccttctttttcagaagtcagacagaaataggaaggttctctggctacaagatatcaaccaaaaaa

SEQ ID NO: 3175 - DNA, 573 bp, Homo sapiens
gaggttggagccaagatggctgaataggaacagctccggtctacagctcccagcatcagcgatgcagaagatgggtgatttctgcatttccatctgagtttcccagagctatggggacttcccatccggcgttcctggtcttaggctgtcttctcacagggctgagcctaatcctctgccagctttcattaccctctatccttccaaatgaaaatgaaaaggttgtgcagctgaattcatccttttctctgagatgctttggggagagtgaagtgagctggcagtaccccatgtctgaagaagagagctccgatgtggaaatcagaaatgaagaaaacaacagcggcctttttgtgacggtcttggaagtgagcagtgcctcggcggcccacacagggttgtacacttgctattacaaccacactcagacagaagagaatgagcttgaaggcaggcacatttacatctatgtgccagacccagatgtagcctttgtacctctaggaatgacggattatttagtcatcgtggaggatgatgattctgccattataccttgtcgcacaactgatc

SEQ ID NO: 3176 - DNA, 5717 bp, Homo sapiens
gctcctgaggctgccagcagccagcagtgactgcccgccctatctgggacccaggatcgctctgtgagcaacttggagccagagaggagatcaacaaggaggaggagagagccggcccctcagccctgctgcccagcagcagcctgtgctcgccctgcccaacgcagacagccagacccagggcggcccctctggcggctctgctcctcccgaaggatgcttggggagtgaggcgaagctgggccgctcctctcccctacagcagcccccttcctccatccctctgttctcctgagccttcaggagcctgcaccagtcctgcctgtccttctactcagctgttacccactctgggaccagcagtctttctgataactgggagagggcagtaaggaggacttcctggagggggtgactgtccagagcctggaactgtgcccacaccagaagccatcagcagcaaggacaccatgcggcttccgggtgcgatgccagctctggccctcaaaggcgagctgctgttgctgtctctcctgttacttctggaaccacagatctctcagggcctggtcgtcacacccccggggccagagcttgtcctcaatgtctccagcaccttcgttctgacctgctcgggttcagctccggtggtgtgggaacggatgtcccaggagcccccacaggaaatggccaaggcccaggatggcaccttctccagcgtgctcacactgaccaacctcactgggctagacacgggagaatacttttgcacccacaatgactcccgtggactggagaccgatgagcggaaacggctctacatctttgtgccagatcccaccgtgggcttcctccctaatgatgccgaggaactattcatctttctcacggaaataactgagatcaccattccatgccgagtaacagacccacagctggtggtgacactgcacgagaagaaaggggacgttgcactgcctgtcccctatgatcaccaacgtggcttttctggtatctttgaggacagaagctacatctgcaaaaccaccattggggacagggaggtggattctgatgcctactatgtctacagactccaggtgtcatccatcaacgtctctgtgaacgcagtgcagactgtggtccgccagggtgagaacatcaccctcatgtgcattgtgatcgggaatgaggtggtcaacttcgagtggacatacccccgcaaagaaagtgggcggctggtggagccggtgactgacttcctcttggatatgccttaccacatccgctccatcctgcacatccccagtgccgagttagaagactcggggacctacacctgcaatgtgacggagagtgtgaatgaccatcaggatgaaaaggccatcaacatcaccgtggttgagagcggctacgtgcggctcctgggagaggtgggcacactacaatttgctgagctgcatcggagccggacactgcaggtagtgttcgaggcctacccaccgcccactgtcctgtggttcaaagacaaccgcaccctgggcgactccagcgctggcgaaatcgccctgtccacgcgcaacgtgtcggagacccggtatgtgtcagagctgacactggttcgcgtgaaggtggcagaggctggccactacaccatgcgggccttccatgaggatgctgaggtccagctctccttccagctacagatcaatgtccctgtccgagtgctggagctaagtgagagccaccctgacagtggggaacagacagtccgctgtcgtggccggggcatgccccagccgaacatcatctggtctgcctgcagagacctcaaaaggtgtccacgtgagctgccgcccacgctgctggggaacagttccgaagaggagagccagctggagactaacgtgacgtactgggaggaggagcaggagtttgaggtggtgagcacactgcgtctgcagcacgtggatcggccactgtcggtgcgctgcacgctgcgcaacgctgtgggccaggacacgcaggaggtcatcgtggtgccacactccttgccctttaaggtggtggtgatctcagccatcctggccctggtggtgctcaccatcatctcccttatcatcctcatcatgctttggcagaagaagccacgttacgagatccgatggaaggtgattgagtctgtgagctctgacggccatgagtacatctacgtggaccccatgcagctgccctatgactccacgtgggagctgccgcgggaccagcttgtgctgggacgcaccctcggctctggggcctttgggcaggtggtggaggccacggctcatggcctgagccattctcaggccacgatgaaagtggccgtcaagatgcttaaatccacagcccgcagcagtgagaagcaagcccttatgtcggagctgaagatcatgagtcaccttgggccccacctgaacgtggtcaacctgttgggggcctgcaccaaaggaggacccatctatatcatcactgagtactgccgctacggagacctggtggactacctgcaccgcaacaaacacaccttcctgcagcaccactccgacaagcgccgcccgcccagcgcggagctctacagcaatgctctgcccgttgggctccccctgcccagccatgtgtccttgaccggggagagcgacggtggctacatggacatgagcaaggacgagtcggtggactatgtgcccatgctggacatgaaaggagacgtcaaatatgcagacatcgagtcctccaactacatggccccttacgataactacgttccctctgcccctgagaggacctgccgagcaactttgatcaacgagtctccagtgctaagctacatggacctcgtgggcttcagctaccaggtggccaatggcatggagtttctggcctccaagaactgcgtccacagagacctggcggctaggaacgtgctcatctgtgaaggcaagctggtcaagatctgtgactttggcctggctcgagacatcatgcgggactcgaattacatctccaaaggcagcacctttttgcctttaaagtggatggctccggagagcatcttcaacagcctctacaccaccctgagcgacgtgtggtccttcgggatcctgctctgggagatcttcaccttgggtggcaccccttacccagagctgcccatgaacgagcagttctacaatgccatcaaacggggttaccgcatggcccagcctgcccatgcctccgacgagatctatgagatcatgcagaagtgctgggaagagaagtttgagattcggccccccttctcccagctggtgctgcttctcgagagactgttgggcgaaggttacaaaaagaagtaccagcaggtggatgaggagtttctgaggagtgaccacccagccatccttcggtcccaggcccgcttgcctgggttccatggcctccgatctcccctggacaccagctccgtcctctatactgccgtgcagcccaatgagggtgacaacgactatatcatccccctgcctgaccccaaacccgaggttgctgacgagggcccactggagggttcccccagcctagccagctccaccctgaatgaagtcaacacctcctcaaccatctcctgtgacagccccctggagccccaggacgaaccagagccagagccccagcttgagctccaggtggagccggagccagagctggaacagttgccggattcggggtgccctgcgcctcgggcggaagcagaggatagcttcctgtagggggctggcccctaccctgccctgcctgaagctccccccctgccagcacccagcatctcctggcctggcctgaccgggcttcctgtcagccaggctgcccttatcagctgtccccttctggaagctttctgctcctgacgtgttgtgccccaaaccctggggctggcttaggaggcaagaaaactgcaggggccgtgaccagccctctgcctccagggaggccaactgactctgagccagggttcccccagggaactcagttttcccatatgtaaaatgggaaagttaggcttgatgacccagaatctaggattctctccctggctgacaggtggggagaccgaatccctccctgggaagattcttggagttactgaggtggtaaattaacttttttctgttcagccagctacccctcaaggaatcatagctctctcctcgcacttttatccacccaggagctagggaagagaccctagcctccctggctgctggctgagctagggcctagccttgagcagtgttgcctcatccagaagaaagccagtctcctccctatgatgccagtccctgcgttccctggcccgagctggtctggggccattaggcagcctaattaatgctggaggctgagccaagtacaggacacccccagcctgcagcccttgcccagggcacttggagcacacgcagccatagcaagtgcctgtgtccctgtccttcaggcccatcagtcctggggctttttctttatcaccctcagtcttaatccatccaccagagtctagaaggccagacgggccccgcatctgtgatgagaatgtaaatgtgccagtgtggagtggccacgtgtgtgtgccagtatatggccctggctctgcattggacctgctatgaggctttggaggaatccctcaccctctctgggcctcagtttccccttcaaaaaatgaataagtcggacttattaactctgagtgccttgccagcactaacattctagagtattccaggtggttgcacatttgtccagatgaagcaaggccatataccctaaacttccatcctgggggtcagctgggctcctgggagattccagatcacacatcacactctggggactcaggaaccatgccccttccccaggcccccagcaagtctcaagaacacagctgcacaggccttgacttagagtgacagccggtgtcctggaaagcccccagcagctgccccagggacatgggaagaccacgggacctctttcactacccacgatgacctccgggggtatcctgggcaaaagggacaaagagggcaaatgagatcacctcctgcagcccaccactccagcacctgtgccgaggtctgcgtcgaagacagaatggacagtgaggacagttatgtcttgtaaaagacaagaagcttcagatgggtaccccaagaaggatgtgagaggtgggcgctttggaggtttgcccctcacccaccagctgccccatccctgaggcagcgctccatgggggtatggttttgtcactgcccagacctagcagtgacatctcattgtccccagcccagtgggcattggaggtgccaggggagtcagggttgtagccaagacgcccccgcacggggagggttgggaagggggtgcaggaagctcaacccctctgggcaccaaccctgcattgcaggttggcaccttacttccctgggatccccagagttggtccaaggagggagagtgggttctcaatacggtaccaaagatataatcacctaggtttacaaatatttttaggactcacgttaactcacatttatacagcagaaatgctattttgtatgctgttgagtttttctatctgtgtacttttttttaagggaaagattttaatattaaacctggtgcttctcactcacaga

SEQ ID NO: 3177 - DNA, 568 bp, Homo sapiens
attggaactgtcacccggaggacaggctgtcagagctggacaccatgcggcttccgggtgcgatgccagctctggccctcaaaggcgagctgctgttgctgtctctcctgttacttctggaaccacagatctctcagggcctggtcgtcacacccccggggccagagcttgtcctcaatgtctccagcaccttcgttctgacctgctcgggttcagctccggtggtgtgggaacggatgtcccaggagcccccacaggaaatggccaaggcccaggatggcaccttctccagcgtgctcacactgaccaacctcactgggctagacacgggagaatacttttgcacccacaatgactcccgtggactggagaccgatgagcggaaacggctctacatctttgtgccagatcccaccgtgggcttcctccctaatgatgccgaggaactattcatctttctcacggaaataactgagatcaccattccatgccgagtaacagacccacagctggtggtgacactgcacgagaagaaaggggacgttgcactgcctgtcccctatgatca

SEQ ID NO: 3178 - DNA, 4252 bp, Homo sapiens
gctgcatcggagccggacactgcaggtagtgttcgaggcctacccaccgcccactgtcctgtggttgacaaccgcaccctgggcgactccagcgctggcgaaatcgccctgtccacgcgcaacgtgtcggagacccggtatgtgtcagagctgacactggttcgcgtgaaggtggcagaggctggccactacaccatgcgggccttccatgaggatgctgaggtccagctctccttccagctacagatcaatgtccctgtccgagtgctggagctaagtgagagccaccctgacagtggggaacagacagtccgctgtcgtggccggggcatgccccagccgaacatcatctggtctgcctgcagagacctcaaaaggtgtccacgtgagctgccgcccacgctgctggggaacagttccgaagaggagagccagctggagactaacgtgacgtactgggaggaggagcaggagtttgaggtggtgagcacactgcgtctgcagcacgtggatcggccactgtcggtgcgctgcacgctgcgcaacgctgtgggccaggacacgcaggaggtcatcgtggtgccacactccttgccctttaaggtggtggtgatctcagccatcctggccctggtggtgctcaccatcatctcccttatcatcctcatcatgctttggcagaagaagccacgttacgagatccgatggaaggtgattgagtctgtgagctctgacggccatgagtacatctacgtggaccccatgcagctgccctatgactccacgtgggagctgccgcgggaccagcttgtgctgggacgcaccctcggctctggggcctttgggcaggtggtggaggccacggctcatggcctgagccattctcaggccacgatgaaagtggccgtcaagatgcttaaatccacagcccgcagcagtgagaagcaagcccttatgtcggagctgaagatcatgagtcaccttgggccccacctgaacgtggtcaacctgttgggggcctgcaccaaaggaggacccatctatatcatcactgagtactgccgctacggagacctggtggactacctgcaccgcaacaaacacaccttcctgcagcaccactccgacaagcgccgcccgcccagcgcggagctctacagcaatgctctgcccgttgggctccccctgcccagccatgtgtccttgaccggggagagcgacggtggctacatggacatgagcaaggacgagtcggtggactatgtgcccatgctggacatgaaaggagacgtcaaatatgcagacatcgagtcctccaactacatggccccttacgataactacgttccctctgcccctgagaggacctgccgagcaactttgatcaacgagtctccagtgctaagctacatggacctcgtgggcttcagctaccaggtggccaatggcatggagtttctggcctccaagaactgcgtccacagagacctggcggctaggaacgtgctcatctgtgaaggcaagctggtcaagatctgtgactttggcctggctcgagacatcatgcgggactcgaattacatctccaaaggcagcacctttttgcctttaaagtggatggctccggagagcatcttcaacagcctctacaccaccctgagcgacgtgtggtccttcgggatcctgctctgggagatcttcaccttgggtggcaccccttacccagagctgcccatgaacgagcagttctacaatgccatcaaacggggttaccgcatggcccagcctgcccatgcctccgacgagatctatgagatcatgcagaagtgctgggaagagaagtttgagattcggccccccttctcccagctggtgctgcttctcgagagactgttgggcgaaggttacaaaaagaagtaccagcaggtggatgaggagtttctgaggagtgaccacccagccatccttcggtcccaggcccgcttgcctgggttccatggcctccgatctcccctggacaccagctccgtcctctatactgccgtgcagcccaatgagggtgacaacgactatatcatccccctgcctgaccccaaacccgaggttgctgacgagggcccactggagggttcccccagcctagccagctccaccctgaatgaagtcaacacctcctcaaccatctcctgtgacagccccctggagccccaggacgaaccagagccagagccccagcttgagctccaggtggagccggagccagagctggaacagttgccggattcggggtgccctgcgcctcgggcggaagcagaggatagcttcctgtagggggctggcccctaccctgccctgcctgaagctccccccctgccagcacccagcatctcctggcctggcctgaccgggcttcctgtcagccaggctgcccttatcagctgtccccttctggaagctttctgctcctgacgtgttgtgccccaaaccctggggctggcttaggaggcaagaaaactgcaggggccgtgaccagccctctgcctccagggaggccaactgactctgagccagggttcccccagggaactcagttttcccatatgtaaaatgggaaagttaggcttgatgacccagaatctaggattctctccctggctgacaggtggggagaccgaatccctccctgggaagattcttggagttactgaggtggtaaattaacttttttctgttcagccagctacccctcaaggaatcatagctctctcctcgcacttttatccacccaggagctagggaagagaccctagcctccctggctgctggctgagctagggcctagccttgagcagtgttgcctcatccagaagaaagccagtctcctccctatgatgccagtccctgcgttccctggcccgagctggtctggggccattaggcagcctaattaatgctggaggctgagccaagtacaggacacccccagcctgcagcccttgcccagggcacttggagcacacgcagccatagcaagtgcctgtgtccctgtccttcaggcccatcagtcctggggctttttctttatcaccctcagtcttaatccatccaccagagtctagaaggccagacgggccccgcatctgtgatgagaatgtaaatgtgccagtgtggagtggccacgtgtgtgtgccagtatatggccctggctctgcattggacctgctatgaggctttggaggaatccctcaccctctctgggcctcagtttccccttcaaaaaatgaataagtcggacttattaactctgagtgccttgccagcactaacattctagagtattccaggtggttgcacatttgtccagatgaagcaaggccatataccctaaacttccatcctgggggtcagctgggctcctgggagattccagatcacacatcacactctggggactcaggaaccatgccccttccccaggcccccagcaagtctcaagaacacagctgcacaggccttgacttagagtgacagccggtgtcctggaaagcccccagcagctgccccagggacatgggaagaccacgggacctctttcactacccacgatgacctccgggggtatcctgggcaaaagggacaaagagggcaaatgagatcacctcctgcagcccaccactccagcacctgtgccgaggtctgcgtcgaagacagaatggacagtgaggacagttatgtcttgtaaaagacaagaagcttcagatgggtaccccaagaaggatgtgagaggtgggcgctttggaggtttgcccctcacccaccagctgccccatccctgaggcagcgctccatgggggtatggttttgtcactgcccagacctagcagtgacatctcattgtccccagcccagtgggcattggaggtgccaggggagtcagggttgtagccaagacgcccccgcacggggagggttgggaagggggtgcaggaagctcaacccctctgggcaccaaccctgcattgcaggttggcaccttacttccctgggatccccagagttggtccaaggagggagagtgggttctcaatacggtaccaaagatataatcacctaggtttacaaatatttttaggactcacgttaactcacatttatacagcagaaatgctattttgtatgctgttgagtttttctatctgtgtacttttttttaagggaaagattttaatattaaacctggtgcttctcactc

SEQ ID NO: 3179 - DNA, 1549 bp, Homo sapiens
gcgccagggaggcgtcgccctgccgcgtcggagctgcttcctgggcgccgtgggcgcggactgcgcgggctgcgcgggtgccgaggagcgcgaggcgcggggaaggcgcacctggggtggccctggcgtgcgggcggcgacatggaggacggcgtgctcaaggagggcttcctggtcaagaggggccacattgtccacaactggaaggcgcgatggttcatccttcggcagaacacgctggtgtactacaagcttgaggggggtcggagagtgacccctcccaagggccggatcctcctggatggctgcaccatcacctgcccctgcctggagtatgaaaaccgaccgctcctcattaagctgaagactcaaacatccacggagtacttcctggaggcctgttctcgagaggagcgggatgcctgggcctttgagatcaccggggctattcatgcagggcagccggggaaggtccagcagctgcacagcctgagaaactccttcaagctgcccccgcacatcagcctgcatcgcattgtggacaagatgcacgatagcaacaccggaatccgttcaagccccaacatggagcagggaagcacctataaaaagaccttcctcggctcctccctggtggactggctcatctccaacagcttcacggccagccgtctggaggcggtgaccctggcctccatgctcatggaggagaacttcctcaggcctgtgggtgtccgaagcatgggagccattcgctctggggatctggccgagcagttcctggatgactccacagccctgtacacttttgctgagagctacaaaaagaagataagccccaaggaagaaattagcctgagcactgtggagttaagtggcacggtggtgaaacaaggctacctggccaagcagggacacaagaggaaaaactggaaggtgcgtcgctttgttctaaggaaggatccagctttcctgcattactatgacccttccaaagaagagaacaggccagtgggtgggttttctcttcgtggttcactcgtgtctgctctggaagataatggcgttcccactggggttaaagggaatgtccagggaaacctcttcaaagtgattactaaggatgacacacactattacattcaggccagcagcaaggctgagcgagccgagtggattgaagctatcaaaaagctaacatgacaaggacctgagggaaccaggattcctccctcctaccagatgacacagacaagagttcctggagaatgggagtgttaagacttttgacttctttgtaagttttgtactgctttggagagtgaatgctgccaagagttcctcagattacaaacagcagtggtgccatttccttccccatcttcatgttacaaacctggaaaggctagaacagccattaggcgtcagcatcttgacttttccccagcatcacaaacagccatttcctcgggcaccaaagtaggttccctttgttggaacaattacactggccatgccataatgttgaataaaactctcttcttatgag

SEQ ID NO: 3180 - DNA, 2059 bp, Homo sapiens
gaattaggggaactcagaaatccatcccccaccccacggccctacctagaagacttaggaatgtgggtccccagcgccgccatctgagactccagagtcgaggctcctagcatcccctacgtagaacactgagaaattccgactgcgggaccccagtctccgagagaccccagattctattcctggagcctgagagcccgaagttcacgcccctgagtctgggctccgcacctccctggggaccgcgtcggggtcgcgcaggagccgggctgcctcgagccggggctggaggctccccgggaggactctgctgggccgctcagccatgcctgagggagcccaaggactgagcctctccaaacctagcccaagcctcgggtgtggccgaagaggtgaagtgtgtgactgtggcaccgtgtgtgagactcggacagctcctgcagcccccaccatggcctccccccgaggttctgggagctccacatccctgagcacagtgggctctgagggggatccagcccctgggcccactccagcctgctcagcctccaggccagagccccttccagggcctcccatccgcctacatctctctccggtggggatcccaggttcagccagaccctcaaggctggagcgtgtggcccgggagatcgtggagacagaacgggcctatgtcagggacctccgcagcatcgtggaggactacctgggccctctgctggacggcggggtcctggggctgagcgtggagcaggtgggcacgctgtttgccaacattgaggacatctacgagttcagcagcgagctcctggaggacttggagaacagcagcagcgccgggggtattgccgagtgcttcgtgcagaggagcgaggattttgacatctacacattgtactgcatgaactacccgagctccctggccctgctccgggagctgtcgttgtctccgccagcagccctgtggctgcaggagcgccaggcccagcttcgccactcgctgcccctgcagagcttcctgctgaaacctgtccagcgcattctcaagtaccatctgctgctgcaggaactagggaagcactgggcggagggcccaggcactgggggtcgcgagatggtggaggaagctattgtgtccatgacagcggttgcctggtacatcaacgacatgaagcgcaagcaggagcatgcagcgcgcctccaggaagtgcagcggcggctgggtggctggaccggaccagagctcagtgcttttggggaactggtgttggagggcgcgttccgaggaggcggagggggtggcccccggctacgagggggtgagcggctgctcttcctgttctctcggatgctgctggtggccaagcgcagggggctggagtacacctacaaaggccacatcttctgctgcaacctgagcgtgagcgagagtccccgagaccctctagggttcaaggtgtctgatctgaccattcccaagcacagacacctgctccaggccaagaaccaagaagagaagaggctgtggattcactgtctccagcgcctcttctttgagaaccaccctgcctccatccctgccaaggcaaagcaagttctccttgaaaacagcctgcattgtgcccccaaaagtaagcctgtcctagagcccctgacacccccacttgggtctcctcgacctcgagatgctagaagttttacccctgggcgaaggaacacagctccatctcctgggccctctgtgattcgccgaggccgcaggcagtctgagccggtgaaggacccttatgtcatgttcccacagaacgctaagcctggattcaagcacgctggcagcgaaggggaactctaccctccagaatctcagccaccagtttcaggctctgcaccccctgaggacctggaggatgctggacccccaacactggacccctctgggacctcaatcactgaagaaatcctggaactgctgaatcagcgaggccttcgagatccaggggaatctatgggccttcacagggcccagggggctcctgatgcccccttccacatgtga

SEQ ID NO: 3181 - DNA, 5231 bp, Homo sapiens
atgtgagccccggcgacagcgggggaggggaagccccgggcgaccgccccccgcctcacagctgggatcggactctcccgccccagatgtggcgccgccgccgtcacacgagccccgtgacacccagccgggagcccgaggggtccagaggctcggacccgggcgtccggaatttctgcaccgcatcctgagagaccccgaggtccagaccccggcgcccaggctggaggacttgagccatccaggtgcgcagcgccccctcctggagcagccgggagcccggacgtcaccccgcgagaccctggaggccgagcgccccgtatccccgtttcaagaactcaggatccaggaccgcagactccctccagggctccgatcccaagaccccgcgttggaggaacttgagatccggacttctaagcgccccaaccagtttcgggctgcagcggccatcgcttcaaggggacccaggactttgggacccccctgtgctcccacctggagggagtttcattcctgcccctagaattaggggaactcagaaatccatcccccaccccacggccctacctagaagacttaggaatgtgggtccccagcgccgccatctgagactccagagtcgaggctcctagcatcccctacgtagaacactgagaaattccgactgcgggaccccagtctccgagagaccccagattctattcctggagcctgagagcccgaagttcacgcccctgagtctgggctccgcacctccctggggaccgcgtcggggtcgcgcaggagccgggctgcctcgagccggggctggaggctccccgggaggactctgctgggccgctcagccatgcctgagggagcccaaggactgagcctctccaaacctagcccaagcctcgggtgtggccgaagaggtgaagtgtgtgactgtggcaccgtgtgtgagactcggacagctcctgcagcccccaccatggcctccccccgaggttctgggagctccacatccctgagcacagtgggctctgagggggatccagcccctgggcccactccagcctgctcagcctccaggccagagccccttccagggcctcccatccgcctacatctctctccggtggggatcccaggttcagccagaccctcaaggctggagcgtgtggcccgggagatcgtggagacagaacgggcctatgtcagggacctccgcagcatcgtggaggactacctgggccctctgctggacggcggggtcctggggctgagcgtggagcaggtgggcacgctgtttgccaacattgaggacatctacgagttcagcagcgagctcctggaggacttggagaacagcagcagcgccgggggtattgccgagtgcttcgtgcagaggagcgaggattttgacatctacacattgtactgcatgaactacccgagctccctggccctgctccgggagctgtcgttgtctccgccagcagccctgtggctgcaggagcgccaggcccagcttcgccactcgctgcccctgcagagcttcctgctgaaacctgtccagcgcattctcaagtaccatctgctgctgcaggaactagggaagcactgggcggagggcccaggcactgggggtcgcgagatggtggaggaagctattgtgtccatgacagcggttgcctggtacatcaacgacatgaagcgcaagcaggagcatgcagcgcgcctccaggaagtgcagcggcggctgggtggctggaccggaccagagctcagtgcttttggggaactggtgttggagggcgcgttccgaggaggcggagggggtggcccccggctacgagggggtgagcggctgctcttcctgttctctcggatgctgctggtggccaagcgcagggggctggagtacacctacaaaggccacatcttctgctgcaacctgagcgtgagcgagagtccccgagaccctctagggttcaaggtgtctgatctgaccattcccaagcacagacacctgctccaggccaagaaccaagaagagaagaggctgtggattcactgtctccagcgcctcttctttgagaaccaccctgcctccatccctgccaaggcaaagcaagttctccttgaaaacagcctgcattgtgcccccaaaagtaagcctgtcctagagcccctgacacccccacttgggtctcctcgacctcgagatgctagaagttttacccctgggcgaaggaacacagctccatctcctgggccctctgtgattcgccgaggccgcaggcagtctgagccggtgaaggacccttatgtcatgttcccacagaacgctaagcctggattcaagcacgctggcagcgaaggggaactctaccctccagaatctcagccaccagtttcaggctctgcaccccctgaggacctggaggatgctggacccccaacactggacccctctgggacctcaatcactgaagaaatcctggaactgctgaatcagcgaggccttcgagatccagggccgtccacccatgacattcccaagttccccggagactcccaggtgcctggcgacagcgaaaccctcacattccaagccctgcccagccgggactcttcagaagaggaggaggaggaagaggaagggctggagatggatgaacgggggccttccccactccacgtcctggaagggctcgaaagttccattgcagctgaaatgcccagcattccctgccttaccaaaattcctgacgtgcccaaccttcctgaaattcccagccgctgtgaaattcccgaaggttctcgccttcctagtctctctgacatttccgatgtttttgagatgccctgccttccagccatacctagtgtccccaacacccccagtctgtctagcactcccaccctctcctgtgactcctggctccaagggcctctgcaggaaccagctgaggctccagccaccaggagagaactgttttctgggagcaatcctgggaaactgggagagccgccttcaggaggcaaggcagggccagaggaggatgaagaaggggtatcattcacagacttccagccccaggatgtcacccaacatcagggattcccagatgagctggcattccgctcttgctcagaaatccggagcgcctggcaggcattggaacagggacagctggcccggccaggcttcccagagccactgctgatcctggaggattcggatctgggtggagacagcgggagcgggaaggcaggagccccgagttcagaaaggacggcgtcccgagtgcgagagctggcccggctttacagcgagcggatccagcagatgcagcgggcggagactcgggcatcagccaatgccccgcgccgccggcctcgggttctggcccaaccccagccatccccctgtctgccccaggagcaggcagagccagggctcctgcctgcctttggacacgtgctggtatgtgagctggccttcccactgacatgtgcccaggagtctgtccccctgggtcctgctgtctgggttcaagctgccatacctttgtcaaagcagggaggcagcccggatggccagggtctacatgtttccaatttgcctaagcaagaccttccgggcatccacgtttcagctgctacccttttgcctgagcaaggaggttcccggcatgtccaggctccagccgccacacctttgcccaagcaagaaggccccctgcacctccaggtgccggctcttacaactttctctgatcaaggccacccagaaatccaagttccagccaccactcctttgcctgagcatagaagtcacatggttataccagctccatccaccgccttttgtcctgagcagggacactgtgcggacatccacgttcccaccactccagctttgcccaaggagatttgttctgatttcacagtttcagtcaccacccctgtgcccaagcaagaaggtcacctagacagcgagagcccaaccaatatcccactgacaaagcaaggaggttccagggatgttcagggcccagaccctgtctgcagtcaacccatccagcctttgtcttggcatggaagcagcctggatccccagggcccaggcgacaccctaccacccttgccatgtcacctcccagaccttcagattccaggtacctcacctttgcctgcacatggaagccacctggaccatcggatcccagccaacgccccactgtctttgtcccaggagctcccagacactcaggttccagctaccacacctttgcccctgccacaagtcctcacagacatctgggtccaagccctcccaacttcacccaagcagggaagcctcccagacatccagggtccagcggctgcacctccacttccggagccaagccttacagatacacaggtccaaaaactcacaccttcgttggagcagaagagcctcatagatgcccatgttccagctgccacacctttacctgagagaggaggctctctagacattcagggcctctcacccaccccagttcagaccaccatggttttgtccaaaccaggaggctccttagcctctcacgttgccaggttggagtcttcagacttgacgccacctcatagtcccccaccttccagccgtcagctcctgggccccaatgcagctgccctctccagatacctggcagcctcatatatcagccagagcctggctcggcggcaggggcctgggggaggggcccccgcagcctcccggggctcctggtcctctgctcccacgtcacgggcatcttcgccgcccccccagccccagccaccacctcccccagccaggcggctcagctatgccacgacggttaacatccacgtgggcgggggtgggcggctgcggccagccaaggcccaggtccggttgaaccaccctgctctcttggcctccacacaggaatctatgggccttcacagggcccagggggctcctgatgcccccttccacatgtgagccaggacatgaggcttccctgaagcaaggatttcagccagatgccatagaccctcagaacttgacctggaagtccagacactgaacgcaggcctcaaaactgctgcggccttccaactcctggtatctgcatcggcgaatggcccttcttgccttgatccacagggatggggaagggaggaatgtcattaatgttttgttaatactgattctttcatgc

SEQ ID NO: 3182 - DNA, 2102 bp, Homo sapiens
agctggagcccaaacgttcccaggatccctaagcctccggccccagacaaacgggactcgcagcttctgcgcctcctgctccgctcactcttctttgtctcagcctttccatctttttcgccaggactctgctgggccgctcagccatgcctgagggagcccaaggactgagcctctccaaacctagcccaagcctcgggtgtggccgaagaggtgaagtgtgtgactgtggcaccgtgtgtgagactcggacagctcctgcagcccccaccatggcctccccccgaggttctgggagctccacatccctgagcacagtgggctctgagggggatccagcccctgggcccactccagcctgctcagcctccaggccagagccccttccagggcctcccatccgcctacatctctctccggtggggatcccaggttcagccagaccctcaaggctggagcgtgtggcccgggagatcgtggagacagaacgggcctatgtcagggacctccgcagcatcgtggaggactacctgggccctctgctggacggcggggtcctggggctgagcgtggagcaggtgggcacgctgtttgccaacattgaggacatctacgagttcagcagcgagctcctggaggacttggagaacagcagcagcgccgggggtattgccgagtgcttcgtgcagaggagcgaggattttgacatctacacattgtactgcatgaactacccgagctccctggccctgctccgggagctgtcgttgtctccgccagcagccctgtggctgcaggagcgccaggcccagcttcgccactcgctgcccctgcagagcttcctgctgaaacctgtccagcgcattctcaagtaccatctgctgctgcaggaactagggaagcactgggcggagggcccaggcactgggggtcgcgagatggtggaggaagctattgtgtccatgacagcggttgcctggtacatcaacgacatgaagcgcaagcaggagcatgcagcgcgcctccaggaagtgcagcggcggctgggtggctggaccggaccagagctcagtgcttttggggaactggtgttggagggcgcgttccgaggaggcggagggggtggcccccggctacgagggggtgagcggctgctcttcctgttctctcggatgctgctggtggccaagcgcagggggctggagtacacctacaaaggccacatcttctgctgcaacctgagcgtgagcgagagtccccgagaccctctagggttcaaggtgtctgatctgaccattcccaagcacagacacctgctccaggccaagaaccaagaagagaagaggctgtggattcactgtctccagcgcctcttctttgagaaccaccctgcctccatccctgccaaggcaaagcaagttctccttgaaaacagcctgcattgtgcccccaaaagtaagcctgtcctagagcccctgacacccccacttgggtctcctcgacctcgagatgctagaagttttacccctgggcgaaggaacacagctccatctcctgggccctctgtgattcgccgaggccgcaggcagtctgagccggtgaaggacccttatgtcatgttcccacagaacgctaagcctggattcaagcacgctggcagcgaaggggaactctaccctccagaatctcagccaccagtttcaggctctgcaccccctgaggacctggaggatgctggacccccaacactggacccctctgggacctcaatcactgaagaaatcctggaactgctgaatcagcgaggccttcgagatccaggggaatctatgggccttcacagggcccagggggctcctgatgcccccttccacatgtgagccaggacatgaggcttccctgaagcaaggatttcagccagatgccatagaccctcagaacttgacctggaagtccagacactgaacgcaggcctcaaaactgctgcggccttccaactcctggtatctgcatcggcgaatggcccttcttgccttgatccacagggatggggaagggaggaatgtcattaatgttttgttaatactgattctttcatgcaa

SEQ ID NO: 3183 - DNA, 7519 bp, Homo sapiens
gaattaggggaactcagaaatccatcccccaccccacggccctacctagaagacttaggaatgtgggtccccagcgccgccatctgagactccagagtcgaggctcctagcatcccctacgtagaacactgagaaattccgactgcgggaccccagtctccgagagaccccagattctattcctggagcctgagagcccgaagttcacgcccctgagtctgggctccgcacctccctggggaccgcgtcggggtcgcgcaggagccgggctgcctcgagccggggctggaggctccccgggaggactctgctgggccgctcagccatgcctgagggagcccaaggactgagcctctccaaacctagcccaagcctcgggtgtggccgaagaggtgaagtgtgtgactgtggcaccgtgtgtgagactcggacagctcctgcagcccccaccatggcctccccccgaggttctgggagctccacatccctgagcacagtgggctctgagggggatccagcccctgggcccactccagcctgctcagcctccaggccagagccccttccagggcctcccatccgcctacatctctctccggtggggatcccaggttcagccagaccctcaaggctggagcgtgtggcccgggagatcgtggagacagaacgggcctatgtcagggacctccgcagcatcgtggaggactacctgggccctctgctggacggcggggtcctggggctgagcgtggagcaggtgggcacgctgtttgccaacattgaggacatctacgagttcagcagcgagctcctggaggacttggagaacagcagcagcgccgggggtattgccgagtgcttcgtgcagaggagcgaggattttgacatctacacattgtactgcatgaactacccgagctccctggccctgctccgggagctgtcgttgtctccgccagcagccctgtggctgcaggagcgccaggcccagcttcgccactcgctgcccctgcagagcttcctgctgaaacctgtccagcgcattctcaagtaccatctgctgctgcaggaactagggaagcactgggcggagggcccaggcactgggggtcgcgagatggtggaggaagctattgtgtccatgacagcggttgcctggtacatcaacgacatgaagcgcaagcaggagcatgcagcgcgcctccaggaagtgcagcggcggctgggtggctggaccggaccagagctcagtgcttttggggaactggtgttggagggcgcgttccgaggaggcggagggggtggcccccggctacgagggggtgagcggctgctcttcctgttctctcggatgctgctggtggccaagcgcagggggctggagtacacctacaaaggccacatcttctgctgcaacctgagcgtgagcgagagtccccgagaccctctagggttcaaggtgtctgatctgaccattcccaagcacagacacctgctccaggccaagaaccaagaagagaagaggctgtggattcactgtctccagcgcctcttctttgagaaccaccctgcctccatccctgccaaggcaaagcaagttctccttgaaaacagcctgcattgtgcccccaaaagtaagcctgtcctagagcccctgacacccccacttgggtctcctcgacctcgagatgctagaagttttacccctgggcgaaggaacacagctaagcctggattcaagcacgctggcagcgaaggggaactctaccctccagaatctcagccaccagtttcaggctctgcaccccctgaggacctggaggatgctggacccccaacactggacccctctgggacctcaatcactgaagaaatcctggaactgctgaatcagcgaggccttcgagatccagggccgtccacccatgacattcccaagttccccggagactcccaggtgcctggcgacagcgaaaccctcacattccaagccctgcccagccgggactcttcagaagaggaggaggaggaagaggaagggctggagatggatgaacgggggccttccccactccacgtcctggaagggctcgaaagttccattgcagctgaaatgcccagcattccctgccttaccaaaattcctgacgtgcccaaccttcctgaaattcccagccgctgtgaaattcccgaaggttctcgccttcctagtctctctgacatttccgatgtttttgagatgccctgccttccagccatacctagtgtccccaacacccccagtctgtctagcactcccaccctctcctgtgactcctggctccaagggcctctgcaggaaccagctgaggctccagccaccaggagagaactgttttctgggagcaatcctgggaaactgggagagccgccttcaggaggcaaggcagggccagaggaggatgaagaaggggtatcattcacagacttccagccccaggatgtcacccaacatcagggattcccagatgagctggcattccgctcttgctcagaaatccggagcgcctggcaggcattggaacagggacagctggcccggccaggcttcccagagccactgctgatcctggaggattcggatctgggtggagacagcgggagcgggaaggcaggagccccgagttcagaaaggacggcgtcccgagtgcgagagctggcccggctttacagcgagcggatccagcagatgcagcgggcggagactcgggcatcagccaatgccccgcgccgccggcctcgggttctggcccaaccccagccatccccctgtctgccccaggagcaggcagagccagggctcctgcctgcctttggacacgtgctggtatgtgagctggccttcccactgacatgtgcccaggagtctgtccccctgggtcctgctgtctgggttcaagctgccatacctttgtcaaagcagggaggcagcccggatggccagggtctacatgtttccaatttgcctaagcaagaccttccgggcatccacgtttcagctgctacccttttgcctgagcaaggaggttcccggcatgtccaggctccagccgccacacctttgcccaagcaagaaggccccctgcacctccaggtgccggctcttacaactttctctgatcaaggccacccagaaatccaagttccagccaccactcctttgcctgagcatagaagtcacatggttataccagctccatccaccgccttttgtcctgagcagggacactgtgcggacatccacgttcccaccactccagctttgcccaaggagatttgttctgatttcacagtttcagtcaccacccctgtgcccaagcaagaaggtcacctagacagcgagagcccaaccaatatcccactgacaaagcaaggaggttccagggatgttcagggcccagaccctgtctgcagtcaacccatccagcctttgtcttggcatggaagcagcctggatccccagggcccaggcgacaccctaccacccttgccatgtcacctcccagaccttcagattccaggtacctcacctttgcctgcacatggaagccacctggaccatcggatcccagccaacgccccactgtctttgtcccaggagctcccagacactcaggttccagctaccacacctttgcccctgccacaagtcctcacagacatctgggtccaagccctcccaacttcacccaagcagggaagcctcccagacatccagggtccagcggctgcacctccacttccggagccaagccttacagatacacaggtccaaaaactcacaccttcgttggagcagaagagcctcatagatgcccatgttccagctgccacacctttacctgagagaggaggctctctagacattcagggcctctcacccaccccagttcagaccaccatggttttgtccaaaccaggaggctccttagcctctcacgttgccaggttggagtcttcagacttgacgccacctcatagtcccccaccttccagccgtcagctcctgggccccaatgcagctgccctctccagatacctggcagcctcatatatcagccagagcctggctcggcggcaggggcctgggggaggggcccccgcagcctcccggggctcctggtcctctgctcccacgtcacgggcatcttcgccgcccccccagccccagccaccacctcccccagccaggcggctcagctatgccacgacggttaacatccacgtgggcgggggtgggcggctgcggccagccaaggcccaggtccggttgaaccaccctgctctcttggcctccacacaggaatctatgggccttcacagggcccagggggctcctgatgcccccttccacatgtgagccaggacatgaggcttccctgaagcaaggatttcagccagatgccatagaccctcagaacttgacctggaagtccagacactgaacgcaggcctcaaaactgctgcggccttccaactcctggtatctgcatcggcgaatggcccttcttgccttgatccacagggatggggaagggaggaatgtcattaatgttttgttaatactgattctttcatgcaatgatgtgtattttcccattctggaggctgtgggagatgacaagacaatgaatgggaaggtctgacacagaacaaatcagcggttctgaaagcttggggaatctcagactcctttgagaattattggaaaatggacccactataacttggcgtgtgtgtgaactgcttgatgcccatccaggaaagccaagttaagaagctttgcttcaagtagacactagaaatccattcccttggcaatttatacagttcacgtctcccaccatccgttcatctcacccaccctgccatctctccacctatccatctggctattgctccatctagctttcccgctccatctacccatcttccaatccatcatctcacgtatctgccttgcttatccaactgtctgccttattcacccacccatccctttatcattctaaccccatctggcattccatccctccatttatccatcttcccacttacccatcttctccatccagcactccgttcatcagtccgtctctccctccatatttccatctgtccattcatccactcattttgccatccatacatattcacccagccatctcccaatccatcgacataccccatccctccctcactggactctccggggtcttagtactatgatacttcagagacaattccatgctgatacgggggagatcaattttggggctctgggataagtctgtcccacatctgtctgatttcccttggcatccttcccgtcagttcctcttgaatatcccagttcttgtacccactcacatacctcagatcccttcactcctccccgcagtttgcagcctctacaattcatccacatgctccctcccccagcaaaataattcaggtcgtggagacaaaaggcttttatgttaggttctgtctgcccccttgttccagcagtggtatgcccagtgagaggcacaatttaaacggtttctttggtgatgatattagctactttcatcaaatacttagcctcttgtgctttagcacattatttatgtaagctcccctaggattctctgaagcaccctggtgtcctggctgtgaattcaagtcccatctttacttatttggtgtgggtcctccctctgagccggttttctcatctacaaaatgaagacaacagtacttccctcctgggatcattgaaagatttagggagcatatccttccacttcccaaacatatttgaacctctgacttgcttaggagcatcattcaaatcacagatcccccagtatctagtcccaacctattgaatcaggatccccagggaaggaggagcttgggaatctgatttttttttttttttttagataaagtctcactctgtcacccaggcttgagtgcagtggcaaaatcttggctcattgcaacctccacctcctgggttcaagcaattctcatgcctcagcttcccgacatagctgggattataggcgtgcaccaccatgcccagctaatttttcgttgttgttgttgttgttttgtttttgagacagagtctcgctctgttgcccaggctggagtacagtggcacgatcttggctcactgcaagctccgcttcccgggttcacgccattctcctgcctcagcctcccgagtagctgggaccacaggtgcccgccaccacgcccggctaatttttttggtatttttagtagagacggggttttaccatgttagccaggatggtctcgatctcctgacctcgtgatcctcccgcctcggcctcccaaagtgctggcattacaggcgtgagccatcattcctggctgggaatccgaatttttttttttttttagacggagtttcgctcttgttgcccaggctggagttcaatagcatgatctcggctcactgcaacctctgcctcccaggttcaagtgattctcctgcctctagctgggattgcaggcgcccacgaccacgcccagctaatttttgtattttgtagtagagacgggatttcgccatattggccaggccatagtggtcttggactcctgacctcaggtgatccgcccacctcggcctcccaaagtgttgggtttacaggcgtgagctaccataccctgcccaggaatctgaatttttagcaatcagttagcagcaaataagctgagatttcctgggtactaagcacatactatgagcattacagccgctttatataagctcgttcactgtcctcattacattcctaatatgcaagtgagcatgttttttaatcctcagtctagaggtgaggaaactgaggcaggcacagagaggctaagggatttgcctagtcgcacagctaggaaggtgcagcactgagactcgaatccacacagcttggcttaagtctaccattaaatttgcctgtcctggccaggtgcggtggctcacgcctgtaatcccaacacttcgtgaggccaaggcaggtggatcacttgaagtgaggagttcgagaccacaccagcctggccaacatggtgaaatcccgtctttactaaaaatacaaaaaattagctgggcgtggtggtgggtgccggtaatcctagctactcaggaggctgaggcaggagaatcacttgaacctgggaggtggaggttgcagtgaaccgagattgcgccactagactccagcctgggagacgagcaaaactgtctcaaaaaaataaaatgaaatacataaataaatgtgcctatcctgtgccgggtgctgttcttgccagtggggatacatgagagaacactgccttgcccgcatgaggcttgtggcctggtactgtgcacacctcaggggattctgataattagctgagcacagttgccagcacagggcctggctcaataaatattagctgctggcttctgctc

SEQ ID NO: 3184 - DNA, 800 bp, Homo sapiens
tttcgccaggttctctctccttgtccccttctttctgtcactttgtgcctcccccattagttactcccaggggcccctccctggatttacaccacgctcctaattcccagcccccatctgtgagtctgggcggcggagaggcccatggggtcctgatatccaagaaggggctctttctgcaggactctgctgggccgctcagccatgcctgagggagcccaaggactgagcctctccaaacctagcccaagcctcgggtgtggccgaagaggtgaagtgtgtgactgtggcaccgtgtgtgagactcggacagcagctcctgcagcccccaccatggcctccccccgaggttctgggagctccacatccctgagcacagtgggctctgagggggatccagcccctgggcccactccagcctgctcagcctccaggccagagccccttccagggcctcccatccgcctacatctctctccggtggggatcccaggttcagccagaccctcaaggctggagcgtgtggcccgggagatcgtggagacagaacgggcctatgtcagggacctccgcagcatcgtggaggactacctgggccctctgctggacggcggggtcctggggctgagcgtggagcaggtgggcacgctgtttgccaacattgaggacatctacgagttcagcagcgagctcctggaggacttggagaacagcagcagcgccgggggtattgccgagtgcttcgtgcagaggagcgaggattttgacatctacacattgtactgcatgaactacccgag

SEQ ID NO: 3185 - DNA, 3898 bp, Homo sapiens
gaagttcacgcccctgagtctgggctccgcacctccctggggaccgcgtcggggtcgcgcaggagccgggctgcctcgagccggggctggaggctccccgggaggactctgctgggccgctcagccatgcctgagggagcccaaggactgagcctctccaaacctagcccaagcctcgggtgtggccgaagaggtgaagtgtgtgactgtggcaccgtgtgtgagactcggacaggttcagccagaccctcaaggctggagcgtgtggcccgggagatcgtggagacagaacgggcctatgtcagggacctccgcagcatcgtggaggactacctgggccctctgctggacggcggggtcctggggctgagcgtggagcaggtgggcacgctgtttgccaacattgaggacatctacgagttcagcagcgagctcctggaggacttggagaacagcagcagcgccgggggtattgccgagtgcttcgtgcagaggagcgaggattttgacatctacacattgtactgcatgaactacccgagctccctggccctgctccgggagctgtcgttgtctccgccagcagccctgtggctgcaggagcgccaggcccagcttcgccactcgctgcccctgcagagcttcctgctgaaacctgtccagcgcattctcaagtaccatctgctgctgcaggaactagggaagcactgggcggagggcccaggcactgggggtcgcgagatggtggaggaagctattgtgtccatgacagcggttgcctggtacatcaacgacatgaagcgcaagcaggagcatgcagcgcgcctccaggaagtgcagcggcggctgggtggctggaccggaccagagctcagtgcttttggggaactggtgttggagggcgcgttccgaggaggcggagggggtggcccccggctacgagggggtgagcggctgctcttcctgttctctcggatgctgctggtggccaagcgcagggggctggagtacacctacaaaggccacatcttctgctgcaacctgagcgtgagcgagagtccccgagaccctctagggttcaaggtgtctgatctgaccattcccaagcacagacacctgctccaggccaagaaccaagaagagaagaggctgtggattcactgtctccagcgcctcttctttgagaaccaccctgcctccatccctgccaaggcaaagcaagttctccttgaaaacagcctgcattgtgcccccaaaagtaagcctgtcctagagcccctgacacccccacttgggtctcctcgacctcgagatgctagaagttttacccctgggcgaaggaacacagctccatctcctgggccctctgtgattcgccgaggccgcaggcagtctgagccggtgaaggacccttatgtcatgttcccacagaacgctaagcctggattcaagcacgctggcagcgaaggggaactctaccctccagaatctcagccaccagtttcaggctctgcaccccctgaggacctggaggatgctggacccccaacactggacccctctgggacctcaatcactgaagaaatcctggaactgctgaatcagcgaggccttcgagatccagggccgtccacccatgacattcccaagttccccggagactcccaggtgcctggcgacagcgaaaccctcacattccaagccctgcccagccgggactcttcagaagaggaggaggaggaagaggaagggctggagatggatgaacgggggccttccccactccacgtcctggaagggctcgaaagttccattgcagctgaaatgcccagcattccctgccttaccaaaattcctgacgtgcccaaccttcctgaaattcccagccgctgtgaaattcccgaaggttctcgccttcctagtctctctgacatttccgatgtttttgagatgccctgccttccagccatacctagtgtccccaacacccccagtctgtctagcactcccaccctctcctgtgactcctggctccaagggcctctgcaggaaccagctgaggctccagccaccaggagagaactgttttctgggagcaatcctgggaaactgggagagccgccttcaggaggcaaggcagggccagaggaggatgaagaaggggtatcattcacagacttccagccccaggatgtcacccaacatcagggattcccagatgagctggcattccgctcttgctcagaaatccggagcgcctggcaggcattggaacagggacagctggcccggccaggcttcccagagccactgctgatcctggaggattcggatctgggtggagacagcgggagcgggaaggcaggagccccgagttcagaaaggacggcgtcccgagtgcgagagctggcccggctttacagcgagcggatccagcagatgcagcgggcggagactcgggcatcagccaatgccccgcgccgccggcctcgggttctggcccaaccccagccatccccctgtctgccccaggagcaggcagagccagggctcctgcctgcctttggacacgtgctggtatgtgagctggccttcccactgacatgtgcccaggagtctgtccccctgggtcctgctgtctgggttcaagctgccatacctttgtcaaagcagggaggcagcccggatggccagggtctacatgtttccaatttgcctaagcaagaccttccgggcatccacgtttcagctgctacccttttgcctgagcaaggaggttcccggcatgtccaggctccagccgccacacctttgcccaagcaagaaggccccctgcacctccaggtgccggctcttacaactttctctgatcaaggccacccagaaatccaagttccagccaccactcctttgcctgagcatagaagtcacatggttataccagctccatccaccgccttttgtcctgagcagggacactgtgcggacatccacgttcccaccactccagctttgcccaaggagatttgttctgatttcacagtttcagtcaccacccctgtgcccaagcaagaaggtcacctagacagcgagagcccaaccaatatcccactgacaaagcaaggaggttccagggatgttcagggcccagaccctgtctgcagtcaacccatccagcctttgtcttggcatggaagcagcctggatccccagggcccaggcgacaccctaccacccttgccatgtcacctcccagaccttcagattccaggtacctcacctttgcctgcacatggaagccacctggaccatcggatcccagccaacgccccactgtctttgtcccaggagctcccagacactcaggttccagctaccacacctttgcccctgccacaagtcctcacagacatctgggtccaagccctcccaacttcacccaagcagggaagcctcccagacatccagggtccagcggctgcacctccacttccggagccaagccttacagatacacaggtccaaaaactcacaccttcgttggagcagaagagcctcatagatgcccatgttccagctgccacacctttacctgagagaggaggctctctagacattcagggcctctcacccaccccagttcagaccaccatggttttgtccaaaccaggaggctccttagcctctcacgttgccaggaatctatgggccttcacagggcccagggggctcctgatgcccccttccacatgtgagccaggacatgaggcttccctgaagcaaggatttcagccagatgccatagaccctcagaacttgacctggaagtccagacactgaacgcaggcctcaaaactgctgcggccttccaactcctggtatctgcatcggcgaatgg

SEQ ID NO: 3186 - DNA, 1540 bp, Homo sapiens
agcgcaccgggccgggggagcggccgcgctgggccgggcgggcgggtggcgggggtgcgctcggggacccgggccgcgtgggcgccgggatggagggcgccaaggggcggggagcgggcgtgcgtgtgtgtgcgagtgcgaatgcgagggaggccggccttgagtgaaaccggagctacaaagaaggggagagtccgggagcgggagggcgcgagggaggagcggcggcgccggggcagctccgacgccctcccgcggggaaggagcccccgcggtgccgccgaggccccgacgcggggccgcccctcggctcgccgccccgcgcccgcgcccgctgggaatgatgaagaagaacaattccgccaagcggggacctcaggatggaaaccagcagcctgcaccgcccgagaaggtcggctgggtccggaaattctgcgggaaagggattttcagggagatttggaaaaaccgctatgtggtgctgaaaggggaccagctctacatctctgagaaggaggtaaaagatgagaaaaatattcaagaggtatttgacctgagtgactatgagaagtgtgaagagctccggaagtccaagagcaggagcaagaaaaatcatagcaagtttactcttgcccactccaaacagcccggtaacacggcacccaacctgatcttcctggcagtgagtccagaagagaaggaatcgtggatcaatgccctcaactctgccatcacccgagccaagaaccgtatcttggatgaggcttccacctctacctcggatgggatgctgaccttggacttgatccaagaggaagacccttcccctgaggaaccaacctcttgtgctgagagctttcgggttgacctggacaagtctgtggcccagctggcagggagccggcggagagcggactcagaccgcatccagccctccgcagaccgggcaagcagtctctcccgaccttgggaaaaaacagacaaaggggccacctacaccccccaggcacccaagaagttgacgcccacagagaaaggccgctgcgcctccctggaggagatcctatctcagcgggatgctgcctctgcccgcaccctccagctgcgggctgaggaacccccaacccctgccctccccaacccggggcagctgtcccggatccaggacctggtagcaaggaaactggaggagactcaggagcttctggcagaggttcagggactgggagatgggaagcgaaaggccaaggacccccctcggtctccgccggattctgagtcagagcagctgctgctggagacggaacggctgctgggagaggcatcatcgaattggagccaggcaaagagggtgctgcaggaggtcagggagctgagagacctgtacagacagatggacctgcagaccccggactcccacctcagacagaccaccccgcacagtcagtaccggaagagcctgatgtgagggcagggtggggtctggaacttgtcgggttggacagactcttatctccgtgttgctggataaagctttttt

SEQ ID NO: 3187 - DNA, 2050 bp, Homo sapiens
ggggacccgggccgcgtgggcgccgggatggagggcgccaaggggcggggagcgggcgtgcgtgtgtgtgcgagtgcgaatgcgagggaggccggccttgagtgaaaccggagctacaaagaaggggagagtccgggagcgggagggcgcgagggaggagcggcggcgccggggcagctccgacgccctcccgcggggaaggagcccccgcggtgccgccgaggccccgacgcggggccgcccctcggctcgccgccccgcgcccgcgcccgctgggaatgatgaagaagaacaattccgccaagcggggacctcaggatggaaaccagcagcctgcaccgcccgagaaggtcggctgggtccggaaattctgcgggaaagggattttcagggagatttggaaaaaccgctatgtggtgctgaaaggggaccagctctacatctctgagaaggaggtaaaagatgagaaaaatattcaagaggtatttgacctgagtgactatgagaagtgtgaagagctccggaagtccaagagcaggagcaagaaaaatcatagcaagtttactcttgcccactccaaacagcccggtaacacggcacccaacctgatcttcctggcagtgagtccagaagagaaggaatcgtggatcaatgccctcaactctgccatcacccgagccaagaaccgtatcttggatgaggtcaccgttgaggaggacagctatcttgcccatcccactcgagacagggcaaaaatccagcactcccgccgccccccaacaaggggacacctaatggctgtggcttccacctctacctcggatgggatgctgaccttggacttgatccaagaggaagacccttcccctgaggaaccaacctcttgtgctgagagctttcgggttgacctggacaagtctgtggcccagctggcagggagccggcggagagcggactcagaccgcatccagccctccgcagaccgggcaagcagtctctcccgaccttgggaaaaaacagacaaaggggccacctacaccccccaggcacccaagaagttgacgcccacagagaaaggccgctgcgcctccctggaggagatcctatctcagcgggatgctgcctctgcccgcaccctccagctgcgggctgaggaacccccaacccctgccctccccaacccggggcagctgtcccggatccaggacctggtagcaaggaaactggaggagactcaggagcttctggcagaggttcagggactgggagatgggaagcgaaaggccaaggacccccctcggtctccgccggattctgagtcagagcagctgctgctggagacggaacggctgctgggagaggcatcatcgaattggagccaggcaaagagggtgctgcaggaggtcagggagctgagagacctgtacagacagatggacctgcagaccccggactcccacctcagacagaccaccccgcacagtcagtaccggaagagcctgatgtgagggcagggtggggtctggaacttgtcgggttggacagactcttatctccgtgttgctggataaagcttttttatttacctcaatcaaaaaaagaaaacaaaaatgaactcattgctcttgctgatgcctgaccccactacaacccttattgccccacctactttccatatgcccctcgtatgcccctcaggtttgaggaagtgaccccgcagcagtagcaggaagtttttacccagccagagagagagaaggcacggtaaagacacagtctgaccactccacacaccgcccgcccccaagacggcacagggagtccactgctgctcccaaggatacagtgggcttctaagcttagagcgggagggggatgaggatgttttctgttatgtcccaccccaggccttcagtttgagggtgaagtttcagctgcccaactctagttgtagggatgtggaggccagtgtcacctgtccgtgcacatggaagtgaaatttatcccagccctgaggaggatttgtggaattaaaatctccccagccaga

SEQ ID NO: 3188 - DNA, 1809 bp, Homo sapiens
aaggataatggtttggagacagagttctattcctgccagcattgacactgtgtctgaaaagccagcatcgacactgtgtctgcaaatccctcagctattctgagtctccgttttctccctgtgagatggagatcataaaatccgcctcatccttaggattattctcctgaagctacaataaggcctgaggcattgtacgctggaagaaacgtgtattaatagcaacttctgtcccaccccatcccccaacacgtcgatcccctccggagcataaaactttcccccagcatctgacctgcccaggccaccctagcacctaggagcgtgaattcctgatgcgggttgtgggtggcgcgccctcccggttcccgctctcgtttttgtttttggtcgggtaaggcgatgctgtagaggctggcgatctccagtcttcacgaatccgcacgtctctccattatccaccgcgcccgcccactgggccccggggcggccggcggccgggtctctcgggctccgcgtgtcgcccgagccgccgccggagcgagggtccctgccccctggggagcggtctccagccgcttcgaagccgccttcttccccctccggacctcaggatggaaaccagcagcctgcaccgcccgagaaggtcggctgggtccggaaattctgcgggaaagggattttcagggagatttggaaaaaccgctatgtggtgctgaaaggggaccagctctacatctctgagaaggaggtaaaagatgagaaaaatattcaagaggtatttgacctgagtgactatgagaagtgtgaagagctccggaagtccaagagcaggagcaagaaaaatcatagcaagtttactcttgcccactccaaacagcccggtaacacggcacccaacctgatcttcctggcagtgagtccagaagagaaggaatcgtggatcaatgccctcaactctgccatcacccgagccaagaaccgtatcttggatgaggcttccacctctacctcggatgggatgctgaccttggacttgatccaagaggaagacccttcccctgaggaaccaacctcttgtgctgagagctttcgggttgacctggacaagtctgtggcccagctggcagggagccggcggagagcggactcagaccgcatccagccctccgcagaccgggcaagcagtctctcccgaccttgggaaaaaacagacaaaggggccacctacaccccccaggcacccaagaagttgacgcccacagagaaaggccgctgcgcctccctggaggagatcctatctcagcgggatgctgcctctgcccgcaccctccagctgcgggctgaggaacccccaacccctgccctccccaacccggggcagctgtcccggatccaggacctggtagcaaggaaactggaggagactcaggagcttctggcagaggttcagggactgggagatgggaagcgaaaggccaaggacccccctcggtctccgccggattctgagtcagagcagctgctgctggagacggaacggctgctgggagaggcatcatcgaattggagccaggcaaagagggtgctgcaggaggtcagggagctgagagacctgtacagacagatggacctgcagaccccggactcccacctcagacagaccaccccgcacagtcagtaccggaagagcctgatgtgagggcagggtggggtctggaacttgtcgggttggacagactcttatctccgtgttgctggataaagcttttttatttacctcaatcaaaaaaagaaaacaaaaatgaa

SEQ ID NO: 3189 - DNA, 708 bp, Homo sapiens
ctggcagtgagtccagaagagaaggaatcgtggatcaatgccctcaactctgccatcacccgagccaagaaccgtatcttggatgagtacatctcttcaggtcaccgttgaggaggacagctatcttgcccatcccactcgagacagggcaaaaatccagcactcccgccgccccccaacaaggggacacctaatggctgtggcttccacctctacctcggatgggatgctgaccttggacttgatccaagaggaagacccttcccctgaggaaccaacctcttgtgctgagagctttcgggttgacctggacaagtctgtggcccagctggcagggagccggcggagagcggactcagaccgcatccagccctccgcagaccgggcaagcagtctctcccgaccttgggaaaaaacagacaaaggggccacctacaccccccaggcacccaagaagttgacgcccacagagaaaggccgctgcgcctccctggaggagatcctatctcagcgggatgctgcctctgcccgcaccctccagctgcgggctgaggaacccccaacccctgccctccccaacccggggcagctgtcccggatccaggacctggtagcaaggaaactggaggagactcaggagcttctggcagaggttcagggactgggagatgggaagcgaaaggccaaggacccccctcggtctccgcc

SEQ ID NO: 3190 - DNA, 896 bp, Homo sapiens
aggggagggccggccagggtaggaatgcgctgcgggcgggcggcgcaggaggcgagcggcggaacatccgggtgctgagggccgcggtgtgggtgcgcggagcagtcagggcgcaggtgggcagcgcgcacggcctgccagcccggggcgccagaatcctgcgctgcggggccgagaggggcgccgcgcccgccgcagcctggagctttccgcgaacctcggggcgcccatgacggcggcggcgacggctaccgtgctcaaggagggcgtgctggagaagcgcagcggcgggctgctgcagctgtggaagcggaagcgctgcgtcctcaccgaacgcgggctgcagctcttcgaggccaagggcacgggcggccggcccaaggagctcagcttcgcccgcatcaaggccgtggagtgcgtggagagcaccgggcgccacatctacttcacgctggtgaccgaagggggcggcgagatcgacttccgctgccccctggaagatcccggctggaacgcccagatcaccctaggcctggtcaagttcaagaaccagcaggccatccagacagtgcgggcccggcagagcctcgggaccgggaccctcgtgtcctaaaccaccgggcgcaccatctttccttcatgctacccaccacctcagtgctgaggtcaaggcagcttcgttgttccctctggcttgtgggggcacggctgtgctccatgtggcaaggtggaaggcatggacgtgtggaggaggcgctggagctgaaggaatggacgagccctgggaggagggcagaaggctacgcagggctgaggatgaagatgcagcccctggatggtcccagactctcaggacatgcccagctcaggggcttcgagccacaggcctggcctca

SEQ ID NO: 3191 - DNA, 1531 bp, Homo sapiens
gagcggcggaacatgtaagggcacatcccgcgagctgccgcccagcgcgcagacagagcccaggggagcaagagaacgggcgggcggtggggctcacggcctagggaggcgcggaggcatctggcagaggcgggtcgggctgggccagctggggtagagcggaggagcgggtgccggctgaagcggggcggtgggcgcggagcgcgctgggggcaccgacaccacctcaccggcagccgggtgctgagggccgcggtgtgggtgcgcggagcagtcagggcgcaggtgggcagcgcgcacggcctgccagcccggggcgccagaatcctgcgctgcggggccgagaggggcgccgcgcccgccgcagcctggagctttccgcgaacctcggggcgcccatgacggcggcggcgacggctaccgtgctcaaggagggcgtgctggagaagcgcagcggcgggctgctgcagctgtggaagcggaagcgctgcgtcctcaccgaacgcgggctgcagctcttcgaggccaagggcacgggcggccggcccaaggagctcagcttcgcccgcatcaaggccgtggagtgcgtggagagcaccgggcgccacatctacttcacgctggtgaccgaagggggcggcgagatcgacttccgctgccccctggaagatcccggctggaacgcccagatcaccctaggcctggtcaagttcaagaaccagcaggccatccagacagtgcgggcccggcagagcctcgggaccgggaccctcgtgtcctaaaccaccgggcgcaccatctttccttcatgctacccaccacctcagtgctgaggtcaaggcagcttcgttgttccctctggcttgtgggggcacggctgtgctccatgtggcaaggtggaaggcatggacgtgtggaggaggcgctggagctgaaggaatggacgagccctgggaggagggcagaaggctacgcagggctgaggatgaagatgcagcccctggatggtcccagactctcaggacatgcccagctcaggggcttcgagccacaggcctggcctcatatggcatgagggggagctggcataggagccccctccctgctgtggtcctgccctctgtcctgcagactgctcttagccccctggctttgtgccaggcctggaggagggcagtcccccatggggtgccgagccaacgcctcaggaatcaggaggccagcctggtaccaaaaggagtacccagggcctggtacccaggcccactccagaatggcctctggactcaccttgagaagggggagctgctgggcctaaagcccactcctgggggtctcctgctgcttaggtccttttgggacccccacccatccaggccctttctttgcacacttcttcccccacctctacgcatcttccccccactgcggtgttcggcctgaaggtggtgggggtgagggggggtttggccattagcatttcatgtctttccccaaatgaagatgccctgcaaagggcagtaaccacaca

SEQ ID NO: 3192 - DNA, 2764 bp, Homo sapiens
ggcaagacaacgaggatttgcgtagggggcgagcctctgaggccacttggctcttacggccacgcagggcgccgcagatgcagccggagcccgcttttccctctcaggacgacccctaggccgccagcagttccctaccgacgaaggcgactgtacagcgtccaccgcgttcgtgcccacttacccgccgccccactccgggccgccggctcgcagcaggaccagcccggctgctacggccgcggatacacgccctcaggcccggcgctgcgcagcttgcggaagctttcccggacagactcgctgccagcggattggctgcgagcagcgccaatctcacgttgcccccgggcgaggcgggactcagtgccgcgctctctgcacccgctctgccgcgcgcgtgcgtgctgggtgcgggtgcgggtgcggggttgggcctgcgcatcgggtgagacgctggctgcttgcggctagtggatggtaattgcctgcctcgcgctagcaggaagctgctctgttaaaagcgaaaatgaaacaattgcctgcggcaacagttcgactcctttcaagttctcagatcatcacttcggtggtcagtgttgtaaaagagcttattgaaaactccttggatgctggtgccacaagcgtagatgttaaactggagaactatggatttgataaaattgaggtgcgagataacggggagggtatcaaggctgttgatgcacctgtaatggcaatgaagtactacacctcaaaaataaatagtcatgaagatcttgaaaatttgacaacttacggttttcgtggagaagccttggggtcaatttgttgtatagctgaggttttaattacaacaagaacggctgctgataattttagcacccagtatgttttagatggcagtggccacatactttctcagaaaccttcacatcttggtcaaggtacaactgtaactgctttaagattatttaagaatctacctgtaagaaagcagttttactcaactgcaaaaaaatgtaaagatgaaataaaaaagatccaagatctcctcatgagctttggtatccttaaacctgacttaaggattgtctttgtacataacaaggcagttatttggcagaaaagcagagtatcagatcacaagatggctctcatgtcagttctggggactgctgttatgaacaatatggaatcctttcagtaccactctgaagaatctcagatttatctcagtggatttcttccaaagtgtgatgcagaccactctttcactagtctttcaacaccagaaagaagtttcatcttcataaacagtcgaccagtacatcaaaaagatatcttaaagttaatccgacatcattacaatctgaaatgcctaaaggaatctactcgtttgtatcctgttttctttctgaaaatcgatgttcctacagctgatgttgatgtaaatttaacaccagataaaagccaagtattattacaaaataaggaatctgttttaattgctcttgaaaatctgatgacgacttgttatggaccattacctagtacaaattcttatgaaaataataaaacagatgtttccgcagctgacatcgttcttagtaaaacagcagaaacagatgtgctttttaataaagtggaatcatctggaaagaattattcaaatgttgatacttcagtcattccattccaaaatgatatgcataatgatgaatctggaaaaaacactgatgattgtttaaatcaccagataagtattggtgactttggttatggtcattgtagtagtgaaatttctaacattgataaaaacactaagaatgcatttcaggacatttcaatgagtaatgtatcatgggagaactctcagacggaatatagtaaaacttgttttataagttccgttaagcacacccagtcagaaaatggcaataaagaccatatagatgagagtggggaaaatgaggaagaagcaggtcttgaaaactcttcggaaatttctgcagatgagtggagcaggggaaatatacttaaaaattcagtgggagagaatattgaacctgtgaaaattttagtgcctgaaaaaagtttaccatgtaaagtaagtaataataattatccaatccctgaacaaatgaatcttaatgaagattcatgtaacaaaaaatcaaatgtaatagataataaatctggaaaagttacagcttatgatttacttagcaatcgagtaatcaagaaacccatgtcagcaagtgctctttttgttcaagatcatcgtcctcagtttctcatagaaaatcctaagactagtttagaggatgcaacactacaaattgaagaactgtggaagacattgagtgaagaggaaaaactgaaatatgaagagaaggctactaaagacttggaacgatacaatagtcaaatgaagagagccattgaacaggagtcacaaatgtcactaaaagatggcagaaaaaagataaaacccaccagcgcatggaatttggcccagaagcacaagttaaaaacctcattatctaatcaaccaaaacttgatgaactccttcagtcccaaattgaaaaaagaaggagtcaaaatattaaaatggtacagatccccttttctatgaaaaacttaaaaataaattttaagaaacaaaacaaagttgacttagaagagaaggatgaaccttgcttgatccacaatctcaggtttcctgatgcatggctaatgacatccaaaacagagtctttt

SEQ ID NO: 3193 - DNA, 3012 bp, Homo sapiens
gtgctgggtgcgggtgcgggtgcggggttgggcctgcgcatcgggtgagacgctggctgcttgcggctagtggatggtaattgcctgcctcgcgctagcaggaagctgctctgttaaaagcgaaaatgaaacaattgcctgcggcaacagttcgactcctttcaagttctcagatcatcacttcggtggtcagtgttgtaaaagagcttattgaaaactccttggatgctggtgccacaagcgtagatgttaaactggagaactatggatttgataaaattgaggtgcgagataacggggagggtatcaaggctgttgatgcacctgtaatggcaatgaagtactacacctcaaaaataaatagtcatgaagatcttgaaaatttgacaacttacggttttcgtggagaagccttggggtcaatttgttgtatagctgaggtacaactgtaactgctttaagattatttaagaatctacctgtaagaaagcagttttactcaactgcaaaaaaatgtaaagatgaaataaaaaagatccaagatctcctcatgagctttggtatccttaaacctgacttaaggattgtctttgtacataacaaggcagttatttggcagaaaagcagagtatcagatcacaagatggctctcatgtcagttctggggactgctgttatgaacaatatggaatcctttcagtaccactctgaagaatctcagatttatctcagtggatttcttccaaagtgtgatgcagaccactctttcactagtctttcaacaccagaaagaagtttcatcttcataaacagtcgaccagtacatcaaaaagatatcttaaagttaatccgacatcattacaatctgaaatgcctaaaggaatctactcgtttgtatcctgttttctttctgaaaatcgatgttcctacagctgatgttgatgtaaatttaacaccagataaaagccaagtattattacaaaataaggaatctgttttaattgctcttgaaaatctgatgacgacttgttatggaccattacctagtacaaattcttatgaaaataataaaacagatgtttccgcagctgacatcgttcttagtaaaacagcagaaacagatgtgctttttaataaagtggaatcatctggaaagaattattcaaatgttgatacttcagtcattccattccaaaatgatatgcataatgatgaatctggaaaaaacactgatgattgtttaaatcaccagataagtattggtgactttggttatggtcattgtagtagtgaaatttctaacattgataaaaacactaagaatgcatttcaggacatttcaatgagtaatgtatcatgggagaactctcagacggaatatagtaaaacttgttttataagttccgttaagcacacccagtcagaaaatggcaataaagaccatatagatgagagtggggaaaatgaggaagaagcaggtcttgaaaactcttcggaaatttctgcagatgagtggagcaggggaaatatacttaaaaattcagtgggagagaatattgaacctgtgaaaattttagtgcctgaaaaaagtttaccatgtaaagtaagtaataataattatccaatccctgaacaaatgaatcttaatgaagattcatgtaacaaaaaatcaaatgtaatagataataaatctggaaaagttacagcttatgatttacttagcaatcgagtaatcaagaaacccatgtcagcaagtgctctttttgttcaagatcatcgtcctcagtttctcatagaaaatcctaagactagtttagaggatgcaacactacaaattgaagaactgtggaagacattgagtgaagaggaaaaactgaaatatgaagagaaggctactaaagacttggaacgatacaatagtcaaatgaagagagccattgaacaggagtcacaaatgtcactaaaagatggcagaaaaaagataaaacccaccagcgcatggaatttggcccagaagcacaagttaaaaacctcattatctaatcaaccaaaacttgatgaactccttcagtcccaaattgaaaaaagaaggagtcaaaatattaaaatggtacagatccccttttctatgaaaaacttaaaaataaattttaagaaacaaaacaaagttgacttagaagagaaggatgaaccttgcttgatccacaatctcaggtttcctgatgcatggctaatgacatccaaaacagaggtaatgttattaaatccatatagagtagaagaagccctgctatttaaaagacttcttgagaatcataaacttcctgcagagccactggaaaagccaattatgttaacagagagtctttttaatggatctcattatttagacgttttatataaaatgacagcagatgaccaaagatacagtggatcaacttacctgtctgatcctcgtcttacagcgaatggtttcaagataaaattgataccaggagtttcaattactgaaaattacttggaaatagaaggaatggctaattgtctcccattctatggagtagcagatttaaaagaaattcttaatgctatattaaacagaaatgcaaaggaagtttatgaatgtagacctcgcaaagtgataagttatttagagggagaagcagtgcgtctatccagacaattacccatgtacttatcaaaagaggacatccaagacattatctacagaatgaagcaccagtttggaaatgaaattaaagagtgtgttcatggtcgcccattttttcatcatttaacctatcttccagaaactacatgattaaatatgtttaagaagattagttaccattgaaattggttctgtcataaaacagcatgagtctggttttaaattatctttgtattatgtgtcacatggttattttttaaatgaggattcactgacttgtttttatattgaaaaaagttccacgtattgtagaaaacgtaaataaactaatatagactatt

SEQ ID NO: 3194 - DNA, 331 bp, Homo sapiens
gatctattttcatctgtcattattattgccatttgtcctgttggtcaggaatgcttaacaattcttacaagttgcatttttatcttctagctgctctgttaaaagcgaaaatgaaacaattgcctgcggcaacagttcgactcctttcaagttctcagatcatcacttcggtggtcagtgttgtaaaagagcttattgaaaactccttggatgctggtgccacaagcgtagatgttaaactggagaactatggatttgataaaattgaggtgcgagataacggggagggtatcaaggctgttgatgcacctgtaatggcaatgaagtacta

SEQ ID NO: 3195 - DNA, 831 bp, Homo sapiens
ggctgcttgcggctagtggatggtaattgcctgcctcgcgctagcaggaaggtagtgtggtgtgactaacgggtatttattatatcctcgatggctcgagggccccgtcccctctactcgtcctggtccgggcgcgaacgctatagggcagctaagggcgctccccgcggggcgggaagcgaagccgggcttgcgggcgcgcacacgtggaacgcgttttctgagcagctgctctgttaaaagcgaaaatgaaacaattgcctgcggcaacagttcgactcctttcaagttctcagatcatcacttcggtggtcagtgttgtaaaagagcttattgaaaactccttggatgctggtgccacaagcgtagatgttaaactggagaactatggatttgataaaattgaggtgcgagataacggggagggtatcaaggctgttgatgcacctgtaatggcaatgaagtactacacctcaaaaataaatagtcatgaagatcttgaaaatttgacaacttacggttttcgtggagaagccttggggtcaatttgttgtatagctgaggttttaattacaacaagaacggctgctgataattttagcacccagtatgttttagatggcagtggccacatactttctcagaaaccttcacatcttggtcaaggtacaactgtaactgctttaagattatttaagaatctacctgtaagaaagcagttttactcaactgcaaaaaaatgtaaagatgaaataaaaaagatccaagatctcctcatgagctttggtatccttaaacctgacttaaggattgtctttgtacataacaagg

SEQ ID NO: 3196 - DNA, 2659 bp, Homo sapiens
gtaattgcctgcctcgcgctagcaggaagctgctctgttaaaagcgaaaatgaaacaattgcctgcggcaacagttcgactcctttcaagttctcagatcatcacttcggtggtcagtgttgtaaaagagcttattgaaaactccttggatgctggtgccacaagcgtagatgttaaactggtacaactgtaactgctttaagattatttaagaatctacctgtaagaaagcagttttactcaactgcaaaaaaatgtaaagatgaaataaaaaagatccaagatctcctcatgagctttggtatccttaaacctgacttaaggattgtctttgtacataacaaggcagttatttggcagaaaagcagagtatcagatcacaagatggctctcatgtcagttctggggactgctgttatgaacaatatggaatcctttcagtaccactctgaagaatctcagatttatctcagtggatttcttccaaagtgtgatgcagaccactctttcactagtctttcaacaccagaaagaagtttcatcttcataaacagtcgaccagtacatcaaaaagatatcttaaagttaatccgacatcattacaatctgaaatgcctaaaggaatctactcgtttgtatcctgttttctttctgaaaatcgatgttcctacagctgatgttgatgtaaatttaacaccagataaaagccaagtattattacaaaataaggaatctgttttaattgctcttgaaaatctgatgacgacttgttatggaccattacctagtacaaattcttatgaaaataataaaacagatgtttccgcagctgacatcgttcttagtaaaacagcagaaacagatgtgctttttaataaagtggaatcatctggaaagaattattcaaatgttgatacttcagtcattccattccaaaatgatatgcataatgatgaatctggaaaaaacactgatgattgtttaaatcaccagataagtattggtgactttggttatggtcattgtagtagtgaaatttctaacattgataaaaacactaagaatgcatttcaggacatttcaatgagtaatgtatcatgggagaactctcagacggaatatagtaaaacttgttttataagttccgttaagcacacccagtcagaaaatggcaataaagaccatatagatgagagtggggaaaatgaggaagaagcaggtcttgaaaactcttcggaaatttctgcagatgagtggagcaggggaaatatacttaaaaattcagtgggagagaatattgaacctgtgaaaattttagtgcctgaaaaaagtttaccatgtaaagtaagtaataataattatccaatccctgaacaaatgaatcttaatgaagattcatgtaacaaaaaatcaaatgtaatagataataaatctggaaaagttacagcttatgatttacttagcaatcgagtaatcaagaaacccatgtcagcaagtgctctttttgttcaagatcatcgtcctcagtttctcatagaaaatcctaagactagtttagaggatgcaacactacaaattgaagaactgtggaagacattgagtgaagaggaaaaactgaaatatgaagagaaggctactaaagacttggaacgatacaatagtcaaatgaagagagccattgaacaggagtcacaaatgtcactaaaagatggcagaaaaaagataaaacccaccagcgcatggaatttggcccagaagcacaagttaaaaacctcattatctaatcaaccaaaacttgatgaactccttcagtcccaaattgaaaaaagaaggagtcaaaatattaaaatggtacagatccccttttctatgaaaaacttaaaaataaattttaagaaacaaaacaaagttgacttagaagagaaggatgaaccttgcttgatccacaatctcaggtttcctgatgcatggctaatgacatccaaaacagaggtaatgttattaaatccatatagagtagaagaagccctgctatttaaaagacttcttgagaatcataaacttcctgcagagccactggaaaagccaattatgttaacagagagtctttttaatggatctcattatttagacgttttatataaaatgacagcagatgaccaaagatacagtggatcaacttacctgtctgatcctcgtcttacagcgaatggtttcaagataaaattgataccaggagtttcaattactgaaaattacttggaaatagaaggaatggctaattgtctcccattctatggagtagcagatttaaaagaaattcttaatgctatattaaacagaaatgcaaaggaagtttatgaatgtagacctcgcaaagtgataagttatttagagggagaagcagtgcgtctatccagacaattacccatgtacttatcaaaagaggacatccaagacattatctacagaatgaagcaccagtttggaaatgaaattaaagagtgtgttcatggtcgcccattttttcatcatttaacctatcttccagaaactacatgattaaatatgtttaagaagattagttaccattgaaattggttctgtcataaaacagcatgagtctggttttaaattatctttgtattatgtgtcacat

SEQ ID NO: 3197 - DNA, 3225 bp, Homo sapiens
agactcgctgccagcggattggctgcgagcagcgccaatctcacgttgcccccgggcgaggcgggactcagtgccgcgctctctgcacccgctctgccgcgcgcgtgcgtgctgggtgcgggtgcgggtgcggggttgggcctgcgcatcgggtgagacgctggctgcttgcggctagtggatggtaattgcctgcctcgcgctagcaggaagctgctctgttaaaagcgaaaatgaaacaattgcctgcggcaacagttcgactcctttcaagttctcagatcatcacttcggtggtcagtgttgtaaaagagcttattgaaaactccttggatgctggtgccacaagcgtagatgttaaactggagaactatggatttgataaaattgaggtgcgagataacggggagggtatcaaggctgttgatgcacctgtaatggcaatgaagtactacacctcaaaaataaatagtcatgaagatcttgaaaatttgacaacttacggttttcgtggagaagccttggggtcaatttgttgtatagctgaggttttaattacaacaagaacggctgctgataattttagcacccagtatgttttagatggcagtggccacatactttctcagaaaccttcacatcttggtcaaggtacaactgtaactgctttaagattatttaagaatctacctgtaagaaagcagttttactcaactgcaaaaaaatgtaaagatgaaataaaaaagatccaagatctcctcatgagctttggtatccttaaacctgacttaaggattgtctttgtacataacaaggcagttatttggcagaaaagcagagtatcagatcacaagatggctctcatgtcagttctggggactgctgttatgaacaatatggaatcctttcagtaccactctgaagaatctcagatttatctcagtggatttcttccaaagtgtgatgcagaccactctttcactagtctttcaacaccagaaagaagtttcatcttcataaacagtcgaccagtacatcaaaaagatatcttaaagttaatccgacatcattacaatctgaaatgcctaaaggaatctactcgtttgtatcctgttttctttctgaaaatcgatgttcctacagctgatgttgatgtaaatttaacaccagataaaagccaagtattattacaaaataaggaatctgttttaattgctcttgaaaatctgatgacgacttgttatggaccattacctagtacaaattcttatgaaaataataaaacagatgtttccgcagctgacatcgttcttagtaaaacagcagaaacagatgtgctttttaataaagtggaatcatctggaaagaattattcaaatgttgatacttcagtcattccattccaaaatgatatgcataatgatgaatctggaaaaaacactgatgattgtttaaatcaccagataagtattggtgactttggttatggtcattgtagtagtgaaatttctaacattgataaaaacactaagaatgcatttcaggacatttcaatgagtaatgtatcatgggagaactctcagacggaatatagtaaaacttgttttataagttccgttaagcacacccagtcagaaaatggcaataaagaccatatagatgagagtggggaaaatgaggaagaagcaggtcttgaaaactcttcggaaatttctgcagatgagtggagcaggggaaatatacttaaaaattcagtgggagagaatattgaacctgtgaaaattttagtgcctgaaaaaagtttaccatgtaaagtaagtaataataattatccaatccctgaacaaatgaatcttaatgaagattcatgtaacaaaaaatcaaatgtaatagataataaatctggaaaagttacagcttatgatttacttagcaatcgagtaatcaagaaacccatgtcagcaagtgctctttttgttcaagatcatcgtcctcagtttctcatagaaaatcctaagactagtttagaggatgcaacactacaaattgaagaactgtggaagacattgagtgaagaggaaaaactgaaatatgaagagaaggctactaaagacttggaacgatacaatagtcaaatgaagagagccattgaacaggagtcacaaatgtcactaaaagatggcagaaaaaagataaaacccaccagcgcatggaatttggcccagaagcacaagttaaaaacctcattatctaatcaaccaaaacttgatgaactccttcagtcccaaattgaaaaaagaaggagtcaaaatattaaaatggtacagatccccttttctatgaaaaacttaaaaataaattttaagaaacaaaacaaagttgacttagaagagaaggatgaaccttgcttgatccacaatctcaggtttcctgatgcatggctaatgacatccaaaacagaggtaatgttattaaatccatatagagtagaagaagccctgctatttaaaagacttcttgagaatcataaacttcctgcagagccactggaaaagccaattatgttaacagagagtctttttaatggatctcattatttagacgttttatataaaatgacagcagatgaccaaagatacagtggatcaacttacctgtctgatcctcgtcttacagcgaatggtttcaagataaaattgataccaggagtttcaattactgaaaattacttggaaatagaaggaatggctaattgtctcccattctatggagtagcagatttaaaagaaattcttaatgctatattaaacagaaatgcaaaggaagtttatgaatgtagacctcgcaaagtgataagttatttagagggagaagcagtgcgtctatccagacaattacccatgtacttatcaaaagaggacatccaagacattatctacagaatgaagcaccagtttggaaatgaaattaaagagtgtgttcatggtcgcccattttttcatcatttaacctatcttccagaaactacatgattaaatatgtttaagaagattagttaccattgaaattggttctgtcataaaacagcatgagtctggttttaaattatctttgtattatgtgtcacatggttattttttaaatgaggattcactgacttgtttttatattgaaaaaagttccacgtattgtagaaaacgtaaataaactaatatagactattca

SEQ ID NO: 3198 - DNA, 560 bp, Homo sapiens
gtgctgggtgcgggtgcgggtgcggggttgggcctgcgcatcgggtgagacgctggctgcttgcggctagtggatggtaattgcctgcctcgcgctagcaggaaggtagtgtggtgtgactaacgggtatttattatatcctcgatggctcgagggccccgtcccctctactcgtcctggtccgggcgcgaacgctatagggcagctaagggcgctccccgcggggcgggaagcgaagccgggcttgcgggcgcgcacacgtggaacgcgttttctgagcaggcacacctgttgtccttaactgactttccgggtcatcagcacttcttcagaagtgttccttttccctcccagcaaatatggaagactgactatcctgatattcccagacattctttgctgtgatttctgctctgttaaaagcgaaaatgaaacaattgcctgcggcaacagttcgactcctttcaagttctcagatcatcacttcggtggtcagtgttgtaaaagagcttattgaaaactccttggatgctggtgccacaagcgtagatgttaaactg

SEQ ID NO: 3199 - DNA, 2576 bp, Homo sapiens
gctgcttgcggctagtggatggtaattgcctgcctcgcgctagcaggaagctgctctgttaaaagcgaaaatgaaacaattgcctgcggcaacagttcgactcctttcaagttctcagatcatcacttcggtggtcagtgttgtaaaagagcttattgaaaactccttggatgctggtgccacaagcgtagatgttaaactggagaactatggatttgataaaattgaggtgcgagataacggggagggtatcaaggctgttgatgcacctgtaatggcaatgaagtactacacctcaaaaataaatagtcatgaagatcttgaaaatttgacaacttacggttttcgtggagaagccttggggtcaatttgttgtatagctgaggttttaattacaacaagaacggctgctgataattttagcacccagtatgttttagatggcagtggccacatactttctcagaaaccttcacatcttggtcaaggtacaactgtaactgctttaagattatttaagaatctacctgtaagaaagcagttttactcaactgcaaaaaaatgtaaagatgaaataaaaaagatccaagatctcctcatgagctttggtatccttaaacctgacttaaggattgtctttgtacataacaaggcagttatttggcagaaaagcagagtatcagatcacaagatggctctcatgtcagttctggggactgctgttatgaacaatatggaatcctttcagtaccactctgaagaatctcagatttatctcagtggatttcttccaaagtgtgatgcagaccactctttcactagtctttcaacaccagaaagaagtttcatcttcataaacagtcgaccagtacatcaaaaagatatcttaaagttaatccgacatcattacaatctgaaatgcctaaaggaatctactcgtttgtatcctgttttctttctgaaaatcgatgttcctacagctgatgttgatgtaaatttaacaccagataaaagccaagtattattacaaaataaggaatctgttttaattgctcttgaaaatctgatgacgacttgttatggaccattacctagtacaaattcttatgaaaataataaaacagatgtttccgcagctgacatcgttcttagtaaaacagcagaaacagatgtgctttttaataaagtggaatcatctggaaagaattattcaaatgttgatacttcagtcattccattccaaaatgatatgcataatgatgaatctggaaaaaacactgatgattgtttaaatcaccagataagtattggtgactttggttatggtcattgtagtagtgaaatttctaacattgataaaaacactaagaatgcatttcaggacatttcaatgagtaatgtatcatgggagaactctcagacggaatatagtaaaacttgttttataagttccgttaagcacacccagtcagaaaatggcaataaagaccatatagatgagagtggggaaaatgaggaagaagcaggtcttgaaaactcttcggaaatttctgcagatgagtggagcaggggaaatatacttaaaaattcagtgggagagaatattgaacctgtgaaaattttagtgcctgaaaaaagtttaccatgtaaagtaagtaataataattatccaatccctgaacaaatgaatcttaatgaagattcatgtaacaaaaaatcaaatgtaatagataataaatctggaaaagttacagcttatgatttacttagcaatcgagtaatcaagaaacccatgtcagcaagtgctctttttgttcaagatcatcgtcctcagtttctcatagaaaatcctaagactagtttagaggatgcaacactacaaattgaagaactgtggaagacattgagtgaagaggaaaaactgaatctttttaatggatctcattatttagacgttttatataaaatgacagcagatgaccaaagatacagtggatcaacttacctgtctgatcctcgtcttacagcgaatggtttcaagataaaattgataccaggagtttcaattactgaaaattacttggaaatagaaggaatggctaattgtctcccattctatggagtagcagatttaaaagaaattcttaatgctatattaaacagaaatgcaaaggaagtttatgaatgtagacctcgcaaagtgataagttatttagagggagaagcagtgcgtctatccagacaattacccatgtacttatcaaaagaggacatccaagacattatctacagaatgaagcaccagtttggaaatgaaattaaagagtgtgttcatggtcgcccattttttcatcatttaacctatcttccagaaactacatgattaaatatgtttaagaagattagttaccattgaaattggttctgtcataaaacagcatgagtctggttttaaattatctttgtattatgtgtcacatggttattttttaaatgaggattcactgacttgtttttatattgaaaaaagttccacgtattgtagaaaacgtaaataaactaatatagactattca

SEQ ID NO: 3200 - DNA, 2795 bp, Homo sapiens
ggtgcgggtgcggggttgggcctgcgcatcgggtgagacgctggctgcttgcggctagtggatggtaattgcctgcctcgcgctagcaggaagctgctctgttaaaagcgaaaatgaaacaattgcctgcggcaacagttcgactcctttcaagttctcagatcatcacttcggtggtcagtgttgtaaaagagcttattgaaaactccttggatgctggtgccacaagcgtagatgttaaactggagaactatggatttgataaaattgaggtgcgagataacggggagggtatcaaggctgttgatgcacctgtaatggcaatgaagtactacacctcaaaaataaatagtcatgaagatcttgaaaatttgacaacttacggttttcgtggagaagccttggggtcaatttgttgtatagctgaggttttaattacaacaagaacggctgctgataattttagcacccagtatgttttagatggcagtggccacatactttctcagaaaccttcacatcttggtcaaggtacaactgtaactgctttaagattatttaagaatctacctgtaagaaagcagttttactcaactgcaaaaaaatgtaaagatgaaataaaaaagatccaagatctcctcatgagctttggtatccttaaacctgacttaaggattgtctttgtacataacaagatttatctcagtggatttcttccaaagtgtgatgcagaccactctttcactagtctttcaacaccagaaagaagtttcatcttcataaacagtcgaccagtacatcaaaaagatatcttaaagttaatccgacatcattacaatctgaaatgcctaaaggaatctactcgtttgtatcctgttttctttctgaaaatcgatgttcctacagctgatgttgatgtaaatttaacaccagataaaagccaagtattattacaaaataaggaatctgttttaattgctcttgaaaatctgatgacgacttgttatggaccattacctagtacaaattcttatgaaaataataaaacagatgtttccgcagctgacatcgttcttagtaaaacagcagaaacagatgtgctttttaataaagtggaatcatctggaaagaattattcaaatgttgatacttcagtcattccattccaaaatgatatgcataatgatgaatctggaaaaaacactgatgattgtttaaatcaccagataagtattggtgactttggttatggtcattgtagtagtgaaatttctaacattgataaaaacactaagaatgcatttcaggacatttcaatgagtaatgtatcatgggagaactctcagacggaatatagtaaaacttgttttataagttccgttaagcacacccagtcagaaaatggcaataaagaccatatagatgagagtggggaaaatgaggaagaagcaggtcttgaaaactcttcggaaatttctgcagatgagtggagcaggggaaatatacttaaaaattcagtgggagagaatattgaacctgtgaaaattttagtgcctgaaaaaagtttaccatgtaaagtaagtaataataattatccaatccctgaacaaatgaatcttaatgaagattcatgtaacaaaaaatcaaatgtaatagataataaatctggaaaagttacagcttatgatttacttagcaatcgagtaatcaagaaacccatgtcagcaagtgctctttttgttcaagatcatcgtcctcagtttctcatagaaaatcctaagactagtttagaggatgcaacactacaaattgaagaactgtggaagacattgagtgaagaggaaaaactgaaatatgaagagaaggctactaaagacttggaacgatacaatagtcaaatgaagagagccattgaacaggagtcacaaatgtcactaaaagatggcagaaaaaagataaaacccaccagcgcatggaatttggcccagaagcacaagttaaaaacctcattatctaatcaaccaaaacttgatgaactccttcagtcccaaattgaaaaaagaaggagtcaaaatattaaaatggtacagatccccttttctatgaaaaacttaaaaataaattttaagaaacaaaacaaagttgacttagaagagaaggatgaaccttgcttgatccacaatctcaggtttcctgatgcatggctaatgacatccaaaacagaggtaatgttattaaatccatatagagtagaagaagccctgctatttaaaagacttcttgagaatcataaacttcctgcagagccactggaaaagccaattatgttaacagagagtctttttaatggatctcattatttagacgttttatataaaatgacagcagatgaccaaagatacagtggatcaacttacctgtctgatcctcgtcttacagcgaatggtttcaagataaaattgataccaggagtttcaattactgaaaattacttggaaatagaaggaatggctaattgtctcccattctatggagtagcagatttaaaagaaattcttaatgctatattaaacagaaatgcaaaggaagtttatgaatgtagacctcgcaaagtgataagttatttagagggagaagcagtgcgtctatccagacaattacccatgtacttatcaaaagaggacatccaagacattatctacagaatgaagcaccagtttggaaatgaaattaaagagtgtgttcatggtcgcccattttttcatcatttaacctatcttccagaaactacatga

SEQ ID NO: 3201 - DNA, 2855 bp, Homo sapiens
ggagcacaacgtcgaaagcagccaatgggagttcaggaggcggagcgcctgtgggagccctggagggaactttcccagtccccgaggcggatcgggtgttgcatccatggagcgagctgagagctcgagtacagaacctgctaaggccatcaaacctattgatcggaagtcagtccatcagatttgctctgggcaggtggtactgagtctaagcactgcggtaaaggagttagtagaaaacagtctggatgctggtgccactaatattgatctaaagcttaaggactatggagtggatcttattgaagtttcagacaatggatgtggggtagaagaagaaaacttcgaaggcttaactctgaaacatcacacatctaagattcaagagtttgccgacctaactcaggttgaaacttttggctttcggggggaagctctgagctcactttgtgcactgagcgatgtcaccatttctacctgccacgcatcggcgaaggttggaactcgactgatgtttgatcacaatgggaaaattatccagaaaaccccctacccccgccccagagggaccacagtcagcgtgcagcagttattttccacactacctgtgcgccataaggaatttcaaaggaatattaagaaggagtatgccaaaatggtccaggtcttacatgcatactgtatcatttcagcaggcatccgtgtaagttgcaccaatcagcttggacaaggaaaacgacagcctgtggtatgcacaggtggaagccccagcataaaggaaaatatcggctctgtgtttgggcagaagcagttgcaaagcctcattccttttgttcagctgccccctagtgactccgtgtgtgaagagtacggtttgagctgttccgatgctctgcataatcttttttacatctcaggtttcatttcacaatgcacgcatggagttggaaggagttcaacagacagacagtttttctttatcaaccggcggccttgtgacccagcaaaggtctgcagactcgtgaatgaggtctaccacatgtataatcgacaccagtatccatttgttgttcttaacatttctgttgattcagaatgcgttgatatcaatgttactccagataaaaggcaaattttgctacaagaggaaaagcttttgttggcagttttaaagacctctttgataggaatgtttgatagtgatgtcaacaagctaaatgtcagtcagcagccactgctggatgttgaaggtaacttaataaaaatgcatgcagcggatttggaaaagcccatggtagaaaagcaggatcaatccccttcattaaggactggagaagaaaaaaaagacgtgtccatttccagactgcgagaggccttttctcttcgtcacacaacagagaacaagcctcacagcccaaagactccagaaccaagaaggagccctctaggacagaaaaggggtatgctgtcttctagcacttcaggtgccatctctgacaaaggcgtcctgagacctcagaaagaggcagtgagttccagtcacggacccagtgaccctacggacagagcggaggtggagaaggactcggggcacggcagcacttccgtggattctgaggggttcagcatcccagacacgggcagtcactgcagcagcgagtatgcggccagctccccaggggacaggggctcgcaggaacatgtggactctcaggagaaagcgcctaaaactgacgactctttttcagatgtggactgccattcaaaccaggaagataccggatgtaaatttcgagttttgcctcagccaactaatctcgcaaccccaaacacaaagcgttttaaaaaagaagaaattctttccagttctgacatttgtcaaaagttagtaaatactcaggacatgtcagcctctcaggttgatgtagctgtgaaaattaataagaaagttgtgcccctggacttttctatgagttctttagctaaacgaataaagcagttacatcatgaagcacagcaaagtgaaggggaacagaattacaggaagtttagggcaaagatttgtcctggagaaaatcaagcagccgaagatgaactaagaaaagagataagtaaaacgatgtttgcagaaatggaaatcattggtcagtttaacctgggatttataataaccaaactgaatgaggatatcttcatagtggaccagcatgccacggacgagaagtataacttcgagatgctgcagcagcacaccgtgctccaggggcagaggctcatagcacctcagactctcaacttaactgctgttaatgaagctgttctgatagaaaatctggaaatatttagaaagaatggctttgattttgttatcgatgaaaatgctccagtcactgaaagggctaaactgatttccttgccaactagtaaaaactggaccttcggaccccaggacgtcgatgaactgatcttcatgctgagcgacagccctggggtcatgtgccggccttcccgagtcaagcagatgtttgcctccagagcctgccggaagtcggtgatgattgggactgctcttaacacaagcgagatgaagaaactgatcacccacatgggggagatggaccacccctggaactgtccccatggaaggccaaccatgagacacatcgccaacctgggtgtcatttctcagaactgaccgtagtcactgtatggaataattggttttatcgcagatttttatgttttgaaagacagagtcttcactaaccttttttgttttaaaatgaacctgctacttaaaaaaaatacacatcacacccatttaaaagtgatcttgagaaccttttcaaaccaga

SEQ ID NO: 3202 - DNA, 1386 bp, Homo sapiens
atggagcgagctgagagctcgagtacagaacctgctaaggccatcaaacctattgatcggaagtcagtccatcagatttgctctgggcaggtggtactgagtctaagcactgcggtaaaggagttagtagaaaacagtctggatgctggtgccactaatattgatctaaagcttaaggactatggagtggatcttattgaagtttcagacaatggatgtggggtagaagaagaaaacttcgaaggcttaactctgaaacatcacacatctaagattcaagagtttgccgacctaactcaggttgaaacttttggctttcggggggaagctctgagctcactttgtgcactgagcgatgtcaccatttctacctgccacgcatcggcgaaggttggaactcgactgatgtttgatcacaatgggaaaattatccagaaaaccccctacccccgccccagagggaccacagtcagcgtgcagcagttattttccacactacctgtgcgccataaggaatttcaaaggaatattaagaaggagtatgccaaaatggtccaggtcttacatgcatactgtatcatttcagcaggcatccgtgtaagttgcaccaatcagcttggacaaggaaaacgacagcctgtggtatgcacaggtggaagccccagcataaaggaaaatatcggctctgtgtttgggcagaagcagttgcaaagcctcattccttttgttcagctgccccctagtgactccgtgtgtgaagagtacggtttgagctgttccgatgctctgcataatcttttttataaaacgatgtttgcagaaatggaaatcattggtcagtttaacctgggatttataataaccaaactgaatgaggatatcttcatagtggaccagcatgccacggacgagaagtataacttcgagatgctgcagcagcacaccgtgctccaggggcagaggctcatagcacctcagactctcaacttaactgctgttaatgaagctgttctgatagaaaatctggaaatatttagaaagaatggctttgattttgttatcgatgaaaatgctccagtcactgaaagggctaaactgatttccttgccaactagtaaaaactggaccttcggaccccaggacgtcgatgaactgatcttcatgctgagcgacagccctggggtcatgtgccggccttcccgagtcaagcagatgtttgcctccagagcctgccggaagtcggtgatgattgggactgctcttaacacaagcgagatgaagaaactgatcacccacatgggggagatggaccacccctggaactgtccccatggaaggccaaccatgagacacatcgccaacctgggtgtcatttctcagaactga

SEQ ID NO: 3203 - DNA, 2678 bp, Homo sapiens
gagttcaggaggcggagcgcctgtgggagccctggagggaactttcccagtccccgaggcggatcgggtgttgcatccatggagcgagctgagagctcgagatctaagcttaaggactatggagtggatcttattgaagtttcagacaatggatgtggggtagaagaagaaaacttcgaaggcttaactctgaaacatcacacatctaagattcaagagtttgccgacctaactcaggttgaaacttttggctttcggggggaagctctgagctcactttgtgcactgagcgatgtcaccatttctacctgccacgcatcggcgaaggttggaactcgactgatgtttgatcacaatgggaaaattatccagaaaaccccctacccccgccccagagggaccacagtcagcgtgcagcagttattttccacactacctgtgcgccataaggaatttcaaaggaatattaagaaggagtatgccaaaatggtccaggtcttacatgcatactgtatcatttcagcaggcatccgtgtaagttgcaccaatcagcttggacaaggaaaacgacagcctgtggtatgcacaggtggaagccccagcataaaggaaaatatcggctctgtgtttgggcagaagcagttgcaaagcctcattccttttgttcagctgccccctagtgactccgtgtgtgaagagtacggtttgagctgttccgatgctctgcataatcttttttacatctcaggtttcatttcacaatgcacgcatggagttggaaggagttcaacagacagacagtttttctttatcaaccggcggccttgtgacccagcaaaggtctgcagactcgtgaatgaggtctaccacatgtataatcgacaccagtatccatttgttgttcttaacatttctgttgattcagaatgcgttgatatcaatgttactccagataaaaggcaaattttgctacaagaggaaaagcttttgttggcagttttaaagacctctttgataggaatgtttgatagtgatgtcaacaagctaaatgtcagtcagcagccactgctggatgttgaaggtaacttaataaaaatgcatgcagcggatttggaaaagcccatggtagaaaagcaggatcaatccccttcattaaggactggagaagaaaaaaaagacgtgtccatttccagactgcgagaggccttttctcttcgtcacacaacagagaacaagcctcacagcccaaagactccagaaccaagaaggagccctctaggacagaaaaggggtatgctgtcttctagcacttcaggtgccatctctgacaaaggcgtcctgagacctcagaaagaggcagtgagttccagtcacggacccagtgaccctacggacagagcggaggtggagaaggactcggggcacggcagcacttccgtggattctgaggggttcagcatcccagacacgggcagtcactgcagcagcgagtatgcggccagctccccaggggacaggggctcgcaggaacatgtggactctcaggagaaagcgcctaaaactgacgactctttttcagatgtggactgccattcaaaccaggaagataccggatgtaaatttcgagttttgcctcagccaactaatctcgcaaccccaaacacaaagcgttttaaaaaagaagaaattctttccagttctgacatttgtcaaaagttagtaaatactcaggacatgtcagcctctcaggttgatgtagctgtgaaaattaataagaaagttgtgcccctggacttttctatgagttctttagctaaacgaataaagcagttacatcatgaagcacagcaaagtgaaggggaacagaattacaggaagtttagggcaaagatttgtcctggagaaaatcaagcagccgaagatgaactaagaaaagagataagtaaaacgatgtttgcagaaatggaaatcattggtcagtttaacctgggatttataataaccaaactgaatgaggatatcttcatagtggaccagcatgccacggacgagaagtataacttcgagatgctgcagcagcacaccgtgctccaggggcagaggctcatagcacctcagactctcaacttaactgctgttaatgaagctgttctgatagaaaatctggaaatatttagaaagaatggctttgattttgttatcgatgaaaatgctccagtcactgaaagggctaaactgatttccttgccaactagtaaaaactggaccttcggaccccaggacgtcgatgaactgatcttcatgctgagcgacagccctggggtcatgtgccggccttcccgagtcaagcagatgtttgcctccagagcctgccggaagtcggtgatgattgggactgctcttaacacaagcgagatgaagaaactgatcacccacatgggggagatggaccacccctggaactgtccccatggaaggccaaccatgagacacatcgccaacctgggtgtcatttctcagaactgaccgtagtcactgtatggaataattggttttatcgcagatttttatgttttgaaagacagagtcttcactaaccttttttgttttaaaatgaacctgctacttaaaaaaaatacacatcacacccatttaaaagtgatcttgagaaccttttc

SEQ ID NO: 3204 - DNA, 1719 bp, Homo sapiens
atggagcgagctgagagctcgagtacagaacctgctaaggccatcaaacctattgatcggaagtcagtccatcagatttgctctgggcaggtggtactgagtctaagcactgcggtaaaggagttagtagaaaacagtctggatgctggtgccactaatattgatctaaagcttaaggactatggagtggatcttattgaagtttcagacaatggatgtggggtagaagaagaaaacttcgaaggcttaactctgaaacatcacacatctaagattcaagagtttgccgacctaactcaggttgaaacttttggctttcggggggaagctctgagctcactttgtgcactgagcgatgtcaccatttctacctgccacgcatcggcgaaggttggaactcgactgatgtttgatcacaatgggaaaattatccagaaaaccccctacccccgccccagagggaccacagtcagcgtgcagcagttattttccacactacctgtgcgccataaggaatttcaaaggaatattaagaaggagtatgccaaaatggtccaggtcttacatgcatactgtatcatttcagcaggcatccgtgtaagttgcaccaatcagcttggacaaggaaaacgacagcctgtggtatgcacaggtggaagccccagcataaaggaaaatatcggctctgtgtttgggcagaagcagttgcaaagcctcattccttttgttcagctgccccctagtgactccgtgtgtgaagagtacggtttgagctgttccgatgctctgcataatcttttttacatctcaggtttcatttcacaatgcacgcatggagttggaaggagttcaacagacagacagtttttctttatcaaccggcggccttgtgacccagcaaaggtctgcagactcgtgaatgaggtctaccacatgtataatcgacaccagtatccatttgttgttcttaacatttctgttgattcagaatgcgttgatatcaatgttactccagataaaaggcaaattttgctacaagaggaaaagcttttgttggcagttttaaagacctctttgataggaatgtttgatagtgatgtcaacaagctaaatgtcagtcagcagccactgctggatgttgaaggtaacttaataaaaatgcatgcagcggatttggaaaagcccatggtagaaaagcaggatcaatccccttcattaaggactggagaagaaaaaaaagacgtgtccatttccagactgcgagaggccttttctcttcgtcacacaacagagaacaagcctcacagcccaaagactccagaaccaagaaggagccctctaggacagaaaaggggtatgctgtcttctagcacttcaggtgccatctctgacaaaggcgtcctgagacctcagaaagaggcagtgagttccagtcacggacccagtgaccctacggacagagcggaggtggagaaggactcggggcacggcagcacttccgtggattctgaggggttcagcatcccagacacgggcagtcactgcagcagcgagtatgcggccagctccccaggggacaggggctcgcaggaacatgtggactctcaggagaaagcgcctaaaactgacgactctttttcagatgtggactgccattcaaaccaggaagataccggattaaaaactggaccttcggaccccaggacgtcgatgaactga

SEQ ID NO: 3205 - DNA, 2271 bp, Homo sapiens
atgtggggtagaagaagaaaacttcgaaggcttaacgatgtcaccatttctacctgccacgcatcggcgaaggttggaactcgactgatgtttgatcacaatgggaaaattatccagaaaaccccctacccccgccccagagggaccacagtcagcgtgcagcagttattttccacactacctgtgcgccataaggaatttcaaaggaatattaagaaggagtatgccaaaatggtccaggtcttacatgcatactgtatcatttcagcaggcatccgtgtaagttgcaccaatcagcttggacaaggaaaacgacagcctgtggtatgcacaggtggaagccccagcataaaggaaaatatcggctctgtgtttgggcagaagcagttgcaaagcctcattccttttgttcagctgccccctagtgactccgtgtgtgaagagtacggtttgagctgttccgatgctctgcataatcttttttacatctcaggtttcatttcacaatgcacgcatggagttggaaggagttcaacagacagacagtttttctttatcaaccggcggccttgtgacccagcaaaggtctgcagactcgtgaatgaggtctaccacatgtataatcgacaccagtatccatttgttgttcttaacatttctgttgattcagaatgcgttgatatcaatgttactccagataaaaggcaaattttgctacaagaggaaaagcttttgttggcagttttaaagacctctttgataggaatgtttgatagtgatgtcaacaagctaaatgtcagtcagcagccactgctggatgttgaaggtaacttaataaaaatgcatgcagcggatttggaaaagcccatggtagaaaagcaggatcaatccccttcattaaggactggagaagaaaaaaaagacgtgtccatttccagactgcgagaggccttttctcttcgtcacacaacagagaacaagcctcacagcccaaagactccagaaccaagaaggagccctctaggacagaaaaggggtatgctgtcttctagcacttcaggtgccatctctgacaaaggcgtcctgagacctcagaaagaggcagtgagttccagtcacggacccagtgaccctacggacagagcggaggtggagaaggactcggggcacggcagcacttccgtggattctgaggggttcagcatcccagacacgggcagtcactgcagcagcgagtatgcggccagctccccaggggacaggggctcgcaggaacatgtggactctcaggagaaagcgcctaaaactgacgactctttttcagatgtggactgccattcaaaccaggaagataccggatgtaaatttcgagttttgcctcagccaactaatctcgcaaccccaaacacaaagcgttttaaaaaagaagaaattctttccagttctgacatttgtcaaaagttagtaaatactcaggacatgtcagcctctcaggttgatgtagctgtgaaaattaataagaaagttgtgcccctggacttttctatgagttctttagctaaacgaataaagcagttacatcatgaagcacagcaaagtgaaggggaacagaattacaggaagtttagggcaaagatttgtcctggagaaaatcaagcagccgaagatgaactaagaaaagagataagtaaaacgatgtttgcagaaatggaaatcattggtcagtttaacctgggatttataataaccaaactgaatgaggatatcttcatagtggaccagcatgccacggacgagaagtataacttcgagatgctgcagcagcacaccgtgctccaggggcagaggctcatagcacctcagactctcaacttaactgctgttaatgaagctgttctgatagaaaatctggaaatatttagaaagaatggctttgattttgttatcgatgaaaatgctccagtcactgaaagggctaaactgatttccttgccaactagtaaaaactggaccttcggaccccaggacgtcgatgaactgatcttcatgctgagcgacagccctggggtcatgtgccggccttcccgagtcaagcagatgtttgcctccagagcctgccggaagtcggtgatgattgggactgctcttaacacaagcgagatgaagaaactgatcacccacatgggggagatggaccacccctggaactgtccccatggaaggccaaccatgagacacatcgccaacctgggtgtcatttctcagaactga

SEQ ID NO: 3206 - DNA, 2227 bp, Homo sapiens
agtggcgcgcaggcttttgtaacgttcccagcgccgcgtttgaattcggggaggagcggagcggtgcggaggctctgctcggatcgaggtctgcagcgcagcttcgggagcatgagtgctgcagtgactgcagggaagctggcacgggcaccggccgaccctgggaaagccggggtccccggagttgcagctcccggagctccggcggcggctccaccggcgaaagagatcccggaggtcctagtggacccacgcagccggcggcgctatgtgcggggccgctttttgggcaagggcggctttgccaagtgcttcgagatctcggacgcggacaccaaggaggtgttcgcgggcaagattgtgcctaagtctctgctgctcaagccgcaccagagggagaagatgtccatggaaatatccattcaccgcagcctcgcccaccagcacgtcgtaggattccacggctttttcgaggacaacgacttcgtgttcgtggtgttggagctctgccgccggaggtctctcctggagctgcacaagaggaggaaagccctgactgagcctgaggcccgatactacctacggcaaattgtgcttggctgccagtacctgcaccgaaaccgagttattcatcgagacctcaagctgggcaaccttttcctgaatgaagatctggaggtgaaaataggggattttggactggcaaccaaagtcgaatatgacggggagaggaagaagaccctgtgtgggactcctaattacatagctcccgaggtgctgagcaagaaagggcacagtttcgaggtggatgtgtggtccattgggtgtatcatgtataccttgttagtgggcaaaccaccttttgagacttcttgcctaaaagagacctacctccggatcaagaagaatgaatacagtattcccaagcacatcaaccccgtggccgcctccctcatccagaagatgcttcagacagatcccactgcccgcccaaccattaacgagctgcttaatgacgagttctttacttctggctatatccctgcccgtctccccatcacctgcctgaccattccaccaaggttttcgattgctcccagcagcctggaccccagcaaccggaagcccctcacagtcctcaataaaggcttggagaaccccctgcctgagcgtccccgggaaaaagaagaaccagtggttcgagagacaggtgaggtggtcgactgccacctcagtgacatgctgcagcagctgcacagtgtcaatgcctccaagccctcggagcgtgggctggtcaggcaagaggaggctgaggatcctgcctgcatccccatcttctgggtcagcaagtgggtggactattcggacaagtacggccttgggtatcagctctgtgataacagcgtgggggtgctcttcaatgactcaacacgcctcatcctctacaatgatggtgacagcctgcagtacatagagcgtgacggcactgagtcctacctcaccgtgagttcccatcccaactccttgatgaagaagatcaccctccttaaatatttccgcaattacatgagcgagcacttgctgaaggcaggtgccaacatcacgccgcgcgaaggtgatgagctcgcccggctgccctacctacggacctggttccgcacccgcagcgccatcatcctgcacctcagcaacggcagcgtgcagatcaacttcttccaggatcacaccaagctcatcttgtgcccactgatggcagccgtgacctacatcgacgagaagcgggacttccgcacataccgcctgagtctcctggaggagtacggctgctgcaaggagctggccagccggctccgctacgcccgcactatggtggacaagctgctgagctcacgctcggccagcaaccgtctcaaggcctcctaatagctgccctcccctccggactggtgccctcctcactcccacctgcatctggggcccatactggttggctcccgcggtgccatgtctgcagtgtgccccccagccccggtggctgggcagagctgcatcatccttgcaggtgggggttgctgtataagttatttttgtacatgttcgggtgtgggttctacagccttgtccccctccccctcaaccccaccatatgaattgtacagaatatttctattgaattcggaactgtcctttccttggctttatgcacattaaacagatgtgaatattc

SEQ ID NO: 3207 - DNA, 894 bp, Homo sapiens
agcatgagtgctgcagtgactgcagggaagctggcacgggcaccggccgaccctgggaaagccggggtccccggagttgcagctcccggagctccggcggcggctccaccggcgaaagagatcccggaggtcctagtggacccacgcagccggcggcgctatgtgcggggccgctttttgggcaagggcggctttgccaagtgcttcgagatctcggacgcggacaccaaggaggtgttcgcgggcaagattgtgcctaagtctctgctgctcaagccgcaccagagggagaagatgtccatggaaatatccattcaccgcagcctcgcccaccagcacgtcgtaggattccacggctttttcgaggacaacgacttcgtgttcgtggtgttggagctctgccgccggaggtctctcctggagctgcacaagaggaggaaagccctgactgagcctgaggcccgatactacctacggcaaattgtgcttggctgccagtacctgcaccgaaaccgagttattcatcgagacctcaagctgggcaaccttttcctgaatgaagatctggaggtgaaaataggggattttggactggcaaccaaagtcgaatatgacggggagaggaagaagaccctgtgtgggactcctaattacatagctcccgcggtgccatgtctgcagtgtgccccccagccccggtggctgggcagagctgcatcatccttgcaggtgggggttgctgtataagttatttttgtacatgttcgggtgtgggttctacagccttgtccccctccccctcaaccccaccatatgaattgtacagaatatttctattgaattcggaactgtcctttccttggctttatgcacattaaacagatgtgaatattc

SEQ ID NO: 3208 - DNA, 1893 bp, Homo sapiens
ctctgctcggatcgaggtctgcagcgcagcttcgggagcatgagtgctgcagtgactgcagggagaagatgtccatggaaatatccattcaccgcagcctcgcccaccagcacgtcgtaggattccacggctttttcgaggacaacgacttcgtgttcgtggtgttggagctctgccgccggaggtctctcctggagctgcacaagaggaggaaagccctgactgagcctgaggcccgatactacctacggcaaattgtgcttggctgccagtacctgcaccgaaaccgagttattcatcgagacctcaagctgggcaaccttttcctgaatgaagatctggaggtgaaaataggggattttggactggcaaccaaagtcgaatatgacggggagaggaagaagaccctgtgtgggactcctaattacatagctcccgaggtgctgagcaagaaagggcacagtttcgaggtggatgtgtggtccattgggtgtatcatgtataccttgttagtgggcaaaccaccttttgagacttcttgcctaaaagagacctacctccggatcaagaagaatgaatacagtattcccaagcacatcaaccccgtggccgcctccctcatccagaagatgcttcagacagatcccactgcccgcccaaccattaacgagctgcttaatgacgagttctttacttctggctatatccctgcccgtctccccatcacctgcctgaccattccaccaaggttttcgattgctcccagcagcctggaccccagcaaccggaagcccctcacagtcctcaataaaggcttggagaaccccctgcctgagcgtccccgggaaaaagaagaaccagtggttcgagagacaggtgaggtggtcgactgccacctcagtgacatgctgcagcagctgcacagtgtcaatgcctccaagccctcggagcgtgggctggtcaggcaagaggaggctgaggatcctgcctgcatccccatcttctgggtcagcaagtgggtggactattcggacaagtacggccttgggtatcagctctgtgataacagcgtgggggtgctcttcaatgactcaacacgcctcatcctctacaatgatggtgacagcctgcagtacatagagcgtgacggcactgagtcctacctcaccgtgagttcccatcccaactccttgatgaagaagatcaccctccttaaatatttccgcaattacatgagcgagcacttgctgaaggcaggtgccaacatcacgccgcgcgaaggtgatgagctcgcccggctgccctacctacggacctggttccgcacccgcagcgccatcatcctgcacctcagcaacggcagcgtgcagatcaacttcttccaggatcacaccaagctcatcttgtgcccactgatggcagccgtgacctacatcgacgagaagcgggacttccgcacataccgcctgagtctcctggaggagtacggctgctgcaaggagctggccagccggctccgctacgcccgcactatggtggacaagctgctgagctcacgctcggccagcaaccgtctcaaggcctcctaatagctgccctcccctccggactggtgccctcctcactcccacctgcatctggggcccatactggttggctcccgcggtgccatgtctgcagtgtgccccccagccccggtggctgggcagagctgcatcatccttgcaggtgggggttgctgtataagttatttttgtacatgttcgggtgtgggttctacagccttgtccccctccccctcaaccccaccatatgaattgtacagaatatttctattgaattcggaactgtcctttccttggctttatgcacattaaacagatgtgaatattc

SEQ ID NO: 3209 - DNA, 2492 bp, Homo sapiens
tgggggaggagcttctgggtgatgtaaggccgggaatgggagtggcctctcctcgactcgctgctaggaagggggcgggactctcggtgaccagacgccggggagggggcaggcgttcattgataaaacgctgggctcccctgggcgccagcgcagcgtagcaaatccaggcagcgccacgcgcggccggggccgggcggaaccgagaagccgggaccgcgctgcgacgcgccggccgcatggagcctgccgccggtttcctgtctccgcgccccttccagcgtgcggccgccgcgcccgctcccccggccgggcccgggccgcctccgagtgccttgcgcggacctgagctggagatgctggccgggctaccgacgtcagaccccgggcgcctcatcacggacccgcgcagcggccgcacctacctcaaaggccgcttgttgggcaaggggggcttcgcccgctgctacgaggccactgacacagagactggcagcgcctacgctgtcaaagtcatcccgcagagccgcgtcgccaagccgcatcagcgcgagaagatcctaaatgagattgagctgcaccgagacctgcagcaccgccacatcgtgcgtttttcgcaccactttgaggacgctgacaacatctacattttcttggagctctgcagccgaaagtccctggcccacatctggaaggcccggcacaccctgttggagccagaagtgcgctactacctgcggcagatcctttctggcctcaagtacttgcaccagcgcggcatcttgcaccgggacctcaagttgggaaattttttcatcactgagaacatggaactgaaggtgggggattttgggctggcagcccggttggagcctccggagcagaggaagaagaccatctgtggcacccccaactatgtggctccagaagtgctgctgagacagggccacggccctgaggcggatgtatggtcactgggctgtgtcatgtacacgctgctctgcgggagccctccctttgagacggctgacctgaaggagacgtaccgctgcatcaagcaggttcactacacgctgcctgccagcctctcactgcctgcccggcagctcctggccgccatccttcgggcctcaccccgagaccgcccctctattgaccagatcctgcgccatgacttctttaccaagggctacacccccgatcgactccctatcagcagctgcgtgacagtcccagacctgacaccccccaacccagctaggagtctgtttgccaaagttaccaagagcctctttggcagaaagaagaagagtaagaatcatgcccaggagagggatgaggtctccggtttggtgagcggcctcatgcgcacatccgttggccatcaggatgccaggccagaggctccagcagcttctggcccagcccctgtcagcctggtagagacagcacctgaagacagctcaccccgtgggacactggcaagcagtggagatggatttgaagaaggtctgactgtggccacagtagtggagtcagccctttgtgctctgagaaattgtatagccttcatgcccccagcggaacagaacccggcccccctggcccagccagagcctctggtgtgggtcagcaagtgggttgactactccaataagttcggctttgggtatcaactgtccagccgccgtgtggctgtgctcttcaacgatggcacacatatggccctgtcggccaacagaaagactgtgcactacaatcccaccagcacaaagcacttctccttctccgtgggtgctgtgccccgggccctgcagcctcagctgggtatcctgcggtacttcgcctcctacatggagcagcacctcatgaagggtggagatctgcccagtgtggaagaggtagaggtacctgctccgcccttgctgctgcagtgggtcaagacggatcaggctctcctcatgctgtttagtgatggcactgtccaggtgaacttctacggggaccacaccaagctgattctcagtggctgggagcccctccttgtgacttttgtggcccgaaatcgtagtgcttgtacttacctcgcttcccaccttcggcagctgggctgctctccagacctgcggcagcgactccgctatgctctgcgcctgctccgggaccgcagcccagcctaggacccaagccctgaggcctgaggcctgtgcctgtcaggctctggcccttgcctttgtggccttcccccttcctttggtgcctcactgggggctttgggccgaatcccccagggaatcagggaccagctttactggagttgggggcggcttgtcttcgctggctcctaccccatctccaagataagcctgagccttagctcccagctagggggcgttatttatggaccacttttatttattgtcagacacttatttattgggatgtgagccccaggggggcctcctcctaggataataaacaattttgcagaa

SEQ ID NO: 3210 - DNA, 2174 bp, Homo sapiens
tccaggcagcgccacgcgcggccggggccgggcggaaccgagaagccgggaccgcgctgcgacgcgccggccgcatggagcctgccgccggtttcctgtctccgcacctacctcaaaggccgcttgttgggcaaggggggcttcgcccgctgctacgaggccactgacacagagactggcagcgcctacgctgtcaaagtcatcccgcagagccgcgtcgccaagccgcatcagcgcgagaagatcctaaatgagattgagctgcaccgagacctgcagcaccgccacatcgtgcgtttttcgcaccactttgaggacgctgacaacatctacattttcttggagctctgcagccgaaagtccctggcccacatctggaaggcccggcacaccctgttggagccagaagtgcgctactacctgcggcagatcctttctggcctcaagtacttgcaccagcgcggcatcttgcaccgggacctcaagttgggaaattttttcatcactgagaacatggaactgaaggtgggggattttgggctggcagcccggttggagcctccggagcagaggaagaagaccatctgtggcacccccaactatgtggctccagaagtgctgctgagacagggccacggccctgaggcggatgtatggtcactgggctgtgtcatgtacacgctgctctgcgggagccctccctttgagacggctgacctgaaggagacgtaccgctgcatcaagcaggttcactacacgctgcctgccagcctctcactgcctgcccggcagctcctggccgccatccttcgggcctcaccccgagaccgcccctctattgaccagatcctgcgccatgacttctttaccaagggctacacccccgatcgactccctatcagcagctgcgtgacagtcccagacctgacaccccccaacccagctaggagtctgtttgccaaagttaccaagagcctctttggcagaaagaagaagagtaagaatcatgcccaggagagggatgaggtctccggtttggtgagcggcctcatgcgcacatccgttggccatcaggatgccaggccagaggctccagcagcttctggcccagcccctgtcagcctggtagagacagcacctgaagacagctcaccccgtgggacactggcaagcagtggagatggatttgaagaaggtctgactgtggccacagtagtggagtcagccctttgtgctctgagaaattgtatagccttcatgcccccagcggaacagaacccggcccccctggcccagccagagcctctggtgtgggtcagcaagtgggttgactactccaataagttcggctttgggtatcaactgtccagccgccgtgtggctgtgctcttcaacgatggcacacatatggccctgtcggccaacagaaagactgtgcactacaatcccaccagcacaaagcacttctccttctccgtgggtgctgtgccccgggccctgcagcctcagctgggtatcctgcggtacttcgcctcctacatggagcagcacctcatgaagggtggagatctgcccagtgtggaagaggtagaggtacctgctccgcccttgctgctgcagtgggtcaagacggatcaggctctcctcatgctgtttagtgatggcactgtccaggtgaacttctacggggaccacaccaagctgattctcagtggctgggagcccctccttgtgacttttgtggcccgaaatcgtagtgcttgtacttacctcgcttcccaccttcggcagctgggctgctctccagacctgcggcagcgactccgctatgctctgcgcctgctccgggaccgcagcccagcctaggacccaagccctgaggcctgaggcctgtgcctgtcaggctctggcccttgcctttgtggccttcccccttcctttggtgcctcactgggggctttgggccgaatcccccagggaatcagggaccagctttactggagttgggggcggcttgtcttcgctggctcctaccccatctccaagataagcctgagccttagctcccagctagggggcgttatttatggaccacttttatttattgtcagacacttatttattgggatgtgagccccaggggggcctcctcctaggataataaacaattttgc

SEQ ID NO: 3211 - DNA, 3841 bp, Homo sapiens
agcctatccggagcgatccatctcgttacgtcaccaccagcctagctcggacggcaagcggcgggagattttcaaaatgggagcccagaggcaccgcccaggcctcggaaggtgtcagggagaactttccgtggtttcagcgtcgtcgcctggagcggcggtttagagagccgagcctgatgggcgccaaggccggctggctgcttggagcgctgcctcgaagggactgcgtgaaggaagctaatccggagaacccaggccagagcctggaaatatggcgacctgcatcggggagaagatcgaggattttaaagttggaaatctgcttggtaaaggatcatttgctggtgtctacagagctgagtccattcacactggtttggaagttgcaatcaaaatgatagataagaaagccatgtacaaagcaggaatggtacagagagtccaaaatgaggtgaaaatacattgccaattgaaacatccttctatcttggagctttataactattttgaagatagcaattatgtgtatctggtattagaaatgtgccataatggagaaatgaacaggtatctaaagaatagagtgaaacccttctcagaaaatgaagctcgacacttcatgcaccagatcatcacagggatgttgtatcttcattctcatggtatactacaccgggacctcacactttctaacctcctactgactcgtaatatgaacatcaagattgctgattttgggctggcaactcaactgaaaatgccacatgaaaagcactatacattatgtggaactcctaactacatttcaccagaaattgccactcgaagtgcacatggccttgaatctgatgtttggtccctgggctgtatgttttatacattacttatcgggagaccacccttcgacactgacacagtcaagaacacattaaataaagtagtattggcagattatgaaatgccatcttttttgtcaatagaggccaaggaccttattcaccagttacttcgtagaaatccagcagatcgtttaagtctgtcttcagtattggaccatccttttatgtcccgaaattcttcaacaaaaagtaaagatttaggaactgtggaagactcaattgatagtgggcatgccacaatttctactgcaattacagcttcttccagtaccagtataagtggtagtttatttgacaaaagaagacttttgattggtcagccactcccaaataaaatgactgtatttccaaagaataaaagttcaactgatttttcttcttcaggagatggaaacagtttttatactcagtggggaaatcaagaaaccagtaatagtggaaggggaagagtaattcaagatgcagaagaaaggccacattctcgataccttcgtagagcttattcctctgatagatctggcacttctaatagtcagtctcaagcaaaaacatatacaatggaacgatgtcactcagcagaaatgctttcagtgtccaaaagatcaggaggaggtgaaaatgaagagaggtactcacccacagacaacaatgccaacatttttaacttctttaaagaaaagacatccagtagttctggatcttttgaaagacctgataacaatcaagcactctccaatcatctttgtccaggaaaaactccttttccatttgcagacccgacacctcagactgaaaccgtacaacagtggtttgggaatctgcaaataaatgctcatttaagaaaaactactgaatatgacagcatcagcccaaaccgggacttccagggccatccagatttgcagaaggacacatcaaaaaatgcctggactgatacaaaagtcaaaaagaactctgatgcttctgataatgcacattctgtaaaacagcaaaataccatgaaatatatgactgcacttcacagtaaacctgagataatccaacaagaatgtgtttttggctcagatcctctttctgaacagagcaagactaggggtatggagccaccatggggttatcagaatcgtacattaagaagcattacatctccgttggttgctcacaggttaaaaccaatcagacagaaaaccaaaaaggctgtggtgagcatacttgattcagaggaggtgtgtgtggagcttgtaaaggagtatgcatctcaagaatatgtgaaagaagttcttcagatatctagtgatggaaatacgatcactatttattatccaaatggtggtagaggttttcctcttgctgatagaccaccctcacctactgacaacatcagtaggtacagctttgacaatttaccagaaaaatactggcgaaaatatcaatatgcttccaggtttgtacagcttgtaagatctaaatctcccaaaatcacttattttacaagatatgctaaatgcattttgatggagaattctcctggtgctgattttgaggtttggttttatgatggggtaaaaatacacaaaacagaagatttcattcaggtgattgaaaagacagggaagtcttacactttaaaaagtgaaagtgaagttaatagcttgaaagaggagataaaaatgtatatggaccatgctaatgagggtcatcgtatttgtttagcactggaatccataatttcagaagaggaaaggaaaactaggagtgctccctttttcccaataatcataggaagaaaacctggtagtactagttcacctaaggccttatcacctcctccttctgtggattcaaattacccaacgagagagagagcatctttcaacagaatggtcatgcatagtgctgcttctccaacacaggcaccaatccttaatccctctatggttacaaatgaaggacttggtcttacaactacagcttctggaacagacatctcttctaatagtctaaaagattgtcttcctaaatcagcacaacttttgaaatctgtttttgtgaaaaatgttggttgggctacacagttaactagtggagctgtgtgggttcagtttaatgatgggtcccagttggttgtgcaggcaggagtgtcttctatcagttatacctcaccaaatggtcaaacaactaggtatggagaaaatgaaaaattaccagactacatcaaacagaaattacagtgtctgtcttccatccttttgatgttttctaatccgactcctaattttcattgattaaaactcctttcagacatataagtttaataaataacttttttgttgactttcaagtaaagtgattttttttaatttaacataaagtcttcagaaagcctttctatgaaagaattttaacctataatgtaaaggatgtattctgagagaacaaagcagaatgaaacttgagtcacttactaaatatagtggatataaaatagaacacctgactttgctcttagaccataacccccgaacttactatgttcatatatttgtattgaacaatcttttaaaagcaaaaatgtaaatgatgtgtagtttatttgtgcttttattgttttccctgcgtctcagacatgttgagaatcatggacaaaacctgctggaattttggaatttttgaagatgtaaataatgtgtatttatgttataagtaacatatgtaaacatgtatatttgttttatatttatttttgtaacaccagtgtctgatgaaacatttttgcaaatgcattttataaaaaaataaatatagtgataagttacattatcttttgattcatttaattaaatacttatttttaaataacttaccagtaaactcactttttaaattttgttgcctgttgaggagccaattaaattttaaatattaattttgcaaatgtt

SEQ ID NO: 3212 - DNA, 3123 bp, Homo sapiens
gattttcaaaatgggagcccagaggcaccgcccaggcctcggaaggtgtcagggagaactttccgtggtttcagcgtcgtcgcctggagcggcggtttagagagccgagcctgatgggcgccaaggccggctggctgcttggagcgctgcctcgaagggactgcgtgaaggaagctaatccggagaacccaggccagagcctggaaatatggcgacctgcatcggggagaagatcgaggattttaaagttggaaatctgcttggtaaaggatcatttgctggtgtctacagagctgagtccattcacactggtttggaagttgcaatcaaaatgctttataactattttgaagatagcaattatgtgtatctggtattagaaatgtgccataatggagaaatgaacaggtatctaaagaatagagtgaaacccttctcagaaaatgaagctcgacacttcatgcaccagatcatcacagggatgttgtatcttcattctcatggtatactacaccgggacctcacactttctaacctcctactgactcgtaatatgaacatcaagattgctgattttgggctggcaactcaactgaaaatgccacatgaaaagcactatacattatgtggaactcctaactacatttcaccagaaattgccactcgaagtgcacatggccttgaatctgatgtttggtccctgggctgtatgttttatacattacttatcgggagaccacccttcgacactgacacagtcaagaacacattaaataaagtagtattggcagattatgaaatgccatcttttttgtcaatagaggccaaggaccttattcaccagttacttcgtagaaatccagcagatcgtttaagtctgtcttcagtattggaccatccttttatgtcccgaaattcttcaacaaaaagtaaagatttaggaactgtggaagactcaattgatagtgggcatgccacaatttctactgcaattacagcttcttccagtaccagtataagtggtagtttatttgacaaaagaagacttttgattggtcagccactcccaaataaaatgactgtatttccaaagaataaaagttcaactgatttttcttcttcaggagatggaaacagtttttatactcagtggggaaatcaagaaaccagtaatagtggaaggggaagagtaattcaagatgcagaagaaaggccacattctcgataccttcgtagagcttattcctctgatagatctggcacttctaatagtcagtctcaagcaaaaacatatacaatggaacgatgtcactcagcagaaatgctttcagtgtccaaaagatcaggaggaggtgaaaatgaagagaggtactcacccacagacaacaatgccaacatttttaacttctttaaagaaaagacatccagtagttctggatcttttgaaagacctgataacaatcaagcactctccaatcatctttgtccaggaaaaactccttttccatttgcagacccgacacctcagactgaaaccgtacaacagtggtttgggaatctgcaaataaatgctcatttaagaaaaactactgaatatgacagcatcagcccaaaccgggacttccagggccatccagatttgcagaaggacacatcaaaaaatgcctggactgatacaaaagtcaaaaagaactctgatgcttctgataatgcacattctgtaaaacagcaaaataccatgaaatatatgactgcacttcacagtaaacctgagataatccaacaagaatgtgtttttggctcagatcctctttctgaacagagcaagactaggggtatggagccaccatggggttatcagaatcgtacattaagaagcattacatctccgttggttgctcacaggttaaaaccaatcagacagaaaaccaaaaaggctgtggtgagcatacttgattcagaggaggtgtgtgtggagcttgtaaaggagtatgcatctcaagaatatgtgaaagaagttcttcagatatctagtgatggaaatacgatcactatttattatccaaatggtggtagaggttttcctcttgctgatagaccaccctcacctactgacaacatcagtaggtacagctttgacaatttaccagaaaaatactggcgaaaatatcaatatgcttccaggtttgtacagcttgtaagatctaaatctcccaaaatcacttattttacaagatatgctaaatgcattttgatggagaattctcctggtgctgattttgaggtttggttttatgatggggtaaaaatacacaaaacagaagatttcattcaggtgattgaaaagacagggaagtcttacactttaaaaagtgaaagtgaagttaatagcttgaaagaggagataaaaatgtatatggaccatgctaatgagggtcatcgtatttgtttagcactggaatccataatttcagaagaggaaaggaaaactaggagtgctccctttttcccaataatcataggaagaaaacctggtagtactagttcacctaaggccttatcacctcctccttctgtggattcaaattacccaacgagagagagagcatctttcaacagaatggtcatgcatagtgctgcttctccaacacaggcaccaatccttaatccctctatggttacaaatgaaggacttggtcttacaactacagcttctggaacagacatctcttctaatagtctaaaagattgtcttcctaaatcagcacaacttttgaaatctgtttttgtgaaaaatgttggttgggctacacagttaactagtggagctgtgtgggttcagtttaatgatgggtcccagttggttgtgcaggcaggagtgtcttctatcagttatacctcaccaaatggtcaaacaactaggtatggagaaaatgaaaaattaccagactacatcaaacagaaattacagtgtctgtcttccatccttttgatgttttctaatccgactcctaattttcattgattaaaactcctttcagacatataagtttaataaataacttttttgttgactttcaagtaaagtgattttttttaatttaacataaagtcttcagaaag

SEQ ID NO: 3213 - DNA, 3060 bp, Homo sapiens
gggaaggggagcgaacgaagctaacggctgcggggcgggcaccgaggtgcttagggagggtcccaacggcccagacccctgctgtttaggggcggagcggcccgcccctcaagagacaagagtagggaaggcgggacaggattttaaagttggaaatctgcttggtaaaggatcatttgctggtgtctacagagctgagtccattcacactggtttggaagttgcaatcaaaatgatagataagaaagccatgtacaaagcaggaatggtacagagagtccaaaatgaggtgaaaatacattgccaattgaaacatccttctatcttggagctttataactattttgaagatagcaattatgtgtatctggtattagaaatgtgccataatggagaaatgaacaggtatctaaagaatagagtgaaacccttctcagaaaatgaagctcgacacttcatgcaccagatcatcacagggatgttgtatcttcattctcatggtatactacaccgggacctcacactttctaacctcctactgactcgtaatatgaacatcaagattgctgattttgggctggcaactcaactgaaaatgccacatgaaaagcactatacattatgtggaactcctaactacatttcaccagaaattgccactcgaagtgcacatggccttgaatctgatgtttggtccctgggctgtatgttttatacattacttatcgggagaccacccttcgacactgacacagtcaagaacacattaaataaagtagtattggcagattatgaaatgccatcttttttgtcaatagaggccaaggaccttattcaccagttacttcgtagaaatccagcagatcgtttaagtctgtcttcagtattggaccatccttttatgtcccgaaattcttcaacaaaaagtaaagatttaggaactgtggaagactcaattgatagtgggcatgccacaatttctactgcaattacagcttcttccagtaccagtataagtggtagtttatttgacaaaagaagacttttgattggtcagccactcccaaataaaatgactgtatttccaaagaataaaagttcaactgatttttcttcttcaggagatggaaacagtttttatactcagtggggaaatcaagaaaccagtaatagtggaaggggaagagtaattcaagatgcagaagaaaggccacattctcgataccttcgtagagcttattcctctgatagatctggcacttctaatagtcagtctcaagcaaaaacatatacaatggaacgatgtcactcagcagaaatgctttcagtgtccaaaagatcaggaggaggtgaaaatgaagagaggtactcacccacagacaacaatgccaacatttttaacttctttaaagaaaagacatccagtagttctggatcttttgaaagacctgataacaatcaagcactctccaatcatctttgtccaggaaaaactccttttccatttgcagacccgacacctcagactgaaaccgtacaacagtggtttgggaatctgcaaataaatgctcatttaagaaaaactactgaatatgacagcatcagcccaaaccgggacttccagggccatccagatttgcagaaggacacatcaaaaaatgcctggactgatacaaaagtcaaaaagaactctgatgcttctgataatgcacattctgtaaaacagcaaaataccatgaaatatatgactgcacttcacagtaaacctgagataatccaacaagaatgtgtttttggctcagatcctctttctgaacagagcaagactaggggtatggagccaccatggggttatcagaatcgtacattaagaagcattacatctccgttggttgctcacaggttaaaaccaatcagacagaaaaccaaaaaggctgtggtgagcatacttgattcagaggaggtgtgtgtggagcttgtaaaggagtatgcatctcaagaatatgtgaaagaagttcttcagatatctagtgatggaaatacgatcactatttattatccaaatggtggtagaggttttcctcttgctgatagaccaccctcacctactgacaacatcagtaggtacagctttgacaatttaccagaaaaatactggcgaaaatatcaatatgcttccaggtttgtacagcttgtaagatctaaatctcccaaaatcacttattttacaagatatgctaaatgcattttgatggagaattctcctggtgctgattttgaggtttggttttatgatggggtaaaaatacacaaaacagaagatttcattcaggtgattgaaaagacagggaagtcttacactttaaaaagtgaaagtgaagttaatagcttgaaagaggagataaaaatgtatatggaccatgctaatgagggtcatcgtatttgtttagcactggaatccataatttcagaagaggaaaggaaaactaggagtgctccctttttcccaataatcataggaagaaaacctggtagtactagttcacctaaggccttatcacctcctccttctgtggattcaaattacccaacgagagagagagcatctttcaacagaatggtcatgcatagtgctgcttctccaacacaggcaccaatccttaatccctctatggttacaaatgaaggacttggtcttacaactacagcttctggaacagacatctcttctaatagtctaaaagattgtcttcctaaatcagcacaacttttgaaatctgtttttgtgaaaaatgttggttgggctacacagttaactagtggagctgtgtgggttcagtttaatgatgggtcccagttggttgtgcaggcaggagtgtcttctatcagttatacctcaccaaatggtcaaacaactaggtatggagaaaatgaaaaattaccagactacatcaaacagaaattacagtgtctgtcttccatccttttgatgttttctaatccgactcctaattttcattgattaaaactcctttcagacatataagtttaataaataac

SEQ ID NO: 3214 - DNA, 1886 bp, Homo sapiens
ggttgatgacgtcagcgttcgaattccatggcggcgcggcggcgacggagcaccggcggcggcagggcgagagcattaaatgaaagcaaaagagttaataatggcaacacggctccagaagactcttcccctgccaagaaaactcgtagatgccagagacaggagtcgaaaaagatgcctgtggctggaggaaaagctaataaggacaggacagaagacaagcaagatggtatgccaggaaggtcatgggccagcaaaagggtctctgaatctgtgaaggccttgctgttaaagggcaaagctcctgtggacccagagtgtacagccaaggtggggaaggctcatgtgtattgtgaaggaaatgatgtctatgatgtcatgctaaatcagaccaatctccagttcaacaacaacaagtactatctgattcagctattagaagatgatgcccagaggaacttcagtgtttggatgagatggggccgagttgggaaaatgggacagcacagcctggtggcttgttcaggcaatctcaacaaggccaaggaaatctttcagaagaaattccttgacaaaacgaaaaacaattgggaagatcgagaaaagtttgagaaggtgcctggaaaatatgatatgctacagatggactatgccaccaatactcaggatgaagaggaaacaaagaaagaggaatctcttaaatctcccttgaagccagagtcacagctagatcttcgggtacaggagttaataaagttgatctgtaatgttcaggccatggaagaaatgatgatggaaatgaagtataataccaagaaagccccacttgggaagctgacagtggcacaaatcaaggcaggttaccagtctcttaagaagattgaggattgtattcgggctggccagcatggacgagctctcatggaagcatgcaatgaattctacaccaggattccgcatgactttggactccgtactcctccactaatccggacacagaaggaactgtcagaaaaaatacaattactagaggctttgggagacattgaaattgctattaagctggtgaaaacagagctacaaagcccagaacacccattggaccaacactatagaaacctacattgtgccttgcgcccccttgaccatgaaagttatgagttcaaagtgatttcccagtacctacaatctacccatgctcccacacacagcgactataccatgaccttgctggatttgtttgaagtggagaaggatggtgagaaagaagccttcagagaggaccttcataacaggatgcttctatggcatggttccaggatgagtaactgggtgggaatcttgagccatgggcttcgaattgccccacctgaagctcccatcacaggttacatgtttgggaaaggaatctactttgctgacatgtcttccaagagtgccaattactgctttgcctctcgcctaaagaatacaggactgctgctcttatcagaggtagctctaggtcagtgtaatgaactactagaggccaatcctaaggccgaaggattgcttcaaggtaaacatagcaccaaggggctgggcaagatggctcccagttctgcccacttcgtcaccctgaatgggagtacagtgccattaggaccagcaagtgacacaggaattctgaatccagatggttataccctcaactacaatgaatatattgtatataaccccaaccaggtccgtatgcggtaccttttaaaggttcagtttaatttccttcagctgtggtgaatgttgatattaaataaaccagagatctgatcttcaagcaagaaaataagcagtgttgtacttgtgaattttgtgatattttatgtaataaaaactgtacaggtcta

SEQ ID NO: 3215 - DNA, 1881 bp, Homo sapiens
ctagtgacactgggcccgcgattccttggagcgggttgatgacgtcagcgttcgaattccatggcggcgcggcggcgacggagcaccggcggcggcagggcgagagcattaaatgaaagcaaaagagttaataatggcaacacggctccagaagactcttcccctgccaagaaaactcgtagatgccagagacaggagtcgaaaaagatgcctgtggctggaggaaaagctaataaggacaggacagaagacaagcaagatgaatctgtgaaggccttgctgttaaagggcaaagctcctgtggacccagagtgtacagccaaggtggggaaggctcatgtgtattgtgaaggaaatgatgtctatgatgtcatgctaaatcagaccaatctccagttcaacaacaacaagtactatctgattcagctattagaagatgatgcccagaggaacttcagtgtttggatgagatggggccgagttgggaaaatgggacagcacagcctggtggcttgttcaggcaatctcaacaaggccaaggaaatctttcagaagaaattccttgacaaaacgaaaaacaattgggaagatcgagaaaagtttgagaaggtgcctggaaaatatgatatgctacagatggactatgccaccaatactcaggatgaagaggaaacaaagaaagaggaatctcttaaatctcccttgaagccagagtcacagctagatcttcgggtacaggagttaataaagttgatctgtaatgttcaggccatggaagaaatgatgatggaaatgaagtataataccaagaaagccccacttgggaagctgacagtggcacaaatcaaggcaggttaccagtctcttaagaagattgaggattgtattcgggctggccagcatggacgagctctcatggaagcatgcaatgaattctacaccaggattccgcatgactttggactccgtactcctccactaatccggacacagaaggaactgtcagaaaaaatacaattactagaggctttgggagacattgaaattgctattaagctggtgaaaacagagctacaaagcccagaacacccattggaccaacactatagaaacctacattgtgccttgcgcccccttgaccatgaaagttatgagttcaaagtgatttcccagtacctacaatctacccatgctcccacacacagcgactataccatgaccttgctggatttgtttgaagtggagaaggatggtgagaaagaagccttcagagaggaccttcataacaggatgcttctatggcatggttccaggatgagtaactgggtgggaatcttgagccatgggcttcgaattgccccacctgaagctcccatcacaggttacatgtttgggaaaggaatctactttgctgacatgtcttccaagagtgccaattactgctttgcctctcgcctaaagaatacaggactgctgctcttatcagaggtagctctaggtcagtgtaatgaactactagaggccaatcctaaggccgaaggattgcttcaaggtaaacatagcaccaaggggctgggcaagatggctcccagttctgcccacttcgtcaccctgaatgggagtacagtgccattaggaccagcaagtgacacaggaattctgaatccagatggttataccctcaactacaatgaatatattgtatataaccccaaccaggtccgtatgcggtaccttttaaaggttcagtttaatttccttcagctgtggtgaatgttgatattaaataaaccagagatctgatcttcaagcaagaaaataagcagtgttgtacttgtgaattttgtgatattttatgtaataaaaactgtacaggtctac

SEQ ID NO: 3216 - DNA, 2336 bp, Homo sapiens
ggtcaccgcgcgaccggcagatgcgtgctgcaggccccggccacatgagcagcgctacggacgcgactgccccggccttggatatgccagatcgagtgtccacccgtccgtgggactggtcgcctgactcggcctgccccagcctctgcttcaccccactggtggccaaatagccgatgtctaatcccccacacaagctcatccccggcctctggcgattgttgggaattctctccctaattcacgcctgaggctcatggagagttgctagacctgggactgccctgggaggcgcacacaaccaggccgggtggcagccaggacctctcccatgtccctgcttttcttggccatggctccaaagccgaagccctgggtacagactgagggccctgagaagaagaagggccggcaggcaggaagggaggaggaccccttccgctccaccgctgaggccctcaaggccatacccgcagagaagcgcataatccgcgtggatccaacatgtccactcagcagcaaccccgggacccaggtgtatgaggactacaactgcaccctgaaccagaccaacatcgagaacaacaacaacaagttctacatcatccagctgctccaagacagcaaccgcttcttcacctgctggaaccactggggccgtgtgggagaggtcggccagtcaaagatcaaccacttcacaaggctagaagatgcaaagaaggactttgagaagaaatttcgggaaaagaccaagaacaactgggcagagcgggaccactttgtgtctcacccgggcaagtacacacttatcgaagtacaggcagaggatgaggcccaggaagctgtggtgaaggtggacagaggcccagtgaggactgtgactaagcgggtgcagccctgctccctggacccagccacgcagaagctcatcactaacatcttcagcaaggagatgttcaagaacaccatggccctcatggacctggatgtgaagaagatgcccctgggaaagctgagcaagcaacagattgcacggggtttcgaggccttggaggcgctggaggaggccctgaaaggccccacggatggtggccaaagcctggaggagctgtcctcacacttttacaccgtcatcccgcacaacttcggccacagccagcccccgcccatcaattcccctgagcttctgcaggccaagaaggacatgctgctggtgctggcggacatcgagctggcccaggccctgcaggcagtctctgagcaggagaagacggtggaggaggtgccacaccccctggaccgagactaccagcttctcaagtgccagctgcagctgctagactctggagcacctgagtacaaggtgatacagacctacttagaacagactggcagcaaccacaggtgccctacacttcaacacatctggaaagtaaaccaagaaggggaggaagacagattccaggcccactccaaactgggtaatcggaagctgctgtggcatggcaccaacatggccgtggtggccgccatcctcactagtgggctccgcatcatgccacattctggtgggcgtgttggcaagggcatctactttgcctcagagaacagcaagtcagctggatatgttattggcatgaagtgtggggcccaccatgtcggctacatgttcctgggtgaggtggccctgggcagagagcaccatatcaacacggacaaccccagcttgaagagcccacctcctggcttcgacagtgtcattgcccgaggccacaccgagcctgatccgacccaggacactgagttggagctggatggccagcaagtggtggtgccccagggccagcctgtgccctgcccagagttcagcagctccacattctcccagagcgagtacctcatctaccaggagagccagtgtcgcctgcgctacctgctggaggtccacctctgagtgcccgccctgtcccccggggtcctgcaaggctggactgtgatcttcaatcatcctgcccatctctggtacccctatatcactcctttttttcaagaatacaatacgttgttgttaactatagtcaccatgctgtacaagatccctgaacttatgcctcctaactgaaattttgtattctttgacacatctgcccagtccctctcctcccagcccatggtaaccagcatttgactctttacttgtataagggcagcttttataggttccacatgtaagtgagatcatgcagtgtttgtctttctgtgcctggcttatttcactcagcataatgtgcaccgggttcacccatgttttcataaatgacaagatttcctccttt

SEQ ID NO: 3217 - DNA, 2472 bp, Homo sapiens
gtatccgggcccaaggtcaccgcgcgaccggcagatgcgtgctgcaggccccggccacatgagcagcgctacggacgcgactgccccggccttggatatgccagatcgagtgtccacccgtccgtgggactggtcgcctgactcggcctgccccagcctctgcttcaccccactggtggccaaatagccgatgtctaatcccccacacaagctcatccccggcctctggcgattgttgggaattctctccctaattcacgcctgaggctcatggagagttgctagacctgggactgccctgggaggcgcacacaaccaggccgggtggcagccaggacctctcccatgtccctgcttttcttggctcggtgactcggcccggcaaccatgccagggctgaactagctgacacagggggaggagccccgaagtggaagagagagagcctcctttcactttccctacccctcaggacacacaggacagccatggctccaaagccgaagccctgggtacagactgagggccctgagaagaagaagggccggcaggcaggaagggaggaggaccccttccgctccaccgctgaggccctcaaggccatacccgcagagaagcgcataatccgcgtggatccaacatgtccactcagcagcaaccccgggacccaggtgtatgaggactacaactgcaccctgaaccagaccaacatcgagaacaacaacaacaagttctacatcatccagctgctccaagacagcaaccgcttcttcacctgctggaaccactggggccgtgtgggagaggtcggccagtcaaagatcaaccacttcacaaggctagaagatgcaaagaaggactttgagaagaaatttcgggaaaagaccaagaacaactgggcagagcgggaccactttgtgtctcacccgggcaagtacacacttatcgaagtacaggcagaggatgaggcccaggaagctgtggtgaaggtggacagaggcccagtgaggactgtgactaagcgggtgcagccctgctccctggacccagccacgcagaagctcatcactaacatcttcagcaaggagatgttcaagaacaccatggccctcatggacctggatgtgaagaagatgcccctgggaaagctgagcaagcaacagattgcacggggtttcgaggccttggaggcgctggaggaggccctgaaaggccccacggatggtggccaaagcctggaggagctgtcctcacacttttacaccgtcatcccgcacaacttcggccacagccagcccccgcccatcaattcccctgagcttctgcaggccaagaaggacatgctgctggtgctggcggacatcgagctggcccaggccctgcaggcagtctctgagcaggagaagacggtggaggaggtgccacaccccctggaccgagactaccagcttctcaagtgccagctgcagctgctagactctggagcacctgagtacaaggtgatacagacctacttagaacagactggcagcaaccacaggtgccctacacttcaacacatctggaaagtaaaccaagaaggggaggaagacagattccaggcccactccaaactgggtaatcggaagctgctgtggcatggcaccaacatggccgtggtggccgccatcctcactagtgggctccgcatcatgccacattctggtgggcgtgttggcaagggcatctactttgcctcagagaacagcaagtcagctggatatgttattggcatgaagtgtggggcccaccatgtcggctacatgttcctgggtgaggtggccctgggcagagagcaccatatcaacacggacaaccccagcttgaagagcccacctcctggcttcgacagtgtcattgcccgaggccacaccgagcctgatccgacccaggacactgagttggagctggatggccagcaagtggtggtgccccagggccagcctgtgccctgcccagagttcagcagctccacattctcccagagcgagtacctcatctaccaggagagccagtgtcgcctgcgctacctgctggaggtccacctctgagtgcccgccctgtcccccggggtcctgcaaggctggactgtgatcttcaatcatcctgcccatctctggtacccctatatcactcctttttttcaagaatacaatacgttgttgttaactatagtcaccatgctgtacaagatccctgaacttatgcctcctaactgaaattttgtattctttgacacatctgcccagtccctctcctcccagcccatggtaaccagcatttgactctttacttgtataagggcagcttttataggttccacatgtaagtgagatcatgcagtgtttgtctttctgtgcctggcttatttcactcagcataatgtgcaccgggttcacccatgttttcataaatgacaagatttcctccttt

SEQ ID NO: 3218 - DNA, 2360 bp, Homo sapiens
gtatccgggcccaaggtcaccgcgcgaccggcagatgcgtgctgcaggccccggccacatgagcagcgctacggacgcgactgccccggccttggatatgccagatcgagtgtccacccgtccgtgggactggtcgcctgactcggcctgccccagcctctgcttcaccccactggtggccaaatagccgatgtctaatcccccacacaagctcatccccggcctctggcgattgttgggaattctctccctaattcacgcctgaggctcatggagagttgctagacctgggactgccctgggaggcgcacacaaccaggccgggtggcagccaggacctctcccatgtccctgcttttcttgggacagccatggctccaaagccgaagccctgggtacagactgagggccctgagaagaagaagggccggcaggcaggaagggaggaggaccccttccgctccaccgctgaggccctcaaggccatacccgcagagaagcgcataatccgcgtggatccaacatgtccactcagcagcaaccccgggacccaggtgtatgaggactacaactgcaccctgaaccagaccaacatcgagaacaacaacaacaagttctacatcatccagctgctccaagacagcaaccgcttcttcacctgctggaaccactggggccgtgtgggagaggtcggccagtcaaagatcaaccacttcacaaggctagaagatgcaaagaaggactttgagaagaaatttcgggaaaagaccaagaacaactgggcagagcgggaccactttgtgtctcacccgggcaagtacacacttatcgaagtacaggcagaggatgaggcccaggaagctgtggtgaaggtggacagaggcccagtgaggactgtgactaagcgggtgcagccctgctccctggacccagccacgcagaagctcatcactaacatcttcagcaaggagatgttcaagaacaccatggccctcatggacctggatgtgaagaagatgcccctgggaaagctgagcaagcaacagattgcacggggtttcgaggccttggaggcgctggaggaggccctgaaaggccccacggatggtggccaaagcctggaggagctgtcctcacacttttacaccgtcatcccgcacaacttcggccacagccagcccccgcccatcaattcccctgagcttctgcaggccaagaaggacatgctgctggtgctggcggacatcgagctggcccaggccctgcaggcagtctctgagcaggagaagacggtggaggaggtgccacaccccctggaccgagactaccagcttctcaagtgccagctgcagctgctagactctggagcacctgagtacaaggtgatacagacctacttagaacagactggcagcaaccacaggtgccctacacttcaacacatctggaaagtaaaccaagaaggggaggaagacagattccaggcccactccaaactgggtaatcggaagctgctgtggcatggcaccaacatggccgtggtggccgccatcctcactagtgggctccgcatcatgccacattctggtgggcgtgttggcaagggcatctactttgcctcagagaacagcaagtcagctggatatgttattggcatgaagtgtggggcccaccatgtcggctacatgttcctgggtgaggtggccctgggcagagagcaccatatcaacacggacaaccccagcttgaagagcccacctcctggcttcgacagtgtcattgcccgaggccacaccgagcctgatccgacccaggacactgagttggagctggatggccagcaagtggtggtgccccagggccagcctgtgccctgcccagagttcagcagctccacattctcccagagcgagtacctcatctaccaggagagccagtgtcgcctgcgctacctgctggaggtccacctctgagtgcccgccctgtcccccggggtcctgcaaggctggactgtgatcttcaatcatcctgcccatctctggtacccctatatcactcctttttttcaagaatacaatacgttgttgttaactatagtcaccatgctgtacaagatccctgaacttatgcctcctaactgaaattttgtattctttgacacatctgcccagtccctctcctcccagcccatggtaaccagcatttgactctttacttgtataagggcagcttttataggttccacatgtaagtgagatcatgcagtgtttgtctttctgtgcctggcttatttcactcagcataatgtgcaccgggttcacccatgttttcataaatgacaagatttcctccttttttaa

SEQ ID NO: 3219 - DNA, 1040 bp, Homo sapiens
ggagaccatggaggcctaagggcctctctgtgccccaggacagccatggctccaaagccgaagccctgggtacagactgagggccctgagaagaagaagggccggcaggcaggaagggaggaggaccccttccgctccaccgctgaggccctcaaggccatacccgcagagaagcgcataatccgcgtggatccaacatgtccactcagcagcaaccccgggacccaggtgtatgaggactacaactgcaccctgaaccagaccaacatcgagaacaacaacaacaagttctacatcatccagctgctccaagacagcaaccgcttcttcacctgctggaaccactggggccgtgtgggagaggtcggccagtcaaagatcaaccacttcacaaggctagaagatgcaaagaaggactttgagaagaaatttcgggaaaagaccaagaacaactgggcagagcgggaccactttgtgtctcacccgggcaagtacacacttatcgaagtacaggcagaggatgaggcccaggaagctgtggtgaaggtggacagaggcccagtgaggactgtgactaagcgggtgcagccctgctccctggacccagccacgcagaagctcatcactaacatcttcagcaaggagatgttcaagaacaccatggccctcatggacctggatgtgaagaagatgcccctgggaaagctgagcaagcaacagattgcacggggtttcgaggccttggaggcgctggaggaggccctgaaaggccccacggatggtggccaaagcctggaggagctgtcctcacacttttacaccgtcatcccgcacaacttcggccacagccagcccccgcccatcaattcccctgagcttctgcaggccaagaaggacatgctgctggtgctggcggacatcgagctggcccaggccctgcaggcagtctctgagcaggagaagacggtggaggaggtgccacaccccctggaccgagactaccagcttctcaagtgccagctgcagctgctagactctgg

SEQ ID NO: 3220 - DNA, 5474 bp, Homo sapiens
cgcccgcccagccccgggggcagggagagcctagattacggaagtaccgcgagcaaggagcgcggaatcggggagcgtccggagctagctggatcctctaggcaggatggtgatgggaatctttgcaaattgtatcttctgtttgaaagtgaagtacttacctcagcagcagaagaaaaagctacaaactgacattaaggaaaatggcggaaagttttccttttcgttaaatcctcagtgcacacatataatcttagataatgctgatgttctgagtcagtaccaactgaattctatccaaaagaaccacgttcatattgcaaacccagattttatatggaaatctatcagggaaaagagactcttggatgtaaagaattatgatccttataagcccctggacatcacaccacctcctgatcagaaggcgagcagttctgaagtgaaaacagaaggtctatgcccggacagtgccacagaggaggaagacactgtggaactcactgagtttggtatgcagaatgttgaaattcctcatcttcctcaagattttgaagttgcaaaatataacaccttggagaaagtgggaatggagggaggccaggaagctgtggtggtggagcttcagtgttcgcgggactccagggactgtcctttcctgatatcctcacacttcctcctggatgatggcatggagactagaagacagtttgctataaagaaaacctctgaagatgcaagtgaatactttgaaaattacattgaagaactgaagaaacaaggatttctactaagagaacatttcacacctgaagcaacccaattagcatctgaacaattgcaagcattgcttttggaggaagtcatgaattcaagcactctgagccaagaggtgagcgatttagtagagatgatttgggcagaggccctgggccacctggaacacatgcttctcaagccagtgaacaggattagcctcaacgatgtgagcaaggcagaggggattctccttctagtaaaggcagcactgaaaaatggagaaacagcagagcaattgcaaaagatgatgacagagttttacagactgatacctcacaaaggcacaatgcccaaagaagtgaacctgggactattggctaagaaagcagacctctgccagctaataagagacatggttaatgtctgtgaaactaatttgtccaaacccaacccaccatccctggccaaataccgagctttgaggtgcaaaattgagcatgttgaacagaatactgaagaatttctcagggttagaaaagaggttttgcagaatcatcacagtaagagcccagtggatgtcttgcagatatttagagttggcagagtgaatgaaaccacagagtttttgagcaaacttggtaatgtgaggcccttgttgcatggttctcctgtacaaaacatcgtgggaatcttgtgtcgagggttgcttttacccaaagtagtggaagatcgtggtgtgcaaagaacagacgtcggaaaccttggaagtgggatttatttcagtgattcgctcagtacaagtatcaagtactcacacccgggagagacagatggcaccagactcctgctcatttgtgacgtagccctcggaaagtgtatggacttacatgagaaggacttttccttaactgaagcaccaccaggctacgacagtgtgcatggagtttcgcaaacagcctctgtcaccacagactttgaggatgatgaatttgttgtctataaaaccaatcaggttaaaatgaaatatattattaaattttccatgcctggagatcagataaaggactttcatcctagtgatcatactgaattagaggaatacagacctgagttttcaaatttttcaaaggttgaagattaccagttaccagatgccaaaacttccagcagcaccaaggccggcctccaggatgcctctgggaacttggttcctctggaggatgtccacatcaaagggagaatcatagacactgtagcccaggtcattgtttttcagacatacacaaataaaagtcacgtgcccattgaggcaaaatatatctttcctttggatgacaaggccgctgtgtgtggcttcgaagccttcatcaatgggaagcacatagttggagagattaaagagaaggaagaagcccagcaagagtacctagaagccgtgacccagggccatggcgcttacctgatgagtcaggatgctccggacgtttttactgtaagtgttggaaacttaccccctaaggctaaggttcttataaaaattacctacatcacagaactcagcatcctgggcactgttggtgtctttttcatgcccgccaccgtagcaccctggcaacaggacaaggctttgaatgaaaaccttcaggatacagtagagaagatttgtataaaagaaataggaacaaagcaaagcttctctttgactatgtctattgagatgccgtatgtgattgaattcattttcagtgatacacatgaactgaaacaaaagcgcacagactgcaaagctgtcattagcaccatggaaggcagctccttagacagcagtggattttctctccacatcggtttgtctgctgcctatctcccaagaatgtgggttgaaaaacatccagaaaaagaaagcgaggcttgcatgcttgtctttcaacccgatctcgatgtcgacctccctgacctagccagtgagagcgaagtgattatttgtcttgactgctccagttccatggagggtgtgacattcttgcaagccaagcaaatcgccttgcatgcgctgtccttggtgggtgagaagcagaaagtaaatattatccagttcggcacaggttacaaggagctattttcgtatcctaagcatatcacaagcaataccatggcagcagagttcatcatgtctgccacacctaccatggggaacacagacttctggaaaacactccgatatcttagcttattgtaccctgctcgagggtcacggaacatcctcctggtgtctgatgggcacctccaggatgagagcctgacattacagctcgtgaagaggagccgcccgcacaccaggttattcgcctgcggtatcggttctacagcaaatcgtcacgtcttaaggattttgtcccagtgtggtgccggagtatttgaatattttaatgcaaaatccaagcatagttggagaaaacagatagaagaccaaatgaccaggctatgttctccgagttgccactctgtctccgtcaaatggcagcaactcaatccagatgtgcccgaggccctgcaggccccagcccaggtgccgtccttgtttctcaatgatcgactccttgtctatggattcattcctcactgcacacaggcaactctgtgtgcactaattcaagagaaagaatttcgtacaatggtgtcgactactgagcttcagaagacaactggaactatgatccacaagctggcagcccgagctctaatcagagattatgaagatggcattcttcacgaaaatgaaaccagtcatgagatgaaaaaacaaaccttgaaatctctgattattaaactcagtaaagaaaactctctcataacacaatttacaagctttgtggcagttgagaaaagggatgagaatgagtcgccttttcctgatattccaaaagtttctgaacttattgccaaagaagatgtagacttcctgccctacatgagctggcagggggagccccaagaagccgtcaggaaccagtctcttttagcatcctctgagtggccagaattacgtttatccaaacgaaaacataggaaaattccattttccaaaagaaaaatggaattatctcagccagaagtttctgaagattttgaagaggatggcttaggtgtactaccagctttcacatcaaatttggaacgtggaggtgtggaaaagctattggatttaagttggacagagtcatgtaaaccaacagcaactgaaccactatttaagaaagtcagtccatgggaaacatctacttctagcttttttcctattttggctccggccgttggttcctatcttcccccgactgcccgcgctcacagtcctgcttccttgtcttttgcctcatatcgtcaggtagctagtttcggttcagctgctcctcccagacagtttgatgcatctcaattcagccaaggccctgtgcctggcacttgtgctgactggatcccacagtcggcgtcttgtcccacaggacctccccagaacccaccttcttcaccctattgtggcattgttttttcagggagctcattaagctctgcacagtctgctccactgcaacatcctggaggctttactaccaggccttctgctggcaccttccctgagctggattctccccagcttcatttctctcttcctacagaccctgatcccatcagaggttttgggtcttatcatccctctgcttcctctccttttcattttcaaccttccgcagcctctttgactgccaaccttaggctgccaatggcctctgctttacctgaggctctttgcagtcagtcccggactaccccagtagatctctgtcttctagaagaatcagtaggcagtctcgaaggaagtcgatgtcctgtctttgcttttcaaagttctgacacagaaagtgatgagctatcagaagtacttcaagacagctgctttttacaaataaaatgtgatacaaaagatgacagtatcctgtgctttctggaagtaaaagaagaggatgaaatagtgtgcatacaacactggcaggatgctgtgccttggacagaactcctcagtctacagacagaggatggcttctggaaacttacaccagaactgggacttatattaaatcttaatacaaatggtttgcacagctttcttaaacaaaaaggcattcaatctctaggtgtaaaaggaagagaatgtctcctggacctaattgccacaatgctggtactacagtttattcgcaccaggttggaaaaagagggaatagtgttcaaatcactgatgaaaatggatgacgcttctatttccaggaatattccctgggcttttgaggcaataaagcaagcaagtgaatgggtaagaagaactgaaggacagtacccatctatctgcccacggcttgaactggggaacgactgggactctgccaccaagcagttgctgggactccagcccataagcactgtgtcccctcttcatagagtcctccattacagtcaaggctaagtcaaatgaaactgaattttaaactttttgcatgcttctatgtagaaaataatcaaatgataatagatacttataatgaaacttcattaaggtttcattcagtgtagcaattactgtctttaaaaattaagtggaagaagaattactttaatcaactaacaagcaataataaaatgaaacttaaaatatttca

SEQ ID NO: 3221 - DNA, 3485 bp, Homo sapiens
cgtagtgcggtccgggtaggagagagcagggggccacgctggctccatctacgcacgtttcggaaaccgggcccggaggggaccacgcccgctcacccgtgcccggcgtcccccggagctggggctagaggagccgggccggccgcagcgggaagaggccacaggcggccgcgcacgtggggggtggttagcgcggaggaacccggaagccctttgcaccgcccaccgccgcggtgacgggttaacgctcctcctggtggaggcaggggcgggcggggcggaaggcggggacgcctcagccaacacccccgaggaccgcccgcgagccgtcctccccacccccacggacgcgacgcagcgcgggctccgcttccccggccgcggcgcctgcgcaaaagccccgccccttcgcccgagccccacccccacaccgcagcctccaccgccgccacctctcccttcctctctgctctttcctcctgttttctcttccctcctccccctggcctccgcgtctcctcctactccggcgctgacgctcgcgtaggggccctggcgtcagacgcgcgggggcggggcgagtgcggcgcggggtataagtagagggtgcaggaggcggtgcttccccttctccccggcggttagtgctgagagtgcggagtgtgtgctccgggctcggaacacacatttattattaaaaaatccaaaaaaaatctaaaaaaatcttttaaaaaaccccaaaaaaatttacaaaaaatccgcgtctcccccgccggagacttttattttttttcttcctcttttataaaataacccggtgaagcagccgagaccgacccgcccgcccgcggccccgcagcagctccaagaaggaaccaagagaccgaggccttcccgctgcccggacccgacaccgccaccctcgctccccgccggcagccggcagccagcggcagtggatcgaccccgttctgcggccgttgagtagttttcaattccggttgatttttgtccctctgcgcttgctccccgctcccctccccccggctccggcccccagccccggcactcgctctcctcctctcacggaaaggtcgcggcctgtggccctgcgggcagccgtgccgagatgaaccccagtgcccccagctaccccatggcctcgctctacgtgggggacctccaccccgacgtgaccgaggcgatgctctacgagaagttcagcccggccgggcccatcctctccatccgggtctgcagggacatgatcacccgccgctccttgggctacgcgtatgtgaacttccagcagccggcggacgcggagcgtgctttggacaccatgaattttgatgttataaagggcaagccagtacgcatcatgtggtctcagcgtgatccatcacttcgcaaaagtggagtaggcaacatattcattaaaaatctggacaaatccattgataataaagcactgtatgatacattttctgcttttggtaacatcctttcatgtaaggtggtttgtgatgaaaatggttccaagggctatggatttgtacactttgagacgcaggaagcagctgaaagagctattgaaaaaatgaatggaatgctcctaaatgatcgcaaagtatttgttggacgatttaagtctcgtaaagaacgagaagctgaacttggagctagggcaaaagaattcaccaatgtttacatcaagaattttggagaagacatggatgatgagcgccttaaggatctctttggcaagtttgggcctgccttaagtgtgaaagtaatgactgatgaaagtggaaaatccaaaggatttggatttgtaagctttgaaaggcatgaagatgcacagaaagctgtggatgagatgaacggaaaggagctcaatggaaaacaaatttatgttggtcgagctcagaaaaaggtggaacggcagacggaacttaagcgcaaatttgaacagatgaaacaagataggatcaccagataccagggtgttaatctttatgtgaaaaatcttgatgatggtattgatgatgaacgtctccggaaagagttttctccatttggtacaatcactagtgcaaaggttatgatggagggtggtcgcagcaaagggtttggttttgtatgtttctcctccccagaagaagccactaaagcagttacagaaatgaacggtagaattgtggccacaaagccattgtatgtagctttagctcagcgcaaagaagagcgccaggctcacctcactaaccagtatatgcagagaatggcaagtgtacgagctgttcccaaccctgtaatcaacccctaccagccagcacctccttcaggttacttcatggcagctatcccacagactcagaaccgtgctgcatactatcctcctagccaaattgctcaactaagaccaagtcctcgctggactgctcagggtgccagacctcatccattccaaaatatgcccggtgctatccgcccagctgctcctagaccaccatttagtactatgagaccagcttcttcacaggttccacgagtcatgtcaacacagcgtgttgctaacacatcaacacagacaatgggtccacgtcctgcagctgcagccgctgcagctactcctgctgtccgcaccgttccacagtataaatatgctgcaggagttcgcaatcctcagcaacatcttaatgcacagccacaagttacaatgcaacagcctgctgttcatgtacaaggtcaggaacctttgactgcttccatgttggcatctgcccctcctcaagagcaaaagcaaatgttgggtgaacggctgtttcctcttattcaagccatgcaccctactcttgctggtaaaatcactggcatgttgttggagattgataattcagaacttcttcatatgctcgagtctccagagtcactccgttctaaggttgatgaagctgtagctgtactacaagcccaccaagctaaagaggctgcccagaaagcagttaacagtgccaccggtgttccaactgtttaaaattgatcagggaccatgaaaagaaacttgtgcttcaccgaagaaaaatatctaaacatcgaaaaacttaaatattatggaaaaaaaacattgcaaaatataaaataaataaaaaaaggaaaggaaactttgaaccttatgtaccgagcaaatgccaggtctagcaaacataatgctagtcctagattacttattgatttaaaaacaaaaaaacacaaaaaaatagtaaaatataaaaacaaattaatgttttatagaccctgggaaaaagaattttcagcaaagtacaaaaatttaaagcattcctttctttaattttgtaattctttactgtggaatagctcagaatgtcagttctgttttaagtaacagaattgataactgagcaaggaaacgtaatttggattataaaattcttgctttaataaaaattccttaaacagtg

SEQ ID NO: 3222 - DNA, 2593 bp, Homo sapiens
cccttctccccggcggttagtgctgagagtgcggagtgtgtgctccgggctcggaacacacatttattattaaaaaatccaaaaaaaatctaaaaaaatcttttaaaaaaccccaaaaaaatttacaaaaaatccgcgtctcccccgccggagacttttattttttttcttcctcttttataaaataacccggtgaagcagccgagaccgacccgcccgcccgcggccccgcagcagctccaagaaggaaccaagagaccgaggccttcccgctgcccggacccgacaccgccaccctcgctccccgccggcagccggcagccagcggcagtggatcgaccccgttctgcggccgttgagtagttttcaattccggttgatttttgtccctctgcgcttgctccccgctcccctccccccggctccggcccccagccccggcactcgctctcctcctctcacggaaaggtcgcggcctgtggccctgcgggcagccgtgccgagatgaaccccagtgcccccagctaccccatggcctcgctctacgtgggggacctccaccccgacgtgaccgaggcgatgctctacgagaagttcagcccggccgggcccatcctctccatccgggtctgcagggacatgatcacccgccgctccttgggctacgcgtatgtgaacttccagcagccggcggacgcggagcgtgctttggacaccatgaattttgatgttataaagggcaagccagtacgcatcatgtggtctcagcgtgatccatcacttcgcaaaagtggagtaggcaacatattcattaaaaatctggacaaatccattgataataaagcactgtatgatacattttctgcttttggtaacatcctttcatgtaaggtggtttgtgatgaaaatggttccaagggctatggatttgtacactttgagacgcaggaagcagctgaaagagctattgaaaaaatgaatggaatgctcctaaatgatcgcaaagtatttgttggacgatttaagtctcgtaaagaacgagaagctgaacttggagctagggcaaaagaattcaccaatgtttacatcaagaattttggagaagacatggatgatgagcgccttaaggatctctttggcaagtttgggcctgccttaagtgtgaaagtaatgactgatgaaagtggaaaatccaaaggatttggatttgtaagctttgaaaggcatgaagatgcacagaaagctgtggatgagatgaacggaaaggagctcaatggaaaacaaatttatgttggtcgagctcagaaaaaggtggaacggcagacggaacttaagcgcaaatttgaacagatgaaacaagataggatcaccagataccagggtgttaatctttatgtgaaaaatcttgatgatggtattgatgatgaacgtctccggaaagagttttctccatttggtacaatcactagtgcaaaggttatgatggagggtggtcgcagcaaagggtttggttttgtatgtttctcctccccagaagaagccactaaagcagttacagaaatgaacggtagaattgtggccacaaagccattgtatgtagctttagctcagcgcaaagaagagcgccaggctcacctcactaaccagtatatgcagagaatggcaagtgtacgagctgttcccaaccctgtaatcaacccctaccagccagcacctccttcaggttacttcatggcagctatcccacagactcagaaccgtgctgcatactatcctcctagccaaattgctcaactaagaccaagtcctcgctggactgctcagggtgccagacctcatcctgctgttcatgtacaaggtcaggaacctttgactgcttccatgttggcatctgcccctcctcaagagcaaaagcaaatgttgggtgaacggctgtttcctcttattcaagccatgcaccctactcttgctggtaaaatcactggcatgttgttggagattgataattcagaacttcttcatatgctcgagtctccagagtcactccgttctaaggttgatgaagctgtagctgtactacaagcccaccaagctaaagaggctgcccagaaagcagttaacagtgccaccggtgttccaactgtttaaaattgatcagggaccatgaaaagaaacttgtgcttcaccgaagaaaaatatctaaacatcgaaaaacttaaatattatggaaaaaaaacattgcaaaatataaaataaataaaaaaaggaaaggaaactttgaaccttatgtaccgagcaaatgccaggtctagcaaacataatgctagtcctagattacttattgatttaaaaacaaaaaaacacaaaaaaatagtaaaatataaaaacaaattaatgttttatagaccctgggaaaaagaattttcagcaaagtacaaaaatttaaagcattcctttctttaattttgtaattctttactgtggaatagctcagaatgtcagttctgttttaagtaacagaattgataactgagcaaggaaacgtaatttggattataaaattcttgctttaataaaaattccttaaacagtg

SEQ ID NO: 3223 - DNA, 608 bp, Homo sapiens
atatgctcgagtctccagagtcactccgttctaaggttgatgaagctgtagctgtactacaagcccaccaagctaaagaggctgcccagaaagcagttaacagtgccaccggtgttccaactgtttaaaaaacaaggacattctcctccataaccatgacaccgccatgaaaacgatcagcaccgtcgaatcctcacgccccactcaagttccttgattgcttcaataatgtcctccgtagcaaaaggatctagttcaaaatcgggagttacatttcattgtcatgcctaaaacgtaagaattgctcattcactttggagcagttcttcagtctatccttgattttcatgaccttgacacttttgaacattatagaccagttattcaatagaatatctttcaatctgggtttgtccgatacctctttattattagattgaaatgatacattttggtggaactatcacagaattgacattgcattcttctcattacatcctgtctggtggcctgtgattctgttttatctcattaccaatggcgtttgttttgagcatttgattaagttgttatctgccactataaagttgctatttttctctttataa

SEQ ID NO: 3224 - DNA, 453 bp, Homo sapiens
cccttctccccggcggttagtgctgagagtgcggaccgagaccgacccgcccgcccgcggccccgcagcagctccaagaaggaaccaagagaccgaggccttcccgctgcccggacccgacaccgccaccctcgctccccgccggcagccggcagccagcggcagtggatcgaccccgttctgcggccgttgagtagttttcaattccggttgatttttgtccctctgcgcttgctccccgctcccctccccccggctccggcccccagccccggcactcgctctcctcctctcacggaaaggtcgcggcctgtggccctgcgggcagccgtgccgagatgaaccccagtgcccccagctaccccatggcctcgctctacgtgggggacctccaccccgacgtgaccgaggcgatgctctacgagaagttcagcccggccgggcccatcctct

SEQ ID NO: 3225 - DNA, 754 bp, Homo sapiens
gcttccccttctccccggcggttagtgctgagagtgcggagtgtgtgctccgggctcggaacacacatttattattaaaaaatccaaaaaaaatctaaaaaaatcttttaaaaaaccccaaaaaaatttacaaaaaatccgcgtctcccccgccggagacttttattttttttcttcctcttttataaaataacccggtgaagcagccgagaccgacccgcccgcccgcggccccgcagcagctccaagaaggaaccaagagaccgaggccttcccgctgcccggacccgacaccgccaccctcgctccccgccggcagccggcagccagcggcagtggatcgaccccgttctgcggccgttgagtcgcggcctgtggccctgcgggcagccgtgccgagatgaaccccagtgcccccagctaccccatggcctcgctctacgtgggggacctccaccccgacgtgaccgaggcgatgctctacgagaagttcagcccggccgggcccatcctctccatccgggtctgcagggacatgatcacccgccgctccttgggctacgcgtatgtgaacttccagcagccggcggacgcggagcgtgctttggacaccatgaattttgatgttataaagggcaagccagtacgcatcatgtggtctcagcgtgatccatcacttcgcaaaagtggagtaggcaacatattcattaaaaatctggacaaatccattgataataaagcactgtatgataca

SEQ ID NO: 3226 - DNA, 493 bp, Homo sapiens
ttctgcggccgacgcgcgtggcggcggtgccggctgggactcgtagtgcggtccggcagccgagaccgacccgcccgcccgcggccccgcagcagctccaagaaggaaccaagagaccgaggccttcccgctgcccggacccgacaccgccaccctcgctccccgccggcagccggcagccagcggcagtggatcgaccccgttctgcggccgttgagtagttttcaattccggttgatttttgtccctctgcgcttgctccccgctcccctccccccggctccggcccccagccccggcactcgctctcctcctctcacggaaaggtcgcggcctgtggccctgcgggcagccgtgccgagatgaaccccagtgcccccagctaccccatggcctcgctctacgtgggggacctccaccccgacgtgaccgaggcgatgctctacgagaagttcagcccggccgggcccatcctctccatccgggtctgcag

SEQ ID NO: 3227 - DNA, 971 bp, Homo sapiens
cagcttcttcacaggttccacgagtcatgtcaacacagcgtgttgctaacacatcaacacagacaatgggtccacgtcctgcagctgcagccgctgcagctactcctgctgtccgcaccgttccacagtataaatatgctgcaggagttcgcaatcctcagcaacatcttaatgcacagccacaagttacaatgcaacagcctgctgttcatgtacaaggtcaggaacctttgactgcttccatgttggcatctgcccctcctcaagagcaaaagcaaatgttgggtgaacggctgtttcctcttattcaagccatgcaccctactcttgctggtaaaatcactggcatgttgttggagattgataattcagaacttcttcatatgctcgagtctccagagtcactccgttctaaggttgatgaagctgtagctgtactacaagcccaccaagctaaagaggctgcccagaaagcagttaacagtgccaccggtgttccaactgtttaaagtgagcttttccctctgattgatcagggaccatgaaaagaaacttgtgcttcaccgaagaaaaatatctaaacatcgaaaaacttaaatattatggaaaaaaaacattgcaaaatataaaataaataaaaaaaggaaaggaaactttgaaccttatgtaccgagcaaatgccaggtctagcaaacataatgctagtcctagattacttattgatttaaaaacaaaaaaacacaaaaaaatagtaaaatataaaaacaaattaatgttttatagaccctgggaaaaagaattttcagcaaagtacaaaaatttaaagcattcctttctttaattttgtaattctttactgtggaatagctcagaatgtcagttctgttttaagtaacagaattgataactgagcaaggaaacgtaatttggattataaaattcttgctttaataaaaattccttaaacagtg

SEQ ID NO: 3228 - DNA, 492 bp, Homo sapiens
gttggtgtcagcgagcgccgcggccgttggggactccagctcccagcaggcaccgcttctgcggccgacgcgcgtggcggcggtgccggctgggactcgtagtgcggtccggcagccgagaccgacccgcccgcccgcggccccgcagcagctccaagaaggaaccaagagaccgaggccttcccgctgcccggacccgacaccgccaccctcgctccccgccggcagccggcagccagcggcagtggatcgaccccgttctgcggccgttgagtcgcggcctgtggccctgcgggcagccgtgccgagatgaaccccagtgcccccagctaccccatggcctcgctctacgtgggggacctccaccccgacgtgaccgaggcgatgctctacgagaagttcagcccggccgggcccatcctctccatccgggtctgcagggacatgatcacccgccgctccttgggctacgcgtatgtgaacttccagcag

SEQ ID NO: 3229 - DNA, 628 bp, Homo sapiens
gcggccgacgcgcgtggcggcggtgccggctgggactcgtagtgcggtccggccgagaccgacccgcccgcccgcggccccgcagcagctccaagaaggaaccaagagaccgaggccttcccgctgcccggacccgacaccgccaccctcgctccccgccggcagccggcagccagcggcagtggatcgaccccgttctgcggccgtcgcggcctgtggccctgcgggcagccgtgccgagatgaaccccagtgcccccagctaccccatggcctcgctctacgtgggggacctccaccccgacgtgaccgaggcgatgctctacgagaagttcagcccggccgggcccatcctctccatccgggtctgcagggacatgatcacccgccgctccttgggctacgcgtatgtgaacttccagcagccggcggacgcggagcgtgctttggacaccatgaattttgatgttataaagggcaagccagtacgcatcatgtggtctcagcgtgatccatcacttcgcaaaagtggagtaggcaacatattcattaaaaatctggacaaatccattgataataaagcactgtatgatacattttctgcttttggtaacatcctttcatgtaag

SEQ ID NO: 3230 - DNA, 736 bp, Homo sapiens
atccgcccagctgctcctagaccaccatttagtactatgagaccagcttcttcacaggttccacgagtcatgtcaacacagcgtgttgctaacacatcaacacagacaatgggtccacgtcctgcagctgcagccgctgcagctactcctgctgtccgcaccgttccacagtataaatatgctgcaggagttcgcaatcctcagcaacatcttaatgcacagccacaagttacaatgcaacagcctgctgttcatgtacaaggtcaggaacctttgactgcttccatgttggcatctgcccctcctcaagagcaaaagcaaatgttgggtgaacggctgtttcctcttattcaagccatgcaccctactcttgctggtaaaatcactggcatgttgttggagattgataattcagaacttcttcatatgctcgagtctccagagtcactccgttctaaggttgatgaagctgtagctgtactacaagcccaccaagctaaagaggctgcccagaaagcagttaacagtgccaccggtgttccaactgtttaaagtgagcttttccctctggtttgttgttttaagcttgttttcttcatcttttataaagtttgttgagcatattttgaaatgtacatagcaaaagatcattttacagttcatttaaatgtattgctaatttttcaaggaaaagtggaactaactatagaggaattaaaggaattttacccgttaa

SEQ ID NO: 3231 - DNA, 593 bp, Homo sapiens
aggcaccgcttctgcggccgacgcgcgtggcggcggtgccggctgggactcgtagtgcggtccggccgagaccgacccgcccgcccgcggccccgcagcagctccaagaaggaaccaagagaccgaggccttcccgctgcccggacccgacaccgccaccctcgctccccgccggcagccggcagccagcggcagtggatcgaccccgttctgcggccgttgagtagttttcaattccggttgatttttgtccctctgcgcttgctccccgctcccctccccccggctccggcccccagccccggcactcgctctcctcctctcacggaaaggtcgcggcctgtggccctgcgggcagccgtgccgagatgaaccccagtgcccccagctaccccatggcctcgctctacgtgggggacctccaccccgacgtgaccgaggcgatgctctacgagaagttcagcccggccgggcccatcctctccatccgggtctgcagggacatgatcacccgccgctccttgggctacgcgtatgtgaacttccagcagccggcggacgcggagcgtgctttggacaccatgaattttgat

SEQ ID NO: 3232 - DNA, 1329 bp, Homo sapiens
aacaagcgccgtgcgccccgccccccatcgggggcaaccattgttccgccggtcgcgccggagctgggttgctcctgctcccgtctccaagtcctggtacctccttcaagctgggagagggctctagtccctggttctgaacactctggggttctcgggtgcaggccgccatgagcaaacggaaggcgccgcaggagactctcaacgggggaatcaccgacatgctcacagaactcgcaaactttgagaagaacgtgagccaagctatccacaagtacaatgcttacagaaaagcagcatctgttatagcaaaatacccacacaaaataaagagtggagctgaagctaagaaattgcctggagtaggaacaaaaattgctgaaaagattgatgagtttttagcaactggaaaattacgtaaactggaaaagattcggcaggatgatacgagttcatccatcaatttcctgactcgagttagtggcattggtccatctgctgcaaggaagtttgtagatgaaggaattaaaacactagaagatctcagaaaaaatgaagataaattgaaccatcatcagcgaattgggctgaaatattttggggactttgaaaaaagaattcctcgtgaagagatgttacaaatgcaagatattgtactaaatgaagttaaaaaagtggattctgaatacattgctacagtctgtggcagtttcagaagaggtgcagagtccagtggtgacatggatgttctcctgacccatcccagcttcacttcagaatcaaccaaacagccaaaactgttacatcaggttgtggagcagttacaaaaggttcattttatcacagataccctgtcaaagggtgagacaaagttcatgggtgtttgccagcttcccagtaaaaatgatgaaaaagaatatccacacagaagaattgatatcaggttgatacccaaagatcagtattactgtggtgttctctatttcactgggagtgatattttcaataagaatatgagggctcatgccctagaaaagggtttcacaatcaatgagtacaccatccgtcccttgggagtcactggagttgcaggagaacccctgccagtggatagtgaaaaagacatctttgattacatccagtggaaataccgggaacccaaggaccggagcgaatgaggcctgtatcctccctggcagacacaacccaataggagtcttaatttatttcttaacctttgctatgtaagggtctttggtgtttttaaatgattgtttcttcttcatgcttttgcttgcaatgtagtcaataaaacctcatgtactatta

SEQ ID NO: 3233 - DNA, 744 bp, Homo sapiens
ttggggactttgaaaaaagaattcctcgtgaagagatgttacaaatgcaagatattgtactaaatgaagttaaaaaagtggattctgaatacattgctacagtctgtggcagtttcagaagaggtgcagagtccagtggtgacatggatgttctcctgacccatcccagcttcacttcagaatcaaccaaacagccaaaactgttacatcaggttgtggagcagttacaaaaggttcattttatcacagataccctgtcaaagggtgagacaaagttcatgggtgtttgccagcttcccagtaaaaatgatgaaaaagaatatccacacagaagaattgatatcaggttgatacccaaagatcagtattactgtggtgttctctatttcactgggagtgatattttcaataagaatatgagggctcatgccctagaaaagggtttcacaatcaatgagtacaccatccgtcccttgggagtcactgtccttcaggcaacgagagaggatttaatgcataacatgctcctaggccctcagttgaaggccatcaaggagttgcaggagaacccctgccagtggatagtgaaaaagacatctttgattacatccagtggaaataccgggaacccaaggaccggagcgaatgaggcctgtatcctccctggcagacacaacccaataggagtcttaatttatttcttaacctttgctatgtaagggtctttggtgtttttaaatgatt

SEQ ID NO: 3234 - DNA, 983 bp, Homo sapiens
tcgggggcaaccattgttccgccggtcgcgccggagctgggttgctcctgctcccgtctccaagtcctggtacctccttcaagctgggagagggctctagtccctggttctgaacactctggggttctcgggtgcaggccgccatgagcaaacggaaggcgccgcaggagactctcaacgggggaatcaccgacatgctcacagaactcgcaaactttgagaagaacgtgagccaagctatccacaagtacaatgcttacagaaaagcagcatctgttatagcaaaatacccacacaaaataaagagtggagctgaagctaagaaattgcctggagtaggaacaaaaattgctgaaaagattgatgagtttttagcaactggaaaattacgtaaactggaaaagattcggcaggatgatacgagttcatccatcaatttcctgactcgagttagtggcattggtccatctgctgcaaggaagtttgtagatgaaggaattaaaacactagaaggctcacagctggattcatgcccagtaaagggacacctgaatggaactgagtcacttttagacttaatatgggatgttatgacaattcttaagttaaaaaatgcagatctcagaaaaaatgaagataaattgaaccatcatcagcgaattgggctgaaatattttggggactttgaaaaaagaattcctcgtgaagagatgttacaaatgcaagatattgtactaaatgaagttaaaaaagtggattctgaatacattgctacagtctgtggcagtttcagaagaggtgcagagtccagtggtgacatggatgttctcctgacccatcccagcttcacttcagaatcaaccaaacagccaaaactgttacatcaggttgtggagcagttacaaaaggttcattttatcacagataccctgtcaaagggtgagacaaagttcatgggtgtttgccagcttcccagtaaaaat

SEQ ID NO: 3235 - DNA, 863 bp, Homo sapiens
tgaaaagattgatgagtttttagcaactggaaaattacgtaaactggaaaagattcggcaggatgatacgagttcatccatcaatttcctgactcgagttagtggcattggtccatctgctgcaaggaagtttgtagatgaaggaattaaaacactagaagatctcagaaaaaatgaagataaattgaaccatcatcagcgaattgggctgaaatattttggggactttgaaaaaagaattcctcgtgaagagatgttacaaatgcaagatattgtactaaatgaagttaaaaaagtggattctgaatacattgctacagtctgtggcagtttcagaagaggtgcagagtccagtggtgacatggatgttctcctgacccatcccagcttcacttcagaatcaaccaaacagggtgtttgccagcttcccagtaaaaatgatgaaaaagaatatccacacagaagaattgatatcaggttgatacccaaagatcagtattactgtggtgttctctatttcactgggagtgatattttcaataagaatatgagggctcatgccctagaaaagggtttcacaatcaatgagtacaccatccgtcccttgggagtcactggagttgcaggagaacccctgccagtggatagtgaaaaagacatctttgattacatccagtggaaataccgggaacccaaggaccggagcgaatgaggcctgtatcctccctggcagacacaacccaataggagtcttaatttatttcttaacctttgctatgtaagggtctttggtgtttttaaatgattgtttcttcttcatgcttttgcttgcaatgtagtcaataaaacctcatgtactatta

SEQ ID NO: 3236 - DNA, 1048 bp, Homo sapiens
attgttccgccggtcgcgccggagctgggttgctcctgctcccgtctccaagtcctggtacctccttcaagctgggagagggctctagtccctggttctgaacactctggggttctcgggtgcaggccgccatgagcaaacggaaggcgccgcaggagactctcaacgggggaatcaccgacatgctcacagaaaagcagcatctgttatagcaaaatacccacacaaaataaagagtggagctgaagctaagaaattgatctcagaaaaaatgaagataaattgaaccatcatcagcgaattgggctgaaatattttggggactttgaaaaaagaattcctcgtgaagagatgttacaaatgcaagatattgtactaaatgaagttaaaaaagtggattctgaatacattgctacagtctgtggcagtttcagaagaggtgcagagtccagtggtgacatggatgttctcctgacccatcccagcttcacttcagaatcaaccaaacagccaaaactgttacatcaggttgtggagcagttacaaaaggttcattttatcacagataccctgtcaaagggtgagacaaagttcatgggtgtttgccagcttcccagtaaaaatgatgaaaaagaatatccacacagaagaattgatatcaggttgatacccaaagatcagtattactgtggtgttctctatttcactgggagtgatattttcaataagaatatgagggctcatgccctagaaaagggtttcacaatcaatgagtacaccatccgtcccttgggagtcactggagttgcaggagaacccctgccagtggatagtgaaaaagacatctttgattacatccagtggaaataccgggaacccaaggaccggagcgaatgaggcctgtatcctccctggcagacacaacccaataggagtcttaatttatttcttaacctttgctatgtaagggtctttggtgtttttaaatgattgtttcttcttcatgcttttgcttgcaatgtagtcaataaaacctcatgtactatta

SEQ ID NO: 3237 - DNA, 2670 bp, Homo sapiens
ctgctggtaagtggtctattcctgcccacccccgggtgactagcttggccagtagtcgaccccacccggggaccgactctgggggttggagagactcttggggccggggtcgggcactccagctttcttctagccccgagctgggattccctggcctgcgccagctgcgtacacggcgagtacaccgcacctgcccgggacttcacccgcagctgcgagactcctccattcccggagggctccccacacctgctgcggccgtgccccatctccccgcagctgcggcgctgagcacccccatgtcgagaggctgagaccaggacagcagccctgaccaacgctccaataggccgggatccagccatacttcaatggatcccaggggtatcttgaaggcatttcccaagcggcagaaaattcatgctgatgcatcatcaaaagtacttgcaaagattcctaggagggaagagggagaagaagcagaagagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccgggtgctcagctggtgaagtcagcctggctgagcttgtgccttcaggagaggaggctggtggatgtagctggattcagcatcttcatccccagtaggtacttggaccatccacagcccagcaaggcagagcaggatgcttctattcctcctggcacccatgaggccctgcttcagacagccctttctcctcctcctcctcccaccaggcctgtgtctcctccccaaaaggcaaaagaggcaccaaacacccaagcccagcccatctctgatgatgaagccagtgatggggaagaaacccaggttagtgcagctgatctggaagccctcatcagtggccactaccccacctcccttgagggagattgtgagcctagcccagcccctgctgtcctggataagtgggtctgtgcacagccctcaagccagaaggcgaccaatcacaacctccatatcacagagaagctggaagttctggccaaagcctacagtgttcagggagacaagtggagggccctgggctatgccaaggccatcaatgccctcaagagcttccataagcctgtcacctcgtaccaggaggcctgcagtatccctgggattgggaagcggatggctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgctctacttcaccggctctgcacacttcaaccgctccatgcgagccctggccaaaaccaagggcatgagtctgtcagaacatgccctcagcactgctgtggtccggaacacccatggctgcaaggtggggcctggccgagtgctgcccactcccactgagaaggatgtcttcaggctcttaggcctcccctaccgagaacctgctgagcgggactggtgacccatggctgggggtgctgaggagagccgagttggactggctacccctcctggccacccagtactccctccagcctcagctggctgaacctcgccgctccaaccaccagcttcctcagcgagcagggcccagggctctgggcctgaagcaagagccagcccggctcccagtgtctgcccggctcccagtgtctgcccagccctctcccagacaggagcaggctgccaccccttctacctcaccactgcccctcgaagaattttgcaaatggccccttgccccattttaagcaggagcaggtggctggtttgaagccccaggtatcccccttccctgctatgggaaaggccaagctgctgggtggggacagaagctgcaggggagagggaagcagccgtgctgtcaacatcatccggcaccctctggggtaggagaacagccattccacatgtgttccctctatccgtcctgcttcctgggcagctggtggtgctgggaatggggtgccccagccttggtgaggacagtgttgggaggcccaggggcccagtaaagtgcatttgacattgaa

SEQ ID NO: 3238 - DNA, 2289 bp, Homo sapiens
ggttggagagactcttggggccggggtcgggcactccagctttcttctagccccgagctgggattccctggcctgcgccagctgcgtacacggcgagtacaccgcacctgcccgggacttcacccgcagctgcgagactcctccattcccggagggctccccacacctgctgcggccgtgccccatctccccgcagctgcggcgctgagcacccccatgtcgagaggctgagaccaggacaggtgcagggcgttcccactcacccccgaaagtcctcctccttcctctgcgagtctgtgttggaggtagagaaatagtatgtggggtttatgtgcaggtcctccccaggctccgctccatcccctaaagctccatttcctagcccagcatcccatttggtaaagcccttcgaagtgggccgcagcagggctgtgctgaatctttagcgcaacccctctgaggaatggtgtcgtttcctactcctcaaaagtacccccgatggcaccagccttcccctcatttcccgtaatactccaacttcgaaaggctggggagtgtgaagctaggctaaaccactgaagtttaaccgggtttgaagagaccccctcccccgacccgcttccccaaactgggctgctacccccaaagcctggtcaggaaagaccctacctccataggcaaaggggttggagggcctcaattctggatttccacgtgcagcagccctgaccaacgctccaataggccgggatccagccatacttcaatggatcccaggggtatcttgaaggcatttcccaagcggcagaaaattcatgctgatgcatcatcaaaagtacttgcaaagattcctaggagggaagagggagaagaagcagaaggaggcctgcagtatccctgggattgggaagcggatggctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgctctacttcaccggctctgcacacttcaaccgctccatgcgagccctggccaaaaccaagggcatgagtctgtcagaacatgccctcagcactgctgtggtccggaacacccatggctgcaaggtggggcctggccgagtgctgcccactcccactgagaaggatgtcttcaggctcttaggcctcccctaccgagaacctgctgagcgggactggtgacccatggctgggggtgctgaggagagccgagttggactggctacccctcctggccacccagtactccctccagcctcagctggctgaacctcgccgctccaaccaccagcttcctcagcgagcagggcccagggctctgggcctgaagcaagagccagcccggctcccagtgtctgcccggctcccagtgtctgcccagccctctcccagacaggagcaggctgccaccccttctacctcaccactgcccctcgaagaattttgcaaatggccccttgccccattttaagcaggagcaggtggctggtttgaagccccaggtatcccccttccctgctatgggaaaggccaagctgctgggtggggacagaagctgcaggggagagggaagcagccgtgctgtcaacatcatccggcaccctctggggtaggagaacagccattccacatgtgttccctctatccgtcctgcttcctgggcagctggtggtgctgggaatggggtgccccagccttggtgaggacagtgttgggaggcccaggggcccagtaaagtgcatttgacattgaa

SEQ ID NO: 3239 - DNA, 2278 bp, Homo sapiens
attctggccatttgccctccttccccccttcgtccgctctcattggctctgctgcagccctgaccaacgctccaataggccgggatccagccatacttcaatggatcccaggggtatcttgaaggcatttcccaagcggcagaaaattcatgctgatgcatcatcaaaagtacttgcaaagattcctaggagggaagagggagaagaagcagaagagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccgggtgctcagctggtgaagtcagcctggctgagcttgtgccttcaggagaggaggctggtggatgtagctggattcagcatcttcatccccagtaggtacttggaccatccacagcccagcaaggcagagcaggatgcttctattcctcctggcacccatgaggccctgcttcagacagccctttctcctcctcctcctcccaccaggcctgtgtctcctccccaaaaggcaaaagaggcaccaaacacccaagcccagcccatctctgatgatgaagccagtgatggggaagaaacccaggttagtgcagctgatctggaagccctcatcagtggccactaccccacctcccttgagggagattgtgagcctagcccagcccctgctgtcctggataagtgggtctgtgcacagccctcaagccagaaggcgaccaatcacaacctccatatcacagagaagctggaagttctggccaaagcctacagtgttcagggagacaagtggagggccctgggctatgccaaggccatcaatgccctcaagagcttccataagcctgtcacctcgtaccaggaggcctgcagtatccctgggattgggaagcggatggctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgcaaggtggggcctggccgagtgctgcccactcccactgagaaggatgtcttcaggctcttaggcctcccctaccgagaacctgctgagcgggactggtgacccatggctgggggtgctgaggagagccgagttggactggctacccctcctggccacccagtactccctccagcctcagctggctgaacctcgccgctccaaccaccagcttcctcagcgagcagggcccagggctctgggcctgaagcaagagccagcccggctcccagtgtctgcccggctcccagtgtctgcccagccctctcccagacaggagcaggctgccaccccttctacctcaccactgcccctcgaagaattttgcaaatggccccttgccccattttaagcaggagcaggtggctggtttgaagccccaggtatcccccttccctgctatgggaaaggccaagctgctgggtggggacagaagctgcaggggagagggaagcagccgtgctgtcaacatcatccggcaccctctggggtaggagaacagccattccacatgtgttccctctatccgtcctgcttcctgggcagctggtggtgctgggaatggggtgccccagccttggtgaggacagtgttgggaggcccaggggcccagtaaagtgcatttgacattg

SEQ ID NO: 3240 - DNA, 2287 bp, Homo sapiens
ggttggagagactcttggggccggggtcgggcactccagctttcttctagccccgagctgggattccctggcctgcgccagctgcgtacacggcgagtacaccgcacctgcccgggacttcacccgcagctgcgagactcctccattcccggagggctccccacacctgctgcggccgtgccccatctccccgcagctgcggcgctgagcacccccatgtcgagaggctgagaccaggacaggtgcagggcgttcccactcacccccgaaagtcctcctccttcctctgcgagtctgtgttggaggtagagaaatagtatgtggggtttatgtgcaggtcctccccaggctccgctccatcccctaaagctccatttcctagcccagcatcccatttggtaaagcccttcgaagtgggccgcagcagggctgtgctgaatctttagcgcaacccctctgaggaatggtgtcgtttcctactcctcaaaagtacccccgatggcaccagccttcccctcatttcccgtaatactccaacttcgaaaggctggggagtgtgaagctaggctaaaccactgaagtttaaccgggtttgaagagaccccctcccccgacccgcttccccaaactgggctgctacccccaaagcctggtcaggaaagaccctacctccataggcaaaggggttggagggcctcaattctggatttccacgtgcagcagccctgaccaacgctccaataggccgggatccagccatacttcaatggatcccaggggtatcttgaaggcatttcccaagcggcagaaaattcatgctgatgcatcatcaaaagtacttgcaaagattcctaggagggaagagggagaagaagcagaaggaggcctgcagtatccctgggattgggaagcggatggctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgctctacttcaccggctctgcacacttcaaccgctccatgcgagccctggccaaaaccaagggcatgagtctgtcagaacatgccctcagcactgctgtggtccggaacacccatggctgcaaggtggggcctggccgagtgctgcccactcccactgagaaggatgtcttcaggctcttaggcctcccctaccgagaacctgctgagcgggactggtgacccatggctgggggtgctgaggagagccgagttggactggctacccctcctggccacccagtactccctccagcctcagctggctgaacctcgccgctccaaccaccagcttcctcagcgagcagggcccagggctctgggcctgaagcaagagccagcccggctcccagtgtctgcccggctcccagtgtctgcccagccctctcccagacaggagcaggctgccaccccttctacctcaccactgcccctcgaagaattttgcaaatggccccttgccccattttaagcaggagcaggtggctggtttgaagccccaggtatcccccttccctgctatgggaaaggccaagctgctgggtggggacagaagctgcaggggagagggaagcagccgtgctgtcaacatcatccggcaccctctggggtaggagaacagccattccacatgtgttccctctatccgtcctgcttcctgggcagctggtggtgctgggaatggggtgccccagccttggtgaggacagtgttgggaggcccaggggcccagtaaagtgcatttgacattg

SEQ ID NO: 3241 - DNA, 2792 bp, Homo sapiens
tgactcggaagctattctggccatttgccctccttccccccttcgtccgctctcattggctctgctggtaagtggtctattcctgcccacccccgggtgactagcttggccagtagtcgaccccacccggggaccgactctgggggttggagagactcttggggccggggtcgggcactccagctttcttctagccccgagctgggattccctggcctgcgccagctgcgtacacggcgagtacaccgcacctgcccgggacttcacccgcagctgcgagactcctccattcccggagggctccccacacctgctgcggccgtgccccatctccccgcagctgcggcgctgagcacccccatgtcgagaggctgagaccaggacaggtgcagggcgttcccactcacccccgaaagtcctcctccttcctctgcgagtctgtgttggagcagccctgaccaacgctccaataggccgggatccagccatacttcaatggatcccaggggtatcttgaaggcatttcccaagcggcagaaaattcatgctgatgcatcatcaaaagtacttgcaaagattcctaggagggaagagggagaagaagcagaagagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccgggtgctcagctggtgaagtcagcctggctgagcttgtgccttcaggagaggaggctggtggatgtagctggattcagcatcttcatccccagtaggtacttggaccatccacagcccagcaaggcagagcaggatgcttctattcctcctggcacccatgaggccctgcttcagacagccctttctcctcctcctcctcccaccaggcctgtgtctcctccccaaaaggcaaaagaggcaccaaacacccaagcccagcccatctctgatgatgaagccagtgatggggaagaaacccaggttagtgcagctgatctggaagccctcatcagtggccactaccccacctcccttgagggagattgtgagcctagcccagcccctgctgtcctggataagtgggtctgtgcacagccctcaagccagaaggcgaccaatcacaacctccatatcacagagaagctggaagttctggccaaagcctacagtgttcagggagacaagtggagggccctgggctatgccaaggccatcaatgccctcaagagcttccataagcctgtcacctcgtaccaggaggcctgcagtatccctgggattgggaagcggatggctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgctctacttcaccggctctgcacacttcaaccgctccatgcgagccctggccaaaaccaagggcatgagtctgtcagaacatgccctcagcactgctgtggtccggaacacccatggctgcaaggtggggcctggccgagtgctgcccactcccactgagaaggatgtcttcaggctcttaggcctcccctaccgagaacctgctgagcgggactggtgacccatggctgggggtgctgaggagagccgagttggactggctacccctcctggccacccagtactccctccagcctcagctggctgaacctcgccgctccaaccaccagcttcctcagcgagcagggcccagggctctgggcctgaagcaagagccagcccggctcccagtgtctgcccggctcccagtgtctgcccagccctctcccagacaggagcaggctgccaccccttctacctcaccactgcccctcgaagaattttgcaaatggccccttgccccattttaagcaggagcaggtggctggtttgaagccccaggtatcccccttccctgctatgggaaaggccaagctgctgggtggggacagaagctgcaggggagagggaagcagccgtgctgtcaacatcatccggcaccctctggggtaggagaacagccattccacatgtgttccctctatccgtcctgcttcctgggcagctggtggtgctgggaatggggtgccccagccttggtgaggacagtgttgggaggcccaggggcccagtaaagtgcatttgacattg

SEQ ID NO: 3242 - DNA, 2505 bp, Homo sapiens
ctgctggtaagtggtctattcctgcccacccccgggtgactagcttggccagtagtcgaccccacccggggaccgactctgggggttggagagactcttggggccggggtcgggcactccagctttcttctagccccgagctgggattccctggcctgcgccagctgcgtacacggcgagtacaccgcacctgcccgggacttcacccgcagctgcgagactcctccattcccggagggctccccacacctgctgcggccgtgccccatctccccgcagctgcggcgctgagcacccccatgtcgagaggctgagaccaggacagcagccctgaccaacgctccaataggccgggatccagccatacttcaatggatcccaggggtatcttgaaggcatttcccaagcggcagaaaattcatgctgatgcatcatcaaaagtacttgcaaagattcctaggagggaagagggagaagaagcagaagagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccgggtgctcagctggtgaagtcagcctggctgagcttgtgccttcaggagaggaggctggtggatgtagctggattcagcatcttcatccccagtagcccatctctgatgatgaagccagtgatggggaagaaacccaggttagtgcagctgatctggaagccctcatcagtggccactaccccacctcccttgagggagattgtgagcctagcccagcccctgctgtcctggataagtgggtctgtgcacagccctcaagccagaaggcgaccaatcacaacctccatatcacagagaagctggaagttctggccaaagcctacagtgttcagggagacaagtggagggccctgggctatgccaaggccatcaatgccctcaagagcttccataagcctgtcacctcgtaccaggaggcctgcagtatccctgggattgggaagcggatggctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgctctacttcaccggctctgcacacttcaaccgctccatgcgagccctggccaaaaccaagggcatgagtctgtcagaacatgccctcagcactgctgtggtccggaacacccatggctgcaaggtggggcctggccgagtgctgcccactcccactgagaaggatgtcttcaggctcttaggcctcccctaccgagaacctgctgagcgggactggtgacccatggctgggggtgctgaggagagccgagttggactggctacccctcctggccacccagtactccctccagcctcagctggctgaacctcgccgctccaaccaccagcttcctcagcgagcagggcccagggctctgggcctgaagcaagagccagcccggctcccagtgtctgcccggctcccagtgtctgcccagccctctcccagacaggagcaggctgccaccccttctacctcaccactgcccctcgaagaattttgcaaatggccccttgccccattttaagcaggagcaggtggctggtttgaagccccaggtatcccccttccctgctatgggaaaggccaagctgctgggtggggacagaagctgcaggggagagggaagcagccgtgctgtcaacatcatccggcaccctctggggtaggagaacagccattccacatgtgttccctctatccgtcctgcttcctgggcagctggtggtgctgggaatggggtgccccagccttggtgaggacagtgttgggaggcccaggggcccagtaaagtgcatttgacattg

SEQ ID NO: 3243 - DNA, 1536 bp, Homo sapiens
cctggctctgcccacaatcaccagggcagcttggtaaggatgaagatgacaaggtccatcctcagactgatggaatcatgaacgagcatcttaggatagtggcagggctggatgatggcatgtttcccatgctccctgcctttcccaagtcctgctgagtacagacccaactgcccctaggttggtcctgcctctagccttccctagagtctggggcgatggaagccttgtgtgtgtgctcactcatgcctcttcattggtcctggatccttacagcttcccatctggctgcttttttccagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgctctacttcaccggctctgcacacttcaaccgctccatgcgagccctggccaaaaccaagggcatgagtctgtcagaacatgccctcagcactgctgtggtccggaacacccatggctgcaaggtggggcctggccgagtgctgcccactcccactgagaaggatgtcttcaggctcttaggcctcccctaccgagaacctgctgagcgggactggtgacccatggctgggggtgctgaggagagccgagttggactggctacccctcctggccacccagtactccctccagcctcagctggctgaacctcgccgctccaaccaccagcttcctcagcgagcagggcccagggctctgggcctgaagcaagagccagcccggctcccagtgtctgcccggctcccagtgtctgcccagccctctcccagacaggagcaggctgccaccccttctacctcaccactgcccctcgaagaattttgcaaatggccccttgccccattttaagcaggagcaggtggctggtttgaagccccaggtatcccccttccctgctatgggaaaggccaagctgctgggtggggacagaagctgcaggggagagggaagcagccgtgctgtcaacatcatccggcaccctctggggtaggagaacagccattccacatgtgttccctctatccgtcctgcttcctgggcagctggtggtgctgggaatggggtgccccagccttggtgaggacagtgttgggaggcccaggggcccagtaaagtgcatttgacattgaa

SEQ ID NO: 3244 - DNA, 2360 bp, Homo sapiens
gatttccacgtgcagcagccctgaccaacgctccaataggccgggatccagccatacttcaatggatcccaggggtatcttgaaggcatttcccaagcggcagaaaattcatgctgatgcatcatcaaaagtacttgcaaagattcctaggagggaagagggagaagaagcagaagagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccgggtgctcagctggtgaagtcagcctggctgagcttgtgccttcaggagaggaggctggtggatgtagctggattcagcatcttcatccccagtaggtacttggaccatccacagcccagcaaggcagagcaggatgcttctattcctcctggcacccatgaggccctgcttcagacagccctttctcctcctcctcctcccaccaggcctgtgtctcctccccaaaaggcaaaagaggcaccaaacacccaagcccagcccatctctgatgatgaagccagtgatggggaagaaacccaggttagtgcagctgatctggaagccctcatcagtggccactaccccacctcccttgagggagattgtgagcctagcccagcccctgctgtcctggataagtgggtctgtgcacagccctcaagccagaaggcgaccaatcacaacctccatatcacagagaagctggaagttctggccaaagcctacagtgttcagggagacaagtggagggccctgggctatgccaaggccatcaatgccctcaagagcttccataagcctgtcacctcgtaccaggaggcctgcagtatccctgggattgggaagcggatggctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgctctacttcaccggctctgcacacttcaaccgctccatgcgagccctggccaaaaccaagggcatgagtctgtcagaacatgccctcagcactgctgtggtccggaacacccatggctgcaaggtggggcctggccgagtgctgcccactcccactgagaaggatgtcttcaggctcttaggcctcccctaccgagaacctgctgagcgggactggtgacccatggctgggggtgctgaggagagccgagttggactggctacccctcctggccacccagtactccctccagcctcagctggctgaacctcgccgctccaaccaccagcttcctcagcgagcagggcccagggctctgggcctgaagcaagagccagcccggctcccagtgtctgcccggctcccagtgtctgcccagccctctcccagacaggagcaggctgccaccccttctacctcaccactgcccctcgaagaattttgcaaatggccccttgccccattttaagcaggagcaggtggctggtttgaagccccaggtatcccccttccctgctatgggaaaggccaagctgctgggtggggacagaagctgcaggggagagggaagcagccgtgctgtcaacatcatccggcaccctctggggtaggagaacagccattccacatgtgttccctctatccgtcctgcttcctgggcagctggtggtgctgggaatggggtgccccagccttggtgaggacagtgttgggaggcccaggggcccagtaaagtgcatttgacattgaa

SEQ ID NO: 3245 - DNA, 2308 bp, Homo sapiens
atttgccctccttccccccttcgtccgctctcattggctctgctgccttcatgtgcttcagccctacgttgtttatgtccagaatcagatattggagctgactctgcctgtccagggcctgcagagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccgggtgctcagctggtgaagtcagcctggctgagcttgtgccttcaggagaggaggctggtggatgtagctggattcagcatcttcatccccagtaggtacttggaccatccacagcccagcaaggcagagcaggatgcttctattcctcctggcacccatgaggccctgcttcagacagccctttctcctcctcctcctcccaccaggcctgtgtctcctccccaaaaggcaaaagaggcaccaaacacccaagcccagcccatctctgatgatgaagccagtgatggggaagaaacccaggttagtgcagctgatctggaagccctcatcagtggccactaccccacctcccttgagggagattgtgagcctagcccagcccctgctgtcctggataagtgggtctgtgcacagccctcaagccagaaggcgaccaatcacaacctccatatcacagagaagctggaagttctggccaaagcctacagtgttcagggagacaagtggagggccctgggctatgccaaggccatcaatgccctcaagagcttccataagcctgtcacctcgtaccaggaggcctgcagtatccctgggattgggaagcggatggctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgctctacttcaccggctctgcacacttcaaccgctccatgcgagccctggccaaaaccaagggcatgagtctgtcagaacatgccctcagcactgctgtggtccggaacacccatggctgcaaggtggggcctggccgagtgctgcccactcccactgagaaggatgtcttcaggctcttaggcctcccctaccgagaacctgctgagcgggactggtgacccatggctgggggtgctgaggagagccgagttggactggctacccctcctggccacccagtactccctccagcctcagctggctgaacctcgccgctccaaccaccagcttcctcagcgagcagggcccagggctctgggcctgaagcaagagccagcccggctcccagtgtctgcccggctcccagtgtctgcccagccctctcccagacaggagcaggctgccaccccttctacctcaccactgcccctcgaagaattttgcaaatggccccttgccccattttaagcaggagcaggtggctggtttgaagccccaggtatcccccttccctgctatgggaaaggccaagctgctgggtggggacagaagctgcaggggagagggaagcagccgtgctgtcaacatcatccggcaccctctggggtaggagaacagccattccacatgtgttccctctatccgtcctgcttcctgggcagctggtggtgctgggaatggggtgccccagccttggtgaggacagtgttgggaggcccaggggcccagtaaagtgcatttgacattgaa

SEQ ID NO: 3246 - DNA, 2280 bp, Homo sapiens
attctggccatttgccctccttccccccttcgtccgctctcattggctctgctgcagccctgaccaacgctccaataggccgggatccagccatacttcaatggatcccaggggtatcttgaaggcatttcccaagcggcagaaaattcatgctgatgcatcatcaaaagtacttgcaaagattcctaggagggaagagggagaagaagcagaagagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccgggtgctcagctggtgaagtcagcctggctgagcttgtgccttcaggagaggaggctggtggatgtagctggattcagcatcttcatccccagtaggtacttggaccatccacagcccagcaaggcagagcaggatgcttctattcctcctggcacccatgaggccctgcttcagacagccctttctcctcctcctcctcccaccaggcctgtgtctcctccccaaaaggcaaaagaggcaccaaacacccaagcccagcccatctctgatgatgaagccagtgatggggaagaaacccaggttagtgcagctgatctggaagccctcatcagtggccactaccccacctcccttgagggagattgtgagcctagcccagcccctgctgtcctggataagtgggtctgtgcacagccctcaagccagaaggcgaccaatcacaacctccatatcacagagaagctggaagttctggccaaagcctacagtgttcagggagacaagtggagggccctgggctatgccaaggccatcaatgccctcaagagcttccataagcctgtcacctcgtaccaggaggcctgcagtatccctgggattgggaagcggatggctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgcaaggtggggcctggccgagtgctgcccactcccactgagaaggatgtcttcaggctcttaggcctcccctaccgagaacctgctgagcgggactggtgacccatggctgggggtgctgaggagagccgagttggactggctacccctcctggccacccagtactccctccagcctcagctggctgaacctcgccgctccaaccaccagcttcctcagcgagcagggcccagggctctgggcctgaagcaagagccagcccggctcccagtgtctgcccggctcccagtgtctgcccagccctctcccagacaggagcaggctgccaccccttctacctcaccactgcccctcgaagaattttgcaaatggccccttgccccattttaagcaggagcaggtggctggtttgaagccccaggtatcccccttccctgctatgggaaaggccaagctgctgggtggggacagaagctgcaggggagagggaagcagccgtgctgtcaacatcatccggcaccctctggggtaggagaacagccattccacatgtgttccctctatccgtcctgcttcctgggcagctggtggtgctgggaatggggtgccccagccttggtgaggacagtgttgggaggcccaggggcccagtaaagtgcatttgacattgaa

SEQ ID NO: 3247 - DNA, 855 bp, Homo sapiens
cttcgtccgctctcattggctctgctggccgggatccagccatacttcaatggatcccaggggtatcttgaaggcatttcccaagcggcagaaaattcatgctgatgcatcatcaaaagtacttgcaaagattcctaggagggaagagggagaagaagcagaagagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccgggtgctcagctggtgaagtcagcctggctgagcttgtgccttcaggagaggaggctggtggatgtagctggattcagcatcttcatccccagtaggtacttggaccatccacagcccagcaaggcagagcaggatgcttctattcctcctggcacccatgaggccctgcttcagacagccctttctcctcctcctcctcccaccaggcctgtgtctcctccccaaaaggcaaaagaggcaccaaacacccaagcccagcccatctctgatgatgaagccagtgatggggaagaaacccaggttagtgcagctgatctggaagccctcatcagtggccactaccccacctcccttgagggagattgtgagcctagcccagcccctgctgtcctggataagtgggtctgtgcacagccctcaagccagaaggcgaccaatcacaacctccatatcacagagaagctggaagttctggccaaagcctacagtgt

SEQ ID NO: 3248 - DNA, 1457 bp, Homo sapiens
cagccctgaccaacgctccaataggccgggatccagccatacttcaatggatcccaggggtatcttgaaggcatttcccaagcggcagaaaattcatgctgatgcatcatcaaaagtacttgcaaagattcctaggagggaagagggagaagaagcagaagagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccgggtgctcagctggtgaagtcagcctggctgagcttgtgccttcaggagaggaggctggtggatgtagctggattcagcatcttcatccccagtaggtacttggaccatccacagcccagcaaggcagagcaggatgcttctattcctcctggcacccatgaggccctgcttcagacagccctttctcctcctcctcctcccaccaggcctgtgtctcctccccaaaaggcaaaagaggcaccaaacacccaagcccagcccatctctgatgatgaagccagtgatggggaagaaacccaggaggcctgcagtatccctgggattgggaagcggatggctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagcagtcccctctgttgggccagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgctctacttcaccggctctgcacacttcaaccgctccatgcgagccctggccaaaaccaagggcatgagtctgtcagaacatgccctcagcactgctgtggtccggaacacccatggctgcaaggtggggcctggccgagtgctgcccactcccactg

SEQ ID NO: 3249 - DNA, 1049 bp, Homo sapiens
agccctgaccaacgctccaataggccgggatccagccatacttcaatggatcccaggggtatcttgaaggcatttcccaagcggcagaaaattcatgctgatgcatcatcaaaaccttcatgtgcttcagccctacgttgtttatgtccagaatcagatattggagctgactctgcctgtccagggcctgcagagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccgggtgctcagctggtgaagtcagcctggctgagcttgtgccttcaggagaggaggctggtggatgtagctggattcagcatcttcatccccagtaggtacttggaccatccacagcccagcaaggcagagcaggatgcttctattcctcctggcacccatgaggccctgcttcagacagccctttctcctcctcctcctcccaccaggcctgtgtctcctccccaaaaggcaaaagaggcaccaaacacccaagcccagcccatctctgatgatgaagccagtgatggggaagaaacccaggttagtgcagctgatctggaagccctcatcagtggccactaccccacctcccttgagggagattgtgagcctagcccagcccctgctgtcctggataagtgggtctgtgcacagccctcaagccagaaggcgaccaatcacaacctccatatcacagagaagctggaagttctggccaaagcctacagtgttcagggagacaagtggagggccctgggctatgccaaggccatcaatgccctcaagagcttccataagcctgtcacctcgtaccaggaggcctgcagtatccctgggattgggaagcggatggctgagaaaatcatagagatcctggagagcgggcatttgcggaa

SEQ ID NO: 3250 - DNA, 784 bp, Homo sapiens
cccttcgtccgctctcattggctctgctgcagccctgaccaacgctccaataggccgggatccagccatacttcaatggatcccaggggtatcttgaaggcatttcccaagcggcagaaaattcatgctgatgcatcatcaaaagtacttgcaaagattcctaggagggaagagggagaagaagcagaaggaggcctgcagtatccctgggattgggaagcggatggctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccc

SEQ ID NO: 3251 - DNA, 1022 bp, Homo sapiens
cccttcgtccgctctcattggctctgctggtaagtggtctattcctgcccacccccgggtgactagcttggccagtagtcgaccccacccggggaccgactctgggggttggagagactcttggggccggggtcgggcactccagctttcttctagccccgagctgggattccctggcctgcgccagctgcgtacacggcgagtacaccgcacctgcccgggacttcacccgcagctgcgagactcctccattcccggagggctccccacacctgctgcggccgtgccccatctccccgcagctgcggcgctgagcacccccatgtcgagaggctgagaccaggacaggtgcagggcgttcccactcacccccgaaagtcctcctccttcctctgcgagtctgtgttggagcagccctgaccaacgctccaataggccgggatccagccatacttcaatggatcccaggggtatcttgaaggcatttcccaagcggcagaaaattcatgctgatgcatcatcaaaagtacttgcaaagattcctaggagggaagagggagaagaagcagaagagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccgggtgctcagctggtgaagtcagcctggctgagcttgtgccttcaggagaggaggctggtggatgtagctggattcagcatcttcatccccagtaggtacttggaccatccacagcccagcaaggcagagcaggatgcttctattcctcctggcacccatgaggccctgcttcagacagccctttctcctcctcctcctcccaccaggcctgtgtctcctccccaaaaggcaaaagaggcaccaaacaccc

SEQ ID NO: 3252 - DNA, 1257 bp, Homo sapiens
tctggccatttgccctccttccccccttcgtccgctctcattggctctgctgagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccgggtgctcagctggtgaagtcagcctggctgagcttgtgccttcaggagaggaggctggtggatgtagctggattcagcatcttcatccccagtagcccatctctgatgatgaagccagtgatggggaagaaacccaggttagtgcagctgatctggaagccctcatcagtggccactaccccacctcccttgagggagattgtgagcctagcccagcccctgctgtcctggataagtgggtctgtgcacagccctcaagccagaaggcgaccaatcacaacctccatatcacagagaagctggaagttctggccaaagcctacagtgttcagggagacaagtggagggccctgggctatgccaaggccatcaatgccctcaagagcttccataagcctgtcacctcgtaccaggaggcctgcagtatccctgggattgggaagcggatggctgagaaaatcatagagatcctggagagcgggcatttgcggaagctggaccatatcagtgagagcgtgcctgtcttggagctcttctccaacatctggggagctgggaccaagactgcccagatgtggtaccaacaggtcacaccctggctcagcccctacttcagttttgctgtgtctcagagttcctgccccagatgtgtgctgtgctctgccccagatccctatgctgtgctctgatgggaatgcacccacagtatagggagaccatttttcaagcggaccaggactcatatagacccctcagctcccagaacagccttgttgcttggtatccttaagaaggagtagacagggacaagaagtatgtttctcagtctccccagaccagcaagggccttcctgaggaggccaggccttgacactgcgtgtctagagcagtggttcccaatcctggctctgcccacaatcaccagggcagcttggtaaggatgaagatgacaaggtccatcctcagactgatggaatcatgaacgagcatcttaggatagtggca

SEQ ID NO: 3253 - DNA, 683 bp, Homo sapiens
ccttcatgtgcttcagccctacgttgtttatgtccagaatcagatattggagctgactctgcctgtccagggcctgcagagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccgggtgctcagctggtgaagtcagcctggctgagcttgtgccttcaggagaggaggctggtggatgtagctggattcagcatcttcatccccagtagcccatctctgatgatgaagccagtgatggggaagaaacccaggttagtgcagctgatctggaagccctcatcagtggccactaccccacctcccttgagggagattgtgagcctagcccagcccctgctgtcctggataagtgggtctgtgcacagccctcaagccagaaggcgaccaatcacaacctccatatcacagagaagctggaagttctggccaaagcctacagtgttcagggagacaagtggagggccctgggctatgccaaggccatcaatgccctcaagagcttccataagcctgtcacc

SEQ ID NO: 3254 - DNA, 1533 bp, Homo sapiens
ctcattggctctgctgcagccctgaccaacgctccaataggccgggatccagccatacttcaatggatcccaggggtatcttgaaggcatttcccaagcggcagaaaattcatgctgatgcatcatcaaaagtacttgcaaagattcctaggagggaagagggagaagaagcagaagcccatctctgatgatgaagccagtgatggggaagaaacccaggaggcctgcagtatccctgggattgggaagcggatggctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgctctacttcaccggctctgcacacttcaaccgctccatgcgagccctggccaaaaccaagggcatgagtctgtcagaacatgccctcagcactgctgtggtccggaacacccatggctgcaaggtggggcctggccgagtgctgcccactcccactgagaaggatgtcttcaggctcttaggcctcccctaccgagaacctgctgagcgggactggtgacccatggctgggggtgctgaggagagccgagttggactggctacccctcctggccacccagtactccctccagcctcagctggctgaacctcgccgctccaaccaccagcttcctcagcgagcagggcccagggctctgggcctgaagcaagagccagcccggctcccagtgtctgcccggctcccagtgtctgcccagccctctcccagacaggagcaggctgccaccccttctacctcaccactgcccctcgaagaattttgcaaatggccccttgccccattttaagcaggagcaggtggctggtttgaagccccaggtatcccccttccctgctatgggaaaggccaagctgctgggtggggacagaagctgcaggggagagggaagcagccgtgctgtcaacatcatccggcaccctctggggtaggagaacagccattccacatgtgttccctctatccgtcctgcttcct

SEQ ID NO: 3255 - DNA, 3821 bp, Homo sapiens
gtagtgcgtcgcctccgttgccggggaaacgacccgggacctgggagggagcaaagacgtttcccgccggcgggagctgtggctgtgattgagagaggggttagaggcgggtcccagcgctgccgcaccatggcggaccagctttatctggaaaatatagacgagttcgtcacggaccaaaacaagatcgtgacatacaaatggctgagctatacactaggggttcatgttaaccaggccaaacagatgctgtatgattatgttgaaaggaaacgaaaagaaaattcaggagcccaactgcatgttacctacttggtgtctggcagtctcattcagaatggacattcctgccacaaggttgcagtagtgagagaagataaattggaagcagtgaagtccaagctagctgtgactgccagcatccatgtgtacagcatccagaaagccatgctaaaggacagtgggcctctgttcaatactgactatgacatccttaaaagcaacttgcagaactgcagcaaatttagtgctatacaatgtgcagctgccgtccctagagctcctgctgaatcctcttcgtcttccaaaaagtttgagcagtcacatcttcacatgtcaagtgagacacaagccaacaatgagctgaccaccaatggtcatggcccacctgcatccaagcaggtttcccagcagcccaaaggaattatgggaatgtttgcctccaaagctgctgctaaaacccaagaaaccaacaaggaaacgaaaacagaggctaaagaagtaacaaatgcatctgcagcaggcaacaaggcaccagggaaagggaatatgatgagcaacttttttggaaaagctgctatgaataaatttaaagtcaatttggactcagaacaagcagtgaaagaagaaaaaatagtggagcagcctacagtgtctgtcacggaaccaaagctggcaactcctgcaggcctgaaaaaatccagcaaaaaagcagagcctgttaaggtgctgcagaaggaaaaaaaaagggggaagcgagtagcattatctgatgatgagacaaaggaaactgaaaacatgaggaaaaagaggagaagaatcaaacttcctgaatctgatagcagtgaagatgaagtctttccagactctcctggggcttatgaagctgagtcaccatccccacctcctcctccgtctccacctcttgaaccagtgccaaagactgagcctgaacctccttctgtcaagagctcaagtggagaaaacaaaagaaaacgaaaacgcgtactaaaatctaaaacttacctggatggggaaggctgcatagtgactgaaaaagtctacgagagtgaatcctgcacagatagtgaagaggagcttaacatgaagacatcctcagtacacagaccccctgccatgactgtgaaaaaagaacccagagaggaacgaaagggccccaagaaagggactgctgctctgggcaaagccaacagacaggtgtccattactggcttcttccagaggaaataaactgccatctctggtagatcagagacttggagtggtcaagggagaagaccaagaaatgtactcctcacttactatgtaagttcatctagatctccacctcacctgtatcaaaagactgttctttcatcctgtgaggtttatactatttctggtttttaaccaaaaggaaatcatctggaagcaggaggcaaaaagctgttaccttctaatgacatttaaaaagcacagtctttgacctgtccaggagaaggatttactccaaaattatactggaacagttttcagaattctcactgaagccatttagtggctaacccactgtgctccactcaccctatgccctggtccgcatatggcacaggaattattccttcttgttcctctgtattctaagaattcatgtgggtgtttcttatccttacattctgctggatacgtttacccctcttgtcttcctgcagtaccacacttctgtcccctaacctcctgaggctgttctctgtaagtcttttaagttttggttggactaaaggctgaagtgaaaatctccctgtaatcctcttcctccattatgcagtacacggacacctggctacagaccaggacgtggcttgtgttctgttcctttcacaaaagctctctgggaccttcacttgcaattagtggttagggaaaagcctcaggcagaacacaaatagaaatttaatgatgtgttcaactccaccagaaattacctcgagtcagcattgacgatattggaggagctgccgtgctgctgatacggggtgtgctttatgctgctctttgcggtttgttgatcccctcctcccccactctcaatacctagagagtgaaacccgtacaatgagataaagactaaaaagagaaatcccttcctatatacagtgtgctacatttacaaaaaatttctccttaagaaaacagaatattcaaaaacagcacttttccaggaagttagtgaggaagataaggcacacatttatttataaatggatgttgctcctttgtatttttagcttccctatttgcttaaaagtacaggctccctaagagaggatggagagggagagactgaattgttagtaggtctaaacatcaaagaaaacatttttattagttacttatggaaaatcatctattacaatgataaccttcaagtgacttccattatggctggacaggcggtgagctcagtggattgcagtggtgtgctggtgattttgcacagtgagctctgcggaaggggtcaggctcaactgctgatgtgtctcacacgtagcagacaaggggtgtctgactggcttcttttgcctcaagatggtgtatgtcgtaagtgatgcaatcagctgtctgctttttaaggttgggattgtgctgactttgggattaacatgagcttctttagcaaccaagcatgaacttgattaagaccagaagtttgggagatgagtcctggcattatgtctaggactaaagcagtggctttgtatagcaagctgagtaaaggttgacatattccaaaacccttctttttaaaaggaaaaaggatggagagaaggatggaaagcctggacttaaacctttagaaaaaacttctggagagaaatcccttttaaacagttacttttgtcattgcctctggtcatttgtctaaataggaatggaaaattaaaagaaaagcaacaatccaatcttttttctaaaaattatgctggggtctcgactaaaactgaatttgaattggaaaattctggtgttggttggagttccatcttgcaagggataatacaaatcctatgatctctatgcccaatatgctgcctcaactctgagctgtctgcaaggcttagtaagtattgagtggtgttttttttttctttttatacaataccatgttaaccacatgagttaaataaatttgagaagttgttttaaaacagtgcttcaaactgagtatctgatgagtctcttatttgatggatggtaacagtgttgcaattatttaagctctgaatgggaagaaggctggttttcagttgatattgttaaaactgcatacccacagtctgagatgaacaagttatttgctgccttcatcgtttttttcagcactggggaaatgttagtttcagccaacctcattttttagttcatctagaagaaaatctagcacattgtattagtttggcttcatcacttgctagctgtatgactgtgggcaagtttcacagcctcaagttctttatcaaaataaaactaaaatgagttac

SEQ ID NO: 3256 - DNA, 2122 bp, Homo sapiens
gctgtggctgtgattgagagaggggttagaggcgggtcccagcgctgccgcaccatggcggaccagctttatctggaaaatatagacgagttcgtcacggaccaaaacaagatcgtgagcagctactactggggaacgcgggcgtgcgaccggggtcctgggcccggctagggcggcgggagccttgaccctctgtctgcttgtggcttcgtggggaccaggggagacaggtccccacgaggggacctgggcgagctctgtgccccagagcgagcgaggactcgtcgggaaggtcctccagcacacacggaagtccgcgtcccttgggtgggcgtgctgggaacagagcctggggctggagccgcggagaccgggcgcggagggagggccgttggctgagagttctaaggcgtccctacacctttcttttaaggtgacatacaaatggctgagctatacactaggggttcatgttaaccaggccaaacagatgctgtatgattatgttgaaaggaaacgaaaagaaaattcaggagcccaactgcatgttacctacttggtgtctggcagtctcattcagaatggacattcctgccacaaggttgcagtagtgagagaagataaattggaagcagtgaagtccaagctagctgtgactgccagcatccatgtgtacagcatccagaaagccatgctaaaggacagtgggcctctgttcaatactgactatgacatccttaaaagcaacttgcagaactgcagcaaatttagtgctatacaatgtgcagctgccgtccctagagctcctgctgaatcctcttcgtcttccaaaaagtttgagcagtcacatcttcacatgtcaagtgagacacaagccaacaatgagctgaccaccaatggtcatggcccacctgcatccaagcaggtttcccagcagcccaaaggaattatgggaatgtttgcctccaaagctgctgctaaaacccaagaaaccaacaaggaaacgaaaacagaggctaaagaagtaacaaatgcatctgcagcaggcaacaaggcaccagggaaagggaatatgatgagcaacttttttggaaaagctgctatgaataaatttaaagtcaatttggactcagaacaagcagtgaaagaagaaaaaatagtggagcagcctacagtgtctgtcacggaaccaaagctggcaactcctgcaggcctgaaaaaatccagcaaaaaagcagagcctgttaaggtgctgcagaaggaaaaaaaaagggggaagcgagtagcattatctgatgatgagacaaaggaaactgaaaacatgaggaaaaagaggagaagaatcaaacttcctgaatctgatagcagtgaagatgaagtctttccagactctcctggggcttatgaagctgagtcaccatccccacctcctcctccgtctccacctcttgaaccagtgccaaagactgagcctgaacctccttctgtcaagagctcaagtggagaaaacaaaagaaaacgaaaacgcgtactaaaatctaaaacttacctggatggggaaggctgcatagtgactgaaaaagtctacgagagtgaatcctgcacagatagtgaagaggagcttaacatgaagacatcctcagtacacagaccccctgccatgactgtgaaaaaagaacccagagaggaacgaaagggccccaagaaagggactgctgctctgggcaaagccaacagacaggtgtccattactggcttcttccagaggaaataaactgccatctctggtagatcagagacttggagtggtcaagggagaagaccaagaaatgtactcctcacttactatgtaagttcatctagatctccacctcacctgtatcaaaagactgttctttcatcctgtgaggtttatactatttctggtttttaaccaaaaggaaatcatctggaagcaggaggcaaaaagctgttaccttctaatgacatttaaaaagcacagtctttgacctgtccaggagaaggatttactccaaaattatactggaacagttttcagaattctcactgaagccatttagtggctaacccactgtgctccactcaccctatgccctggtcc

SEQ ID NO: 3257 - DNA, 1700 bp, Homo sapiens
gctgtggctgtgattgagagaggggttagaggcgggtcccagcgctgccgcaccatggcggaccagctttatctggaaaatatagacgagttcgtcacggaccaaaacaagatcgtgacatacaaatggctgagctatacactaggggttcatgttaaccaggccaaacatgccacaaggttgcagtagtgagagaagataaattggaagcagtgaagtccaagctagctgtgactgccagcatccatgtgtacagcatccagaaagccatgctaaaggacagtgggcctctgttcaatactgactatgacatccttaaaagcaacttgcagaactgcagcaaatttagtgctatacaatgtgcagctgccgtccctagagctcctgctgaatcctcttcgtcttccaaaaagtttgagcagtcacatcttcacatgtcaagtgagacacaagccaacaatgagctgaccaccaatggtcatggcccacctgcatccaagcaggtttcccagcagcccaaaggaattatgggaatgtttgcctccaaagctgctgctaaaacccaagaaaccaacaaggaaacgaaaacagaggctaaagaagtaacaaatgcatctgcagcaggcaacaaggcaccagggaaagggaatatgatgagcaacttttttggaaaagctgctatgaataaatttaaagtcaatttggactcagaacaagcagtgaaagaagaaaaaatagtggagcagcctacagtgtctgtcacggaaccaaagctggcaactcctgcaggcctgaaaaaatccagcaaaaaagcagagcctgttaaggtgctgcagaaggaaaaaaaaagggggaagcgagtagcattatctgatgatgagacaaaggaaactgaaaacatgaggaaaaagaggagaagaatcaaacttcctgaatctgatagcagtgaagatgaagtctttccagactctcctggggcttatgaagctgagtcaccatccccacctcctcctccgtctccacctcttgaaccagtgccaaagactgagcctgaacctccttctgtcaagagctcaagtggagaaaacaaaagaaaacgaaaacgcgtactaaaatctaaaacttacctggatggggaaggctgcatagtgactgaaaaagtctacgagagtgaatcctgcacagatagtgaagaggagcttaacatgaagacatcctcagtacacagaccccctgccatgactgtgaaaaaagaacccagagaggaacgaaagggccccaagaaagggactgctgctctgggcaaagccaacagacaggtgtccattactggcttcttccagaggaaataaactgccatctctggtagatcagagacttggagtggtcaagggagaagaccaagaaatgtactcctcacttactatgtaagttcatctagatctccacctcacctgtatcaaaagactgttctttcatcctgtgaggtttatactatttctggtttttaaccaaaaggaaatcatctggaagcaggaggcaaaaagctgttaccttctaatgacatttaaaaagcacagtctttgacctgtccaggagaaggatttactccaaaattatactggaacagttttcagaattctcactgaagccatttagtggctaacccactgtgctccactcaccctatgccctggtcc

SEQ ID NO: 3258 - DNA, 839 bp, Homo sapiens
gaggggttagaggcgggtcccagcgctgccgcaccatggcggaccagctttatctggaaaatatagacgagttcgtcacggaccaaaacaagatcgtgacatacaaatggctgagctatacactaggggttcatgttaaccaggccaaacagatgctgtatgattatgttgaaaggaaacgaaaagaaaattcaggagcccaactgcatgttacctacttggtgtctggcagtctcattcagaatggacattcctgccacaaggttgcagtagtgagagaagataaattggaagcagtgaagtccaagctagctgtgactgccagcatccatgtgtacagcatccagaaagccatgctaaaggacagtgggcctctgttcaatactgactatgacatccttaaaagcaacttgcagaactgcagcaaatttagtgctatacaatgtgcagctgccgtccctagagctcctgctgaatcctcttcgtcttccaaaaagtttgagcagtcacatcttcacatgtcaagtgagacacaagccaacaatgagctgaccaccaatggtcatggcccacctgcatccaagcaggtttcccagcagcccaaaggaattatgggaatgtttgcctccaaagctgctgctaaaacccaagaaaccaacaaggaaacgaaaacagaggctaaagaagtaacaaatgcatctgcagcaggcaacaaggcaccagggaaagggaatatgatgagcaacttttttggaaaagctgctatgaataaatttaaagtcaatttggactcagaacaagcagtgaaagaagaaaaaataaaggaaaaaaaaaggtag

SEQ ID NO: 3259 - DNA, 1715 bp, Homo sapiens
ggaaccgaccgccgccggccgggttgcaggcggggcacctcgggcaggacctccctggtcggaagtggccgtgagcccaagccgcggtcccgggccggcacccaggatgggcgaggtggaggccccgggccgcttgtggctcgagagcccccctgggggagcgccccccatcttcctgccctcggacgggcaagccctggtcctgggcaggggacccctgacccaggttacggaccggaagtgctccagaactcaagtggagctggtcgcagatcctgagacccggacagtggcagtgaaacagctgggagttaacccctcaactaccgggacccaggagttgaagccggggttggagggctctctgggggtgggggacacactgtatttggtcaatggcctccacccactgaccctgcgctgggaagagacccgcacaccagaatcccagccagatactccgcctggcacccctctggtgtcccaagatgagaagagagatgctgagctgccgaagaagcgtatgcggaagtcaaaccccggctgggagaacttggagaagttgctagtgttcaccgcagctggggtgaaaccccagggcaaggtggctggctttgatctggacgggacgctcatcaccacacgctctgggaaggtctttcccactggccccagtgactggaggatcttgtacccagagattccccgtaagctccgagagctggaagccgagggctacaagctggtgatcttcaccaaccagatgagcatcgggcgcgggaagctgccagccgaggagttcaaggccaaggtggaggctgtggtggagaagctgggggtccccttccaggtgctggtggccacgcacgcaggcttgtaccggaagccggtgacgggcatgtgggaccatctgcaggagcaggccaacgacggcacgcccatatccatcggggacagcatctttgtgggagacgcagccggacgcccggccaactgggccccggggcggaagaagaaagacttctcctgcgccgatcgcctgtttgccctcaaccttggcctgcccttcgccacgcctgaggagttctttctcaagtggccagcagccggcttcgagctcccagcctttgatccgaggactgtctcccgctcagggcctctctgcctccccgagtccagggccctcctgagcgccagcccggaggtggttgtcgcagtgggattccctggggccgggaagtccacctttctcaagaagcacctcgtgtcggccggatatgtccacgtgaacagggacacgctaggctcctggcagcgctgtgtgaccacgtgtgagacagccctgaagcaagggaaacgggtcgccatcgacaacacaaacccagacgccgcgagccgcgccaggtacgtccagtgtgcccgagccgcgggcgtcccctgccgctgcttcctcttcaccgccactctggagcaggcgcgccacaacaaccggtttcgagagatgacggactcctctcatatccccgtgtcagacatggtcatgtatggctacaggaagcagttcgaggccccaacgctggctgaaggcttctctgccatcctggagatcccgttccggctatgggtggagccgaggctggggcggctgtactgccagttctccgagggctgagccccgcccagctcccctccacaataaacgctgtttctccttg

SEQ ID NO: 3260 - DNA, 3051 bp, Homo sapiens
attagaggctccagccccgccgacttgcagacgtgagatcgggcacacctgagcggcggcggggcggtcgtggccacatccggggcgacgtgcctgagtcaccccgtcccgccagcgtctgccagtccagccagtccgcccagtctctcgcgtccgagactcgcctccagcctcccacctccgcccgggccgcgcgagcctcgcgggggcgggggcggggcgccaaggggcggggctgtctcttaaagggccccgggccgctgcccttaggccacttcctgggggcggagaggacctcagcggctgcggcgacacccagggaaggcggcgcggccgggtcccgaaactcctggctgtttccatcagagccctcggacactcccagcccgggctgagcacgcatcgtcgctccccggcggatacaagggggctccgccatccgctcccgtcagttcggcctccatctcctgggacccgcgccggcagccaggccaggcctctgagtggccccagagccctggctggactcgtccacggcggcagcgatctgcccggggtctcggaggccatcccttcagagtcggccctgtgctcgccaccgtcacctgctggttggattccggaaacccactgtctgaagaccacagaggggtgtcgctgaccaccccaaatcggatacgtccagacctcaagctcccttcccctctctggctgccctctgctcttttcatctcttctctcaaccttttggggatttctgtgtcctgacaccacctccccatccaccaccaaagtagccggggtgagccccaaaccttactgggtgtgctccacctgtgcctccaacccagcgaatctgacagcttcgacccaattctgcacacacccaggaagttctgccttttcttttctttcggtgtctcctgtacttcccaaaatttctcctcctcctgtgccctcttcgcccccctcctttgggggccccgtgaccctgaatgtggggggcacactatattccaccactttggagaccctgacccgcttcccagactctatgctgggggccatgtttagggccggcacccccatgccccccaacctcaattcccaaggaggcggccactacttcatcgaccgggatggcaaggccttccggcacatcctcaatttcctgaggctgggccgcctggacctgccccgtgggtacggagagacagcgctgctcagggcagaggctgacttctaccagatccggcccctcctggacgcgctgcgggaactggaggcctctcaggggacccctgcacccacagctgccctgctccacgcagatgtagatgtcagcccccgcctggtgcacttctctgctcgccggggaccccatcactatgagctgagctccgtccaggtggacaccttccgagccaaccttttctgcaccgactctgagtgtctaggtgctttgcgggcccgatttggtgtggccagtggggatagggcagaggggagcccacattttcatctggagtgggccccccgccccgtggaactccccgaggtggagtatgggagactggggctgcagccgctgtggactggggggccaggagagcggcgggaggtggtgggcaccccaagcttcctggaggaggtgctgcgggtggctctcgagcacggcttccgactagactctgtcttccccgaccccgaagacctgctcaactccaggtctctgcgctttgtccggcactgaggatgctgttctcagtttgactgtggggaggagagagaatggggtactagcacccctgaagcctctttccagctctgcttcaggagctatgagagtcgggactctcctgcacctgactggagctcagatgtgggcaggaattcccaaacctgagcccaccaaggactcacaagtggtccagaaggtctcaacctgtgctgaccctgggaggggtagggaaggttctctcagcttgttcttgcctaaggctgagcacctccagtctctccttgatttggagctcagtgtttaagggcttggaaaaggggggaacatctctttacccagactagacctagcaaaaccctggaaggatattgaggtctggggaaaagggaggactttgcattttcccaatgcggtctcttggaccatggcttctactcctgaagctgggtggcctggcctggcctgaccaatgagaggccagaacactctggaacatcggaagaggagttctttgctatgttccaagccatctactgagggaggcagaaaggccacaacccaccctaggttgatgtatgggagctaggacagtccccatggcaatggggctggagcatccctcatctggaagaatcccatactgatggcagggctggccagggggaagagggtagtatctgtgggtcctggcctttcttcatgtgtgcgtgcatatcagcccgtgtggctgactgatgtataggtccctggcatcctggttcatatctgtgttgctgactacagtgtctgtgatgtccgcatgtccaggcctgtttggggttgcctagcgactcttctggcacagggtgtgtctgtggtatacctgtgaggtggttgacaattagtagtttaatcacagggtgtgtgtgtgtgtgtgtgtgtgtgtgtttatgtgcacgcatgtatatgcatcaccacgtagccaggaggggcctgttggggtttgagtcactgggatcttcctggtgagaggtaagagaagtcactgggcttagctgggcctctgaggcctgtatggaactcttggttgctgaggcaaccatggacctgttgctaggagatagctggggaaggcccaaggccgcccagggcagagagaggagacgaagagtttgggacagtgggggaggagatgggaagggatgggatttctgggtcccagagcgggtgggatactcacgcacagcttcttcactggtggggggtggggcacacattatttctcactggtcatgatttacaagaagaaaaataaaactgcttttggaacc

SEQ ID NO: 3261 - DNA, 7943 bp, Homo sapiens
gtaaaagtgacattctaaatgttcctcactctgcgaggcttattttttagggactttgctataattctgaaagacttagttttacagtacatctgaaagtaggagttttcagaagtatggctcttgggataaatttagattcttaattgtgaagctctgttaccacttgttagaaggcaggtcagctcacctgcttggggaggtaaatatatgaatgcactctcgagtaatttaatggagccctacctcaatgtacagaatgacagtatcacagatcaagaatggagtacgagtgattttcggctatggtgggggtaggtaggtcacttgtcccctgttgtctcttactatttgtaaagtgaagactatgattagtctttttgatcgggatggtttgagatgaataaagaataggcaggcaatttggatactttaggcttttcaagaacattagtaacattttttcttagatatttctcctaatacaatgagtgttgtgaaataacatggcagttattgttgagagaaaagccttcccagttatgtattgagtccttaggcgttttgaccttccctccactcttacagaacttggtggaaggggccactatgttttctacctccttccgtgcctttcacaaagccacatcctgcaccgtctacccttctctgtggatatttttccgcttggcaatttcctttcctgaggcacccacttgggacatctgaatctccatctccatgttgatggcccgtttgtgcttggacgtgttcttccacttgagactgagggttcatgtaatcaaagaagtttctttgttgtgtgtatctttacagaacacaacaggaattgaaaatgaatcagaacactactgagcctgtggcggccaccgagaccctggctgaggtacccgaacatgtgctgcgaggacttccggaggaagtgaggcttttcccttctgctgttgacaagacccggattggtgtctgggccactaaaccaattttaaaaggcaaaaaatttgggccatttgttggtgataagaaaaaaagatctcaggttaagaataatgtatacatgtgggaggtgtattacccaaatttgggatggatgtgcattgatgccactgatccagagaagggaaactggctgcgatatgtgaattgggcttgctcaggagaagagcaaaatttattcccactggaaatcaacagagccatttactataaaactttaaagccaatcgcgccgggcgaggagctcctggtctggtacaatggggaagacaaccctgagatagcagctgcgattgaggaagagcgagccagcgcccggagcaagcggagctcccccaagagccggaaagggaagaaaaaatcccaggaaaataaaaacaaaggaaacaaaatccaagacatacaactgaagacaagtgagccagatttcacctctgcaaatatgagagattctgcagaaggtcctaaagaagacgaagagaagccttcagcctcagcacttgagcagccggccaccctccaggaggtggccagtcaggaggtgcctccagaactagcaacccctgcccctgcctgggagccacagccagaaccagacgagcgattagaagcggcagcttgtgaggtgaatgatttgggggaagaggaggaggaggaagaggaggaggatgaagaagaagaagaagatgatgatgatgatgagttggaagacgagggggaagaagaagccagcatgccaaatgaaaattctgtgaaagagccagaaatacggtgtgatgagaagccagaagatttattagaggaaccaaaaacaacttcagaagaaactcttgaagactgctcagaggtaacacctgccatgcaaatccccagaactaaagaagaggccaatggtgatgtatttgaaacgtttatgtttccgtgtcaacattgtgaaaggaagtttacaaccaaacaggggcttgagcgtcacatgcatatccatatatccaccgtcaatcatgctttcaaatgcaagtactgtgggaaagcctttggcacacagattaaccggcggcgacatgagcggcgccatgaagcagggttaaagcggaaacccagccaaacactacagccgtcagaggatctggctgatggcaaagcatctggagaaaacgttgcttcaaaagatgattcgagtcctcccagtcttgggccagactgtctgatcatgaattcagagaaggcttcccaagacacaataaattcttctgtcgtagaagagaatggggaagttaaagaacttcatccgtgcaaatattgtaaaaaggtttttggaactcatactaatatgagacggcatcagcgtagagttcacgaacgtcatctgattcccaaaggtgtacggcgaaaaggaggccttgaagagccccagcctccagcagaacaggcccaggccacccagaacgtgtatgtaccaagcacagagccggaggaggaaggggaagcagatgatgtgtacatcatggacatttctagcaatatctctgaaaacttaaattactatattgatggtaaaattcaaactaataacaacactagtaactgtgatgtgattgagatggagtctgcttcggcagatttgtatggtataaattgtctgctcactccagttacagtggaaattactcaaaatataaagaccacacaggtccctgtaacagaagatcttcctaaagagcctttgggcagcacaaatagtgaggccaagaagcggagaactgcgagcccacctgcactgcccaaaattaaggccgaaacagactctgaccccatggtcccctcttgctctttaagtcttcctcttagcatatcaacaacagaggcagtgtctttccacaaagagaaaagtgtttatttgtcatcaaagctcaaacaacttcttcaaacccaagataaactaactcctgcagggatttcagcaactgaaatagctaaattaggtcctgtttgtgtgtctgctcctgcatcaatgttgcctgtgacctcaagtaggtttaagaggcggaccagctctcctcccagttctccacagcacagtcctgcccttcgagactttggaaagccaagtgatgggaaagcagcatggaccgatgccgggctgacttccaaaaaatccaaattagaaagtcacagcgactcaccagcatggagtttgtctgggagagatgagagagaaactgtgagccctccatgctttgatgaatataaaatgtctaaagagtggacagctagttctgcttttagcagtgtgtgcaaccagcagccactggatttatccagcggtgtcaaacagaaggctgagggtacaggcaagactccagtccagtgggaatctgtcttagatctcagtgtgcataaaaagcattgtagtgactctgaaggcaaggaattcaaagaaagtcattcagtgcagcctacgtgtagtgctgtaaagaaaaggaaaccaaccacctgcatgctgcagaaggttcttctcaatgaatataatggcatcgatttacctgtagaaaaccctgcagatgggaccaggagcccaagtccttgtaaatccctagaagctcagccagatcctgacctcggtccgggctctggtttccctgcccctactgttgagtccacacctgatgtttgtccttcatcacctgccctgcagacaccctccctttcatccggtcagctgcctcctctcttgatccccacagatccctcttcccctccaccctgtcccccggtattaactgttgccactccgccccctcccctccttcctaccgtacctcttccagccccctcttccagtgcatctccacacccatgcccctctccactctcaaatgccaccgcacagtccccacttccaattctgtccccaacagtgtccccctctccctctcccattcctcccgtggagcccctgatgtctgccgcctcacccgggcctccaacactttcttcttcctcctcttcatcttcctcctcctcttcgttttcttcttcatcttcctcctcttctccttctccacctcctctctccgcaatatcatctgttgtttcctctggtgataatctggaggcttctctccccatgatatctttcaaacaggaggaattagagaatgaaggtctgaaacccagggaagagccccagtctgctgctgaacaggatgttgttgttcaggaaacattcaacaaaaactttgtttgcaacgtctgtgaatcaccttttctttccattaaagatctaaccaaacatttatctattcatgctgaagaatggcccttcaaatgtgaattttgtgtgcagctttttaaggataaaacggacttgtcagaacatcgctttttgcttcatggagttgggaatatctttgtgtgttctgtttgtaaaaaagaatttgcttttttgtgcaatttgcagcagcaccagcgagatctccacccagataaggtgtgcacacatcacgagtttgaaagcgggactctgaggccccagaactttacagatcccagcaaggcccatgtagagcatatgcagagcttgccagaagatcctttagaaacttctaaagaagaagaggagttaaatgattcctctgaagagctttacacgactataaaaataatggcttctggaataaagacaaaagatccagatgttcgattgggcctcaatcagcattacccaagctttaaaccacctccatttcagtaccatcaccgtaaccccatggggattggtgtgacagccacaaatttcactacacacaatattccacagactttcactaccgccattcgctgcacaaagtgtggaaaaggtgtcgacaatatgccggagttgcacaaacatatcctggcttgtgcttctgcaagtgacaagaagaggtacacgcctaagaaaaacccagtaccattaaaacaaactgtgcaacccaaaaatggcgtggtggttttagataactctgggaaaaatgccttccgacgaatgggacagcccaaaaggcttaactttagtgttgagctcagcaaaatgtcgtcgaataagctcaaattaaatgcattgaagaaaaaaaatcagctagtacagaaagcaattcttcagaaaaacaaatctgcaaagcagaaggccgacttgaaaaatgcttgtgagtcatcctctcacatctgcccttactgtaatcgagagttcacttacattggaagcctgaataaacacgccgccttcagctgtcccaaaaaacccctttctcctcccaaaaaaaaagtttctcattcatctaagaaaggtggacactcatcacctgcaagtagtgacaaaaacagtaacagcaaccaccgcagacggacagcggatgcggagattaaaatgcaaagcatgcagactccgttgggcaagaccagagcccgcagctcaggccccacccaagtcccacttccctcctcatccttcaggtccaagcagaacgtcaagtttgcagcttcggtgaaatccaaaaaaccaagctcctcctctttaaggaactccagcccgataagaatggccaaaataactcatgttgaggggaaaaaacctaaagctgtggccaagaatcattctgctcagctttccagcaaaacatcacggagcctgcacgtgagggtacagaaaagcaaagctgttttacaaagcaaatccaccttggcgagtaagaaaagaacagaccggttcaatataaaatctagagagcggagtggggggccagtcacccggagccttcagctggcagctgctgctgacttgagtgagaacaagagagaggacggcagcgccaagcaggagctgaaggacttcagctacagcctccgcttggcgtcccgatgctctccaccagcggccccgtacatcaccaggcagtataggaaggtcaaagctccagctgcagcccagttccagggaccattcttcaaagagtagacactctggctgctccctgacagcacctgaagtgacctggaatcagtgaagccaaagggactggcagtctgccctgcagggagtaccgacctatcccagttgtgtgaggctgcgagagaaagggagtgcatgtgcgcgcgtgcatgtgtgcgtgcgtgtgtgttcacgtgttctcgtgcgggcgcgtgagtggtcttcaaacgagggtcccgatccccggggcggcaggaagggggccgactccacgctgtcctttgggatgatacttggatgcagctcttgggaccgtgttctgcagcccagccttcctgttggggtggggcctctcctactatgcaatttttcaagagctccttgaccctgctttttgcttcttgagttgtcttttgccattatggggactttggtttgacccaggggtcagccttaggaaggccttcaggaggaggccgagttccccttcagtaccacccctctctccccaccttccctctcccggcaacatctctgggaatcaacagcatattgacacgttggagccgagcctgaacatgcccctcggccccagcacatggaaaacccccttccttgcctaaggtgtctgagtttctggctcttgaggcatttccagacttgaaattctcatcagtccattgctcttgagtctttgcagagaacctcagatcaggtgcacctgggagaaagactttgtccccacttacagatctatctcctcccttgggaagggcagggaatggggacggtgtatggaggggagggatctcctgcgcccttcattgccacacttggtgggaccatgaacatctttagtgtctgagcttctcaaattagctgcaataggaaaaaaacaaattgggaaatgaaaaaaaaatgggaagattaaaaagcacagggggaagaagaagagatttcggaggccatcctgccaggggcggacggggctgactcctgctctctggaggacggtcagtccatgtctcggagaaacgggtgagctgagcttggcgtttggacccagttcagtgaggttcttgggttttgtgcctttggggcagaccccaggcaaggatgtctgagaccacttgggcgctgttttctcagctccaatttcaagagtgagctatcaaacccagagcggaaggagggagctctgatgagcacggtttgtcacacgataaagggattttttttttcagggctactacggttgatcttgcaactctgtaaatatgtatgtagacacttttaaaagcacgtatttatgtccctgactgtaaatgctccatttttaaagttttataacttgtgttatttaatgagtcagtcaatcggctgcagtatgggatctgataaggatctaggagaagggtctcatgcggaccctcacatgggcagaaaaatggtggtcattggccgacatcacagttttcctgtttcccacccagctaaaaaccgttgtttgctttaaattttcataaactggaatcctttcacccgctcctacagctaaccctcacaagcatgaagtgctgtggctgttccttatcctaatgatgcgcttttgtcccgtaaatgttaacactcatgaagcataccccggcctctcagttcttgagggcctccccaccgcagcagcaaggaaagctcacgaaccccaaacctggcaagtcacctgcagcccatggtgagctctgggaagtgtggttgaggccttggggtcactccttttttgcatgtgcaaatgtgctggtcacccttcaacgctcccagacggtcaggaaaactgttccaatcatgaaaaggggggatgattttgtaaaagtggcatttcctggtcagtggtggtcttcaagacgacagctctgtatctgccatgtgaagagaattaacaataaaagtgtgaagagcg

SEQ ID NO: 3262 - DNA, 7437 bp, Homo sapiens
gtaaaagtgacattctaaatgttcctcactctgcgaggcttattttttagggactttgctataattctgaaagacttagttttacagtacatctgaaagtaggagttttcagaagtatggctcttgggataaatttagattcttaattgtgaagctctgttaccacttgttagaaggcaggtcagctcacctgcttggggaggtaaatatatgaatgcactctcgagtaatttaatggagccctacctcaatgtacagaatgacagtatcacagatcaagaatggagtacgagtgattttcggctatggtgggggtaggtaggtcacttgtcccctgttgtctcttactatttgtaaagtgaagactatgattagtctttttgatcgggatggtttgagatgaataaagaataggcaggcaatttggatactttaggcttttcaagaacattagtaacattttttcttagatatttctcctaatacaatgagtgttgtgaaataacatggcagttattgttgagagaaaagccttcccagttatgtattgagtccttaggcgttttgaccttccctccactcttacagaacttggtggaaggggccactatgttttctacctccttccgtgcctttcacaaagccacatcctgcaccgtctacccttctctgtggatatttttccgcttggcaatttcctttcctgaggcacccacttgggacatctgaatctccatctccatgttgatggcccgtttgtgcttggacgtgttcttccacttgagactgagggttcatgtaatcaaagaagtttctttgttgtgtgtatctttacagaacacaacaggaattgaaaatgaatcagaacactactgagcctgtggcggccaccgagaccctggctgaggtacccgaacatgtgctgcgaggacttccggaggaagtgaggcttttcccttctgctgttgacaagacccggattggtgtctgggccactaaaccaattttaaaaggcaaaaaatttgggccatttgttggtgataagaaaaaaagatctcaggttaagaataatgtatacatgtgggaggtgtattacccaaatttgggatggatgtgcattgatgccactgatccagagaagggaaactggctgcgatatgtgaattgggcttgctcaggagaagagcaaaatttattcccactggaaatcaacagagccatttactataaaactttaaagccaatcgcgccgggcgaggagctcctggtctggtacaatggggaagacaaccctgagatagcagctgcgattgaggaagagcgagccagcgcccggagcaagcggagctcccccaagagccggaaagggaagaaaaaatcccaggaaaataaaaacaaaggaaacaaaatccaagacatacaactgaagacaagtgagccagatttcacctctgcaaatatgagagattctgcagaaggtcctaaagaagacgaagagaagccttcagcctcagcacttgagcagccggccaccctccaggaggtggccagtcaggaggtgcctccagaactagcaacccctgcccctgcctgggagccacagccagaaccagacgagcgattagaagcggcagcttgtgaggtgaatgatttgggggaagaggaggaggaggaagaggaggaggatgaagaagaagaagaagatgatgatgatgatgagttggaagacgagggggaagaagaagccagcatgccaaatgaaaattctgtgaaagagccagaaatacggtgtgatgagaagccagaagatttattagaggaaccaaaaacaacttcagaagaaactcttgaagactgctcagaggtaacacctgccatgcaaatccccagaactaaagaagaggccaatggtgatgtatttgaaacgtttatgtttccgtgtcaacattgtgaaaggaagtttacaaccaaacaggggcttgagcgtcacatgcatatccatatatccaccgtcaatcatgctttcaaatgcaagtactgtgggaaagcctttggcacacagattaaccggcggcgacatgagcggcgccatgaagcagggttaaagcggaaacccagccaaacactacagccgtcagaggatctggctgatggcaaagcatctggagaaaacgttgcttcaaaagatgattcgagtcctcccagtcttgggccagactgtctgatcatgaattcagagaaggcttcccaagacacaataaattcttctgtcgtagaagagaatggggaagttaaagaacttcatccgtgcaaatattgtaaaaaggtttttggaactcatactaatatgagacggcatcagcgtagagttcacgaacgtcatctgattcccaaaggtgtacggcgaaaaggaggccttgaagagccccagcctccagcagaacaggcccaggccacccagaacgtgtatgtaccaagcacagagccggaggaggaaggggaagcagatgatgtgtacatcatggacatttctagcaatatctctgaaaacttaaattactatattgatggtaaaattcaaactaataacaacactagtaactgtgatgtgattgagatggagtctgcttcggcagatttgtatggtataaattgtctgctcactccagttacagtggaaattactcaaaatataaagaccacacaggtccctgtaacagaagatcttcctaaagagcctttgggcagcacaaatagtgaggccaagaagcggagaactgcgagcccacctgcactgcccaaaattaaggccgaaacagactctgaccccatggtcccctcttgctctttaagtcttcctcttagcatatcaacaacagaggcagtgtctttccacaaagagaaaagtgtttatttgtcatcaaagctcaaacaacttcttcaaacccaagataaactaactcctgcagggatttcagcaactgaaatagctaaattaggtcctgtttgtgtgtctgctcctgcatcaatgttgcctgtgacctcaagtaggtttaagaggcggaccagctctcctcccagttctccacagcacagtcctgcccttcgagactttggaaagccaagtgatgggaaagcagcatggaccgatgccgggctgacttccaaaaaatccaaattagaaagtcacagcgactcaccagcatggagtttgtctgggagagatgagagagaaactgtgagccctccatgctttgatgaatataaaatgtctaaagagtggacagctagttctgcttttagcagtgtgtgcaaccagcagccactggatttatccagcggtgtcaaacagaaggctgagggtacaggcaagactccagtccagtgggaatctgtcttagatctcagtgtgcataaaaagcattgtagtgactctgaaggcaaggaattcaaagaaagtcattcagtgcagcctacgtgtagtgctgtaaagaaaaggaaaccaaccacctgcatgctgcagaaggttcttctcaatgaatataatggcatcgatttacctgtagaaaaccctgcagatgggaccaggagcccaagtccttgtaaatccctagaagctcagccagatcctgacctcggtccgggctctggtttccctgcccctactgttgagtccacacctgatgtttgtccttcatcacctgccctgcagacaccctccctttcatccggtcagctgcctcctctcttgatccccacagatccctcttcccctccaccctgtcccccggtattaactgttgccactccgccccctcccctccttcctaccgtacctcttccagccccctcttccagtgcatctccacacccatgcccctctccactctcaaatgccaccgcacagtccccacttccaattctgtccccaacagtgtccccctctccctctcccattcctcccgtggagcccctgatgtctgccgcctcacccgggcctccaacactttcttcttcctcctcttcatcttcctcctcctcttcgttttcttcttcatcttcctcctcttctccttctccacctcctctctccgcaatatcatctgttgtttcctctggtgataatctggaggcttctctccccatgatatctttcaaacaggaggaattagagaatgaaggtctgaaacccagggaagagccccagtctgctgctgaacaggatgttgttgttcaggaaacattcaacaaaaactttgtttgcaacgtctgtgaatcaccttttctttccattaaagatctaaccaaacatttatctattcatgctgaagaatggcccttcaaatgtgaattttgtgtgcagctttttaaggataaaacggacttgtcagaacatcgctttttgcttcatggagttgggaatatctttgtgtgttctgtttgtaaaaaagaatttgcttttttgtgcaatttgcagcagcaccagcgagatctccacccagataaggtgtgcacacatcacgagtttgaaagcgggactctgaggccccagaactttacagatcccagcaaggcccatgtagagcatatgcagagcttgccagaagatcctttagaaacttctaaagaagaagaggagttaaatgattcctctgaagagctttacacgactataaaaataatggcttctggaataaagacaaaagatccagatgttcgattgggcctcaatcagcattacccaagctttaaaccacctccatttcagtaccatcaccgtaaccccatggggattggtgtgacagccacaaatttcactacacacaatattccacagactttcactaccgccattcgctgcacaaagtgtggaaaaggtgtcgacaatatgccggagttgcacaaacatatcctggcttgtgcttctgcaagtgacaagaagaggtacacgcctaagaaaaacccagtaccattaaaacaaactgtgcaacccaaaaatggcgtggtggttttagataactctgggaaaaatgccttccgacgaatgggacagcccaaaaggcttaactttagtgttgagctcagcaaaatgtcgtcgaataagctcaaattaaatgcattgaagaaaaaaaatcagctagtacagaaagcaattcttcagaaaaacaaatctgcaaagcagaaggccgacttgaaaaatgcttgtgagtcatcctctcacatctgcccttactgtaatcgagagttcacttacattggaagcctgaataaacacgccgccttcagctgtcccaaaaaacccctttctcctcccaaaaaaaaagtttctcattcatctaagaaaggtggacactcatcacctgcaagtagtgacaaaaacagtaacagcaaccaccgcagacggacagcggatgcggagattaaaatgcaaagcatgcagactccgttgggcaagaccagagcccgcagctcaggccccacccaagtcccacttccctcctcatccttcaggtccaagcagaacgtcaagtttgcagcttcggtgaaatccaaaaaaccaagctcctcctctttaaggaactccagcccgataagaatggccaaaataactcatgttgaggggaaaaaacctaaagctgtggccaagaatcattctgctcagctttccagcaaaacatcacggagcctgcacgtgagggtacagaaaagcaaagctgttttacaaagcaaatccaccttggcgagtaagaaaagaacagaccggttcaatataaaatctagagagcggagtggggggccagtcacccggagccttcagctggcagctgctgctgacttgagtgagaacaagagagaggacggcagcgccaagcaggagctgaaggacttcaggaacttcctgtagaaaagcccccaaaacaaaacaaaccttaattgactaaaaagtattgcatgctcaacttaggataagcactacggcaaaggatacgaaatctaccaagcttgcaagaccagttgaagctgactcaaaaatcctaacattcagctgattgccggcaggcttagagtcaggcatctgctgcttcggtgggggcccaacgcgcatgctgggcgcccgggtgattgagatccaaagagaagggcactgtaagacaggccagatgaactggctcctcgtcatgggactggtacctcagatctgagcatggcccttgtttttggcacgtagcagagaaaggattgatttgaacttaaccttgcaaagcaagttgcctgttttagcagtagtttgttgtaggtttcagggatgacagatttggatgcactcatttaaaacgttttggtcacatatcagctcttgatgcctttcttttaaattaattatagacagagagaggcatttagctgatctcttacccctggtatttcttttttttgttgttttcgtttttttaaatcacaagtagattgccagcgtaatggagaggaaaccagattggatatggactcttttttatgcctattctggtgttgcgtttgtatatccaaatggacgttatcctctcagattcttatctggcactaatttataactattatattatcagagactatgtagcaatatatcagtgcacaggcgcatcccaggcctgtacagatgtatgtctacacgtaagtataaatgaatttgcataccaggttttacacttgcatctctaatagagattaaaaacaacaaattggcctcttcctaagtatattaatatcatttatccttacattttatgcctccccctaaattaatgactgagttggtggaaagcggctaggttttattcatactgttttttgttctcaacttcaaaagtaatctacctctgaaaaatttgtagtttaatatttgtttggtgaatttgtgccactttaatccttccactatcattcccattttgttacatttctgttatggggactttatgttgaaatattgtataaagcatttgtagcaatttaaaaataaaatatttaaaattatttaaattgttttggacgcttcaattgtattatatgtgatttacatttcactttttttgttggcgttgttaacccggagagtgctcctgtattgaactttgctgttagttattttattgcttctttttggagagtgctataaaagactattctaatgaaaacattaaaatttacaatttgacatacaaaaaggggttgtccattgattttaaccaatgtagcactgagagagagagaggttaattatagatagacaagagtggtgtttgttgtttttcccctcccagcattgaaatcattggggcttgtcagatgtattaaaaaaagatttgttgtgctattgctgcaaacacttaataactagaggagaatttaaacaatgcattttatattattgtaacc

SEQ ID NO: 3263 - DNA, 5797 bp, Homo sapiens
gagatagcagctgcgattgaggaagagcgagccagcgcccggagcaagcggagctcccccaagagccggaaagaccaagcggagcagccagctggcagtagcgccctgtaggacccccaggacccgatgggaagaaaaaatcccaggaaaataaaaacaaaggaaacaaaatccaagacatacaactgaagacaagtgagccagatttcacctctgcaaatatgagagattctgcagaaggtcctaaagaagacgaagagaagccttcagcctcagcacttgagcagccggccaccctccaggaggtggccagtcaggaggtgcctccagaactagcaacccctgcccctgcctgggagccacagccagaaccagacgagcgattagaagcggcagcttgtgaggtgaatgatttgggggaagaggaggaggaggaagaggaggaggatgaagaagaagaagaagatgatgatgatgatgagttggaagacgagggggaagaagaagccagcatgccaaatgaaaattctgtgaaagagccagaaatacggtgtgatgagaagccagaagatttattagaggaaccaaaaacaacttcagaagaaactcttgaagactgctcagaggtaacacctgccatgcaaatccccagaactaaagaagaggccaatggtgatgtatttgaaacgtttatgtttccgtgtcaacattgtgaaaggaagtttacaaccaaacaggggcttgagcgtcacatgcatatccatatatccaccgtcaatcatgctttcaaatgcaagtactgtgggaaagcctttggcacacagattaaccggcggcgacatgagcggcgccatgaagcagggttaaagcggaaacccagccaaacactacagccgtcagaggatctggctgatggcaaagcatctggagaaaacgttgcttcaaaagatgattcgagtcctcccagtcttgggccagactgtctgatcatgaattcagagaaggcttcccaagacacaataaattcttctgtcgtagaagagaatggggaagttaaagaacttcatccgtgcaaatattgtaaaaaggtttttggaactcatactaatatgagacggcatcagcgtagagttcacgaacgtcatctgattcccaaaggtgtacggcgaaaaggaggccttgaagagccccagcctccagcagaacaggcccaggccacccagaacgtgtatgtaccaagcacagagccggaggaggaaggggaagcagatgatgtgtacatcatggacatttctagcaatatctctgaaaacttaaattactatattgatggtaaaattcaaactaataacaacactagtaactgtgatgtgattgagatggagtctgcttcggcagatttgtatggtataaattgtctgctcactccagttacagtggaaattactcaaaatataaagaccacacaggtccctgtaacagaagatcttcctaaagagcctttgggcagcacaaatagtgaggccaagaagcggagaactgcgagcccacctgcactgcccaaaattaaggccgaaacagactctgaccccatggtcccctcttgctctttaagtcttcctcttagcatatcaacaacagaggcagtgtctttccacaaagagaaaagtgtttatttgtcatcaaagctcaaacaacttcttcaaacccaagataaactaactcctgcagggatttcagcaactgaaatagctaaattaggtcctgtttgtgtgtctgctcctgcatcaatgttgcctgtgacctcaagtaggtttaagaggcggaccagctctcctcccagttctccacagcacagtcctgcccttcgagactttggaaagccaagtgatgggaaagcagcatggaccgatgccgggctgacttccaaaaaatccaaattagaaagtcacagcgactcaccagcatggagtttgtctgggagagatgagagagaaactgtgagccctccatgctttgatgaatataaaatgtctaaagagtggacagctagttctgcttttagcagtgtgtgcaaccagcagccactggatttatccagcggtgtcaaacagaaggctgagggtacaggcaagactccagtccagtgggaatctgtcttagatctcagtgtgcataaaaagcattgtagtgactctgaaggcaaggaattcaaagaaagtcattcagtgcagcctacgtgtagtgctgtaaagaaaaggaaaccaaccacctgcatgctgcagaaggttcttctcaatgaatataatggcatcgatttacctgtagaaaaccctgcagatgggaccaggagcccaagtccttgtaaatccctagaagctcagccagatcctgacctcggtccgggctctggtttccctgcccctactgttgagtccacacctgatgtttgtccttcatcacctgccctgcagacaccctccctttcatccggtcagctgcctcctctcttgatccccacagatccctcttcccctccaccctgtcccccggtattaactgttgccactccgccccctcccctccttcctaccgtacctcttccagccccctcttccagtgcatctccacacccatgcccctctccactctcaaatgccaccgcacagtccccacttccaattctgtccccaacagtgtccccctctccctctcccattcctcccgtggagcccctgatgtctgccgcctcacccgggcctccaacactttcttcttcctcctcttcatcttcctcctcctcttcgttttcttcttcatcttcctcctcttctccttctccacctcctctctccgcaatatcatctgttgtttcctctggtgataatctggaggcttctctccccatgatatctttcaaacaggaggaattagagaatgaaggtctgaaacccagggaagagccccagtctgctgctgaacaggatgttgttgttcaggaaacattcaacaaaaactttgtttgcaacgtctgtgaatcaccttttctttccattaaagatctaaccaaacatttatctattcatgctgaagaatggcccttcaaatgtgaattttgtgtgcagctttttaaggataaaacggacttgtcagaacatcgctttttgcttcatggagttgggaatatctttgtgtgttctgtttgtaaaaaagaatttgcttttttgtgcaatttgcagcagcaccagcgagatctccacccagataaggtgtgcacacatcacgagtttgaaagcgggactctgaggccccagaactttacagatcccagcaaggcccatgtagagcatatgcagagcttgccagaagatcctttagaaacttctaaagaagaagaggagttaaatgattcctctgaagagctttacacgactataaaaataatggcttctggaataaagacaaaagatccagatgttcgattgggcctcaatcagcattacccaagctttaaaccacctccatttcagtaccatcaccgtaaccccatggggattggtgtgacagccacaaatttcactacacacaatattccacagactttcactaccgccattcgctgcacaaagtgtggaaaaggtgtcgacaatatgccggagttgcacaaacatatcctggcttgtgcttctgcaagtgacaagaagaggtacacgcctaagaaaaacccagtaccattaaaacaaactgtgcaacccaaaaatggcgtggtggttttagataactctgggaaaaatgccttccgacgaatgggacagcccaaaaggcttaactttagtgttgagctcagcaaaatgtcgtcgaataagctcaaattaaatgcattgaagaaaaaaaatcagctagtacagaaagcaattcttcagaaaaacaaatctgcaaagcagaaggccgacttgaaaaatgcttgtgagtcatcctctcacatctgcccttactgtaatcgagagttcacttacattggaagcctgaataaacacgccgccttcagctgtcccaaaaaacccctttctcctcccaaaaaaaaagtttctcattcatctaagaaaggtggacactcatcacctgcaagtagtgacaaaaacagtaacagcaaccaccgcagacggacagcggatgcggagattaaaatgcaaagcatgcagactccgttgggcaagaccagagcccgcagctcaggccccacccaagtcccacttccctcctcatccttcaggtccaagcagaacgtcaagtttgcagcttcggtgaaatccaaaaaaccaagctcctcctctttaaggaactccagcccgataagaatggccaaaataactcatgttgaggggaaaaaacctaaagctgtggccaagaatcattctgctcagctttccagcaaaacatcacggagcctgcacgtgagggtacagaaaagcaaagctgttttacaaagcaaatccaccttggcgagtaagaaaagaacagaccggttcaatataaaatctagagagcggagtggggggccagtcacccggagccttcagctggcagctgctgctgacttgagtgagaacaagagagaggacggcagcgccaagcaggagctgaaggacttcaggaacttcctgtagaaaagcccccaaaacaaaacaaaccttaattgactaaaaagtattgcatgctcaacttaggataagcactacggcaaaggatacgaaatctaccaagcttgcaagaccagttgaagctgactcaaaaatcctaacattcagctgattgccggcaggcttagagtcaggcatctgctgcttcggtgggggcccaacgcgcatgctgggcgcccgggtgattgagatccaaagagaagggcactgtaagacaggccagatgaactggctcctcgtcatgggactggtacctcagatctgagcatggcccttgtttttggcacgtagcagagaaaggattgatttgaacttaaccttgcaaagcaagttgcctgttttagcagtagtttgttgtaggtttcagggatgacagatttggatgcactcatttaaaacgttttggtcacatatcagctcttgatgcctttcttttaaattaattatagacagagagaggcatttagctgatctcttacccctggtatttcttttttttgttgttttcgtttttttaaatcacaagtagattgccagcgtaatggagaggaaaccagattggatatggactcttttttatgcctattctggtgttgcgtttgtatatccaaatggacgttatcctctcagattcttatctggcactaatttataactattatattatcagagactatgtagcaatatatcagtgcacaggcgcatcccaggcctgtacagatgtatgtctacacgtaagtataaatgaatttgcataccaggttttacacttgcatctctaatagagattaaaaacaacaaattggcctcttcctaagtatattaatatcatttatccttacattttatgcctccccctaaattaatgactgagttggtggaaagcggctaggttttattcatactgttttttgttctcaacttcaaaagtaatctacctctgaaaaatttgtagtttaatatttgtttggtgaatttgtgccactttaatccttccactatcattcccattttgttacatttctgttatggggactttatgttgaaatattgtataaagcatttgtagcaatttaaaaataaaatatttaaaatta

SEQ ID NO: 3264 - DNA, 2688 bp, Homo sapiens
gcgaaacagcggcggcggcggcggccctcggtgctctgaggcgctggcgcggcgggcgcggggttcatgtaatcaaagaagtttctttgttgtgtgtatctttacagaacacaacaggaattgaaaatgaatcagaacactactgagcctgtggcggccaccgagaccctggctgaggtacccgaacatgtgctgcgaggacttccggaggaagtgaggcttttcccttctgctgttgacaagacccggattggtgtctgggccactaaaccaattttaaaaggcaaaaaatttgggccatttgttggtgataagaaaaaaagatctcaggttaagaataatgtatacatgtgggaggtgtattacccaaatttgggatggatgtgcattgatgccactgatccagagaagggaaactggctgcgatatgtgaattgggcttgctcaggagaagagcaaaatttattcccactggaaatcaacagagccatttactataaaactttaaagccaatcgcgccgggcgaggagctcctggtctggtacaatggggaagacaaccctgagatagcagctgcgattgaggaagagcgagccagcgcccggagcaagcggagctcccccaagagccggaaagctacagcctccgcttggcgtcccgatgctctccaccagcggccccgtacatcaccaggcagtataggaaggtcaaagctccagctgcagcccagttccagggaccattcttcaaagagtagacactctggctgctccctgacagcacctgaagtgacctggaatcagtgaagccaaagggactggcagtctgccctgcagggagtaccgacctatcccagttgtgtgaggctgcgagagaaagggagtgcatgtgcgcgcgtgcatgtgtgcgtgcgtgtgtgttcacgtgttctcgtgcgggcgcgtgagtggtcttcaaacgagggtcccgatccccggggcggcaggaagggggccgactccacgctgtcctttgggatgatacttggatgcagctcttgggaccgtgttctgcagcccagccttcctgttggggtggggcctctcctactatgcaatttttcaagagctccttgaccctgctttttgcttcttgagttgtcttttgccattatggggactttggtttgacccaggggtcagccttaggaaggccttcaggaggaggccgagttccccttcagtaccacccctctctccccaccttccctctcccggcaacatctctgggaatcaacagcatattgacacgttggagccgagcctgaacatgcccctcggccccagcacatggaaaacccccttccttgcctaaggtgtctgagtttctggctcttgaggcatttccagacttgaaattctcatcagtccattgctcttgagtctttgcagagaacctcagatcaggtgcacctgggagaaagactttgtccccacttacagatctatctcctcccttgggaagggcagggaatggggacggtgtatggaggggagggatctcctgcgcccttcattgccacacttggtgggaccatgaacatctttagtgtctgagcttctcaaattagctgcaataggaaaaaaacaaattgggaaatgaaaaaaaaatgggaagattaaaaagcacagggggaagaagaagagatttcggaggccatcctgccaggggcggacggggctgactcctgctctctggaggacggtcagtccatgtctcggagaaacgggtgagctgagcttggcgtttggacccagttcagtgaggttcttgggttttgtgcctttggggcagaccccaggcaaggatgtctgagaccacttgggcgctgttttctcagctccaatttcaagagtgagctatcaaacccagagcggaaggagggagctctgatgagcacggtttgtcacacgataaagggattttttttttcagggctactacggttgatcttgcaactctgtaaatatgtatgtagacacttttaaaagcacgtatttatgtccctgactgtaaatgctccatttttaaagttttataacttgtgttatttaatgagtcagtcaatcggctgcagtatgggatctgataaggatctaggagaagggtctcatgcggaccctcacatgggcagaaaaatggtggtcattggccgacatcacagttttcctgtttcccacccagctaaaaaccgttgtttgctttaaattttcataaactggaatcctttcacccgctcctacagctaaccctcacaagcatgaagtgctgtggctgttccttatcctaatgatgcgcttttgtcccgtaaatgttaacactcatgaagcataccccggcctctcagttcttgagggcctccccaccgcagcagcaaggaaagctcacgaaccccaaacctggcaagtcacctgcagcccatggtgagctctgggaagtgtggttgaggccttggggtcactccttttttgcatgtgcaaatgtgctggtcacccttcaacgctcccagacggtcaggaaaactgttccaatcatgaaaaggggggatgattttgtaaaagtggcatttcctggtcagtggtggtcttcaagacgacagctctgtatctgccatgtgaagagaattaacaataaaagtgtgaagagcg

SEQ ID NO: 3265 - DNA, 5902 bp, Homo sapiens
gtaaaagtgacattctaaatgttcctcactctgcgaggcttattttttagggactttgctataattctgaaagacttagttttacagtacatctgaaagtaggagttttcagaagtatggctcttgggataaatttagattcttaattgtgaagctctgttaccacttgttagaaggcaggtcagctcacctgcttggggaggtaaatatatgaatgcactctcgagtaatttaatggagccctacctcaatgtacagaatgacagtatcacagatcaagaatggagtacgagtgattttcggctatggtgggggtaggtaggtcacttgtcccctgttgtctcttactatttgtaaagtgaagactatgattagtctttttgatcgggatggtttgagatgaataaagaataggcaggcaatttggatactttaggcttttcaagaacattagtaacattttttcttagatatttctcctaatacaatgagtgttgtgaaataacatggcagttattgttgagagaaaagccttcccagttatgtattgagtccttaggcgttttgaccttccctccactcttacagaacttggtggaaggggccactatgttttctacctccttccgtgcctttcacaaagccacatcctgcaccgtctacccttctctgtggatatttttccgcttggcaatttcctttcctgaggcacccacttgggacatctgaatctccatctccatgttgatggcccgtttgtgcttggacgtgttcttccacttgagactgagggttcatgtaatcaaagaagtttctttgttgtgtgtatctttacagaacacaacaggaattgaaaatgaatcagaacactactgagcctgtggcggccaccgagaccctggctgaggtacccgaacatgtgctgcgaggacttccggaggaagtgaggcttttcccttctgctgttgacaagacccggattggtgtctgggccactaaaccaattttaaaaggcaaaaaatttgggccatttgttggtgataagaaaaaaagatctcaggttaagaataatgtatacatgtgggaggtgtattacccaaatttgggatggatgtgcattgatgccactgatccagagaagggaaactggctgcgatatgtgaattgggcttgctcaggagaagagcaaaatttattcccactggaaatcaacagagccatttactataaaactttaaagccaatcgcgccgggcgaggagctcctggtctggtacaatggggaagacaaccctgagatagcagctgcgattgaggaagagcgagccagcgcccggagcaagcggagctcccccaagagccggaaagggaagaaaaaatcccaggaaaataaaaacaaaggaaacaaaatccaagacatacaactgaagacaagtgagccagatttcacctctgcaaatatgagagattctgcagaaggtcctaaagaagacgaagagaagccttcagcctcagcacttgagcagccggccaccctccaggaggtggccagtcaggaggtgcctccagaactagcaacccctgcccctgcctgggagccacagccagaaccagacgagcgattagaagcggcagcttgtgaggtgaatgatttgggggaagaggaggaggaggaagaggaggaggatgaagaagaagaagaagatgatgatgatgatgagttggaagacgagggggaagaagaagccagcatgccaaatgaaaattctgtgaaagagccagaaatacggtgtgatgagaagccagaagatttattagaggaaccaaaaacaacttcagaagaaactcttgaagactgctcagaggtaacacctgccatgcaaatccccagaactaaagaagaggccaatggtgatgtatttgaaacgtttatgtttccgtgtcaacattgtgaaaggaagtttacaaccaaacaggggcttgagcgtcacatgcatatccatatatccaccgtcaatcatgctttcaaatgcaagtactgtgggaaagcctttggcacacagattaaccggcggcgacatgagcggcgccatgaagcagggttaaagcggaaacccagccaaacactacagccgtcagaggatctggctgatggcaaagcatctggagaaaacgttgcttcaaaagatgattcgagtcctcccagtcttgggccagactgtctgatcatgaattcagagaaggcttcccaagacacaataaattcttctgtcgtagaagagaatggggaagttaaagaacttcatccgtgcaaatattgtaaaaaggtttttggaactcatactaatatgagacggcatcagcgtagagttcacgaacgtcatctgattcccaaaggtgtacggcgaaaaggaggccttgaagagccccagcctccagcagaacaggcccaggccacccagaacgtgtatgtaccaagcacagagccggaggaggaaggggaagcagatgatgtgtacatcatggacatttctagcaatatctctgaaaacttaaattactatattgatggtaaaattcaaactaataacaacactagtaactgtgatgtgattgagatggagtctgcttcggcagatttgtatggtataaattgtctgctcactccagttacagtggaaattactcaaaatataaagaccacacaggtccctgtaacagaagatcttcctaaagagcctttgggcagcacaaatagtgaggccaagaagcggagaactgcgagcccacctgcactgcccaaaattaaggccgaaacagactctgaccccatggtcccctcttgctctttaagtcttcctcttagcatatcaacaacagaggcagtgtctttccacaaagagaaaagtgtttatttgtcatcaaagctcaaacaacttcttcaaacccaagataaactaactcctgcagggatttcagcaactgaaatagctaaattaggtcctgtttgtgtgtctgctcctgcatcaatgttgcctgtgacctcaagtaggtttaagaggcggaccagctctcctcccagttctccacagcacagtcctgcccttcgagactttggaaagccaagtgatgggaaagcagcatggaccgatgccgggctgacttccaaaaaatccaaattagaaagtcacagcgactcaccagcatggagtttgtctgggagagatgagagagaaactgtgagccctccatgctttgatgaatataaaatgtctaaagagtggacagctagttctgcttttagcagtgtgtgcaaccagcagccactggatttatccagcggtgtcaaacagaaggctgagggtacaggcaagactccagtccagtgggaatctgtcttagatctcagtgtgcataaaaagcattgtagtgactctgaaggcaaggaattcaaagaaagtcattcagtgcagcctacgtgtagtgctgtaaagaaaaggaaaccaaccacctgcatgctgcagaaggttcttctcaatgaatataatggcatcgatttacctgtagaaaaccctgcagatgggaccaggagcccaagtccttgtaaatccctagaagctcagccagatcctgacctcggtccgggctctggtttccctgcccctactgttgagtccacacctgatgtttgtccttcatcacctgccctgcagacaccctccctttcatccggtcagctgcctcctctcttgatccccacagatccctcttcccctccaccctgtcccccggtattaactgttgccactccgccccctcccctccttcctaccgtacctcttccagccccctcttccagtgcatctccacacccatgcccctctccactctcaaatgccaccgcacagtccccacttccaattctgtccccaacagtgtccccctctccctctcccattcctcccgtggagcccctgatgtctgccgcctcacccgggcctccaacactttcttcttcctcctcttcatcttcctcctcctcttcgttttcttcttcatcttcctcctcttctccttctccacctcctctctccgcaatatcatctgttgtttcctctggtgataatctggaggcttctctccccatgatatctttcaaacaggaggaattagagaatgaaggtctgaaacccagggaagagccccagtctgctgctgaacaggatgttgttgttcaggaaacattcaacaaaaactttgtttgcaacgtctgtgaatcaccttttctttccattaaagatctaaccaaacatttatctattcatgctgaagaatggcccttcaaatgtgaattttgtgtgcagctttttaaggataaaacggacttgtcagaacatcgctttttgcttcatggagttgggaatatctttgtgtgttctgtttgtaaaaaagaatttgcttttttgtgcaatttgcagcagcaccagcgagatctccacccagataaggtgtgcacacatcacgagtttgaaagcgggactctgaggccccagaactttacagatcccagcaaggcccatgtagagcatatgcagagcttgccagaagatcctttagaaacttctaaagaagaagaggagttaaatgattcctctgaagagctttacacgactataaaaataatggcttctggaataaagacaaaagatccagatgttcgattgggcctcaatcagcattacccaagctttaaaccacctccatttcagtaccatcaccgtaaccccatggggattggtgtgacagccacaaatttcactacacacaatattccacagactttcactaccgccattcgctgcacaaagtgtggaaaaggtgtcgacaatatgccggagttgcacaaacatatcctggcttgtgcttctgcaagtgacaagaagaggtacacgcctaagaaaaacccagtaccattaaaacaaactgtgcaacccaaaaatggcgtggtggttttagataactctgggaaaaatgccttccgacgaatgggacagcccaaaaggcttaactttagtgttgagctcagcaaaatgtcgtcgaataagctcaaattaaatgcattgaagaaaaaaaatcagctagtacagaaagcaattcttcagaaaaacaaatctgcaaagcagaaggccgacttgaaaaatgcttgtgagtcatcctctcacatctgcccttactgtaatcgagagttcacttacattggaagcctgaataaacacgccgccttcagctgtcccaaaaaacccctttctcctcccaaaaaaaaagtttctcattcatctaagaaaggtggacactcatcacctgcaagtagtgacaaaaacagtaacagcaaccaccgcagacggacagcggatgcggagattaaaatgcaaagcatgcagactccgttgggcaagaccagagcccgcagctcaggccccacccaagtcccacttccctcctcatccttcaggtccaagcagaacgtcaagtttgcagcttcggtgaaatccaaaaaaccaagctcctcctctttaaggaactccagcccgataagaatggccaaaataactcatgttgaggggaaaaaacctaaagctgtggccaagaatcattctgctcagctttccagcaaaacatcacggagcctgcacgtgagggtacagaaaagcaaagctgttttacaaagcaaatccaccttggcgagtaagaaaagaacagaccggttcaatataaaatctagagagcggagtggggggccagtcacccggagccttcagctggcagctgctgctgacttgagtgagaacaagagagaggacggcagcgccaagcaggagctgaaggacttcaggtgttttttg

SEQ ID NO: 3266 - DNA, 513 bp, Homo sapiens
gaagagcgagccagcgcccggagcaagcggagctcccccaagagccggaaagtgttgtcctgtccctctgctgttccttgtcatcatttccatttcacttcccttgtgtttcattcctctttcttgtctagaccaagcggagcagccagctggcagtagcgccctgtaggacccccaggacccgatgggaagaaaaaatcccaggaaaataaaaacaaaggaaacaaaatccaagacatacaactgaagacaagtgagccagatttcacctctgcaaatatgagagattctgcagaaggtcctaaagaagacgaagagaagccttcagcctcagcacttgagcagccggccaccctccaggaggtggccagtcaggaggtgcctccagaactagcaacccctgcccctgcctgggagccacagccagaaccagacgagcgattagaagcggcagcttgtgaggtgaatgatttgggggaagaggaggaggaggaagaggaggaggatgaagaa

SEQ ID NO: 3267 - DNA, 6175 bp, Homo sapiens
gaagacaaccctgagatagcagctgcgattgaggaagagcgagccagcgcccggagcaagcggagctcccccaagagccggaaagggaagaaaaaatcccaggaaaataaaaacaaaggaaacaaaatccaagacatacaactgaagacaagtgagccagatttcacctctgcaaatatgagagattctgcagaaggtcctaaagaagacgaagagaagccttcagcctcagcacttgagcagccggccaccctccaggaggtggccagtcaggaggtgcctccagaactagcaacccctgcccctgcctgggagccacagccagaaccagacgagcgattagaagcggcagcttgtgaggtgaatgatttgggggaagaggaggaggaggaagaggaggaggatgaagaagaagaagaagatgatgatgatgatgagttggaagacgagggggaagaagaagccagcatgccaaatgaaaattctgtgaaagagccagaaatacggtgtgatgagaagccagaagatttattagaggaaccaaaaacaacttcagaagaaactcttgaagactgctcagaggtaacacctgccatgcaaatccccagaactaaagaagaggccaatggtgatgtatttgaaacgtttatgtttccgtgtcaacattgtgaaaggaagtttacaaccaaacaggggcttgagcgtcacatgcatatccatatatccaccgtcaatcatgctttcaaatgcaagtactgtgggaaagcctttggcacacagattaaccggcggcgacatgagcggcgccatgaagcagggttaaagcggaaacccagccaaacactacagccgtcagaggatctggctgatggcaaagcatctggagaaaacgttgcttcaaaagatgattcgagtcctcccagtcttgggccagactgtctgatcatgaattcagagaaggcttcccaagacacaataaattcttctgtcgtagaagagaatggggaagttaaagaacttcatccgtgcaaatattgtaaaaaggtttttggaactcatactaatatgagacggcatcagcgtagagttcacgaacgtcatctgattcccaaaggtgtacggcgaaaaggaggccttgaagagccccagcctccagcagaacaggcccaggccacccagaacgtgtatgtaccaagcacagagccggaggaggaaggggaagcagatgatgtgtacatcatggacatttctagcaatatctctgaaaacttaaattactatattgatggtaaaattcaaactaataacaacactagtaactgtgatgtgattgagatggagtctgcttcggcagatttgtatggtataaattgtctgctcactccagttacagtggaaattactcaaaatataaagaccacacaggtccctgtaacagaagatcttcctaaagagcctttgggcagcacaaatagtgaggccaagaagcggagaactgcgagcccacctgcactgcccaaaattaaggccgaaacagactctgaccccatggtcccctcttgctctttaagtcttcctcttagcatatcaacaacagaggcagtgtctttccacaaagagaaaagtgtttatttgtcatcaaagctcaaacaacttcttcaaacccaagataaactaactcctgcagggatttcagcaactgaaatagctaaattaggtcctgtttgtgtgtctgctcctgcatcaatgttgcctgtgacctcaagtaggtttaagaggcggaccagctctcctcccagttctccacagcacagtcctgcccttcgagactttggaaagccaagtgatgggaaagcagcatggaccgatgccgggctgacttccaaaaaatccaaattagaaagtcacagcgactcaccagcatggagtttgtctgggagagatgagagagaaactgtgagccctccatgctttgatgaatataaaatgtctaaagagtggacagctagttctgcttttagcagtgtgtgcaaccagcagccactggatttatccagcggtgtcaaacagaaggctgagggtacaggcaagactccagtccagtgggaatctgtcttagatctcagtgtgcataaaaagcattgtagtgactctgaaggcaaggaattcaaagaaagtcattcagtgcagcctacgtgtagtgctgtaaagaaaaggaaaccaaccacctgcatgctgcagaaggttcttctcaatgaatataatggcatcgatttacctgtagaaaaccctgcagatgggaccaggagcccaagtccttgtaaatccctagaagctcagccagatcctgacctcggtccgggctctggtttccctgcccctactgttgagtccacacctgatgtttgtccttcatcacctgccctgcagacaccctccctttcatccggtcagctgcctcctctcttgatccccacagatccctcttcccctccaccctgtcccccggtattaactgttgccactccgccccctcccctccttcctaccgtacctcttccagccccctcttccagtgcatctccacacccatgcccctctccactctcaaatgccaccgcacagtccccacttccaattctgtccccaacagtgtccccctctccctctcccattcctcccgtggagcccctgatgtctgccgcctcacccgggcctccaacactttcttcttcctcctcttcatcttcctcctcctcttcgttttcttcttcatcttcctcctcttctccttctccacctcctctctccgcaatatcatctgttgtttcctctggtgataatctggaggcttctctccccatgatatctttcaaacaggaggaattagagaatgaaggtctgaaacccagggaagagccccagtctgctgctgaacaggatgttgttgttcaggaaacattcaacaaaaactttgtttgcaacgtctgtgaatcaccttttctttccattaaagatctaaccaaacatttatctattcatgctgaagaatggcccttcaaatgtgaattttgtgtgcagctttttaaggataaaacggacttgtcagaacatcgctttttgcttcatggagttgggaatatctttgtgtgttctgtttgtaaaaaagaatttgcttttttgtgcaatttgcagcagcaccagcgagatctccacccagataaggtgtgcacacatcacgagtttgaaagcgggactctgaggccccagaactttacagatcccagcaaggcccatgtagagcatatgcagagcttgccagaagatcctttagaaacttctaaagaagaagaggagttaaatgattcctctgaagagctttacacgactataaaaataatggcttctggaataaagacaaaagatccagatgttcgattgggcctcaatcagcattacccaagctttaaaccacctccatttcagtaccatcaccgtaaccccatggggattggtgtgacagccacaaatttcactacacacaatattccacagactttcactaccgccattcgctgcacaaagtgtggaaaaggtgtcgacaatatgccggagttgcacaaacatatcctggcttgtgcttctgcaagtgacaagaagaggtacacgcctaagaaaaacccagtaccattaaaacaaactgtgcaacccaaaaatggcgtggtggttttagataactctgggaaaaatgccttccgacgaatgggacagcccaaaaggcttaactttagtgttgagctcagcaaaatgtcgtcgaataagctcaaattaaatgcattgaagaaaaaaaatcagctagtacagaaagcaattcttcagaaaaacaaatctgcaaagcagaaggccgacttgaaaaatgcttgtgagtcatcctctcacatctgcccttactgtaatcgagagttcacttacattggaagcctgaataaacacgccgccttcagctgtcccaaaaaacccctttctcctcccaaaaaaaaagtttctcattcatctaagaaaggtggacactcatcacctgcaagtagtgacaaaaacagtaacagcaaccaccgcagacggacagcggatgcggagattaaaatgcaaagcatgcagactccgttgggcaagaccagagcccgcagctcaggccccacccaagtcccacttccctcctcatccttcaggtccaagcagaacgtcaagtttgcagcttcggtgaaatccaaaaaaccaagctcctcctctttaaggaactccagcccgataagaatggccaaaataactcatgttgaggggaaaaaacctaaagctgtggccaagaatcattctgctcagctttccagcaaaacatcacggagcctgcacgtgagggtacagaaaagcaaagctgttttacaaagcaaatccaccttggcgagtaagaaaagaacagaccggttcaatataaaatctagagagcggagtggggggccagtcacccggagccttcagctggcagctgctgctgacttgagtgagaacaagagagaggacggcagcgccaagcaggagctgaaggacttcaggaacttcctgtagaaaagcccccaaaacaaaacaaaccttaattgactaaaaagtattgcatgctcaacttaggataagcactacggcaaaggatacgaaatctaccaagcttgcaagaccagttgaagctgactcaaaaatcctaacattcagctgattgccggcaggcttagagtcaggcatctgctgcttcggtgggggcccaacgcgcatgctgggcgcccgggtgattgagatccaaagagaagggcactgtaagacaggccagatgaactggctcctcgtcatgggactggtacctcagatctgagcatggcccttgtttttggcacgtagcagagaaaggattgatttgaacttaaccttgcaaagcaagttgcctgttttagcagtagtttgttgtaggtttcagggatgacagatttggatgcactcatttaaaacgttttggtcacatatcagctcttgatgcctttcttttaaattaattatagacagagagaggcatttagctgatctcttacccctggtatttcttttttttgttgttttcgtttttttaaatcacaagtagattgccagcgtaatggagaggaaaccagattggatatggactcttttttatgcctattctggtgttgcgtttgtatatccaaatggacgttatcctctcagattcttatctggcactaatttataactattatattatcagagactatgtagcaatatatcagtgcacaggcgcatcccaggcctgtacagatgtatgtctacacgtaagtataaatgaatttgcataccaggttttacacttgcatctctaatagagattaaaaacaacaaattggcctcttcctaagtatattaatatcatttatccttacattttatgcctccccctaaattaatgactgagttggtggaaagcggctaggttttattcatactgttttttgttctcaacttcaaaagtaatctacctctgaaaaatttgtagtttaatatttgtttggtgaatttgtgccactttaatccttccactatcattcccattttgttacatttctgttatggggactttatgttgaaatattgtataaagcatttgtagcaatttaaaaataaaatatttaaaattatttaaattgttttggacgcttcaattgtattatatgtgatttacatttcactttttttgttggcgttgttaacccggagagtgctcctgtattgaactttgctgttagttattttattgcttctttttggagagtgctataaaagactattctaatgaaaacattaaaatttacaatttgacatacaaaaaggggttgtccattgattttaaccaatgtagcactgagagagagagaggttaattatagatagacaagagtggtgtttgttgtttttcccctcccagcattgaaatcattggggcttgtcagatgtattaaaaaaagatttgttgtgctattgctgcaaacacttaataactagaggagaatttaaacaatgcattttatattattgtaaccaataaaaaactttctaaaca

SEQ ID NO: 3268 - DNA, 1291 bp, Homo sapiens
ctcccggccccggcgcaggcgcaggcgcgggcacacgcgccgccgcccgccggtccttcccttcggcggaggtgggggaaggaggagtcatcccgtttaaccctgggctccccgaactctccttaatttgctaaatttgcagcttgctaattcctcctgctttctccttccttccttcttctggctcactccctgccccgataccaaagtctggtttatattcagtgcaaattggagcaaaccctacccttcacctctctcccgccaccccccatccttctgcattgctttccatcgaactctgcaaattttgcaatagggggagggatttttaaaattgcatttgcaaagttcggtgtctgggctggcgagtgggggagggagggaatggggagtaggccccgcccctaccgtcctttgcaaataaaaatctagcggggcggggggggggaggagcaggaagtggcggtgcgagggctgctgcacagcgagcggagccgcggtccggacggcagcgcgtgccccgagctctccgcctccccccgcccgccagccgaggcagctcgagcccagtccgcggccccagcagcagcgccgagagcagccccagtagcagcgccatggccgggtggaacgcctacatcgacaacctcatggcggacgggacctgtcaggacgcggccatcgtgggctacaaggactcgccctccgtctgggccgccgtccccgggaaaacgttcgtcaacatcacgccagctgaggtgggtgtcctggttggcaaagaccggtcaagtttttacgtgaatgggctgacacttgggggccagaaatgttcggtgatccgggactcactgctgcaggatggggaatttagcatggatcttcgtaccaagagcaccggtggggcccccaccttcaatgtcactgtcaccaagactgacaagacgctagtcctgctgatgggcaaagaaggtgtccacggtggtttgatcaacaagaaatgttatgaaatggcctcccaccttcggcgttcccagtactgacctcgtctgtcccttccccttcaccgctccccacagctttgcacccctttcctccccatacacacacaaaccattttattttttgggccattaccccataccccttattgctgccaaaaccacatgggctgggggccagggctggatggacagacacctccccctacccatatccctcccgtgtgtggttggaaaacttttgttttttggggttttttttttctgaataaaaaagattctactaacaa

SEQ ID NO: 3269 - DNA, 2496 bp, Homo sapiens
atgactgagctgaaggcaaagggtccccgggctccccacgtggcgggcggcccgccctcccccgaggtcggatccccactgctgtgtcgcccagccgcaggtccgttcccggggagccagacctcggacaccttgcctgaagtttcggccatacctatctccctggacgggctactcttccctcggccctgccagggacaggacccctccgacgaaaagacgcaggaccagcagtcgctgtcggacgtggagggcgcatattccagagctgaagctacaaggggtgctggaggcagcagttctagtcccccagaaaaggacagcggactgctggacagtgtcttggacactctgttggcgccctcaggtcccgggcagagccaacccagccctcccgcctgcgaggtcaccagctcttggtgcctgtttggccccgaacttcccgaagatccaccggctgcccccgccacccagcgggtgttgtccccgctcatgagccggtccgggtgcaaggttggagacagctccgggacggcagctgcccataaagtgctgccccggggcctgtcaccagcccggcagctgctgctcccggcctctgagagccctcactggtccggggccccagtgaagccgtctccgcaggccgctgcggtggaggttgaggaggaggatggctctgagtccgaggagtctgcgggtccgcttctgaagggcaaacctcgggctctgggtggcgcggcggctggaggaggagccgcggctgtcccgccgggggcggcagcaggaggcgtcgccctggtccccaaggaagattcccgcttctcagcgcccagggtcgccctggtggagcaggacgcgccgatggcgcccgggcgctccccgctggccaccacggtgatggatttcatccacgtgcctatcctgcctctcaatcacgccttattggcagcccgcactcggcagctgctggaagacgaaagttacgacggcggggccggggctgccagcgcctttgccccgccgcggagttcaccctgtgcctcgtccaccccggtcgctgtaggcgacttccccgactgcgcgtacccgcccgacgccgagcccaaggacgacgcgtaccctctctatagcgacttccagccgcccgctctaaagataaaggaggaggaggaaggcgcggaggcctccgcgcgctccccgcgttcctaccttgtggccggtgccaaccccgcagccttcccggatttcccgttggggccaccgcccccgctgccgccgcgagcgaccccatccagacccggggaagcggcggtgacggccgcacccgccagtgcctcagtctcgtctgcgtcctcctcggggtcgaccctggagtgcatcctgtacaaagcggagggcgcgccgccccagcagggcccgttcgcgccgccgccctgcaaggcgccgggcgcgagcggctgcctgctcccgcgggacggcctgccctccacctccgcctctgccgccgccgccggggcggcccccgcgctctaccctgcactcggcctcaacgggctcccgcagctcggctaccaggccgccgtgctcaaggagggcctgccgcaggtctacccgccctatctcaactacctgaggccggattcagaagccagccagagcccacaatacagcttcgagtcattacctcagaagatttgtttaatctgtggggatgaagcatcaggctgtcattatggtgtccttacctgtgggagctgtaaggtcttctttaagagggcaatggaagggcagcacaactacttatgtgctggaagaaatgactgcatcgttgataaaatccgcagaaaaaactgcccagcatgtcgccttagaaagtgctgtcaggctggcatggtccttggaggttttcgaaacttacatattgatgaccagataactctcattcagtattcttggatgagcttaatggtgtttggtctaggatggagatcctacaaacacgtcagtgggcagatgctgtattttgcacctgatctaatactaaatgaacagcggatgaaagaatcatcattctattcattatgccttaccatgtggcagatcccacaggagtttgtcaagcttcaagttagccaagaagagttcctctgtatgaaagtattgttacttcttaatacaattcctttggaagggctacgaagtcaaacccagtttgaggagatgaggtcaagctacattagagagctcatcaaggcaattggtttgaggcaaaaaggagttgtgtcgagctcacagcgtttctatcaacttacaaaacttcttgataacttgcatgatcttgtcaaacaacttcatctgtactgcttgaatacatttatccagtcccgggcactgagtgttgaatttccagaaatgatgtctgaagttattgctgcacaattacccaagatattggcagggatggtgaaaccccttctctttcataaaaagtga

SEQ ID NO: 3270 - DNA, 13748 bp, Homo sapiens
ggatccattttataagctcaaagataattacttttcagactaagaatatttagggtaaaaagtactgttcaacatctctactgaggatgttatgatgtagcacactgtataagctggagctaaaggaaactttccttaaagtgctatttactaaaaattggaacacattccttaagacaaatcgaagtgtggcacacaacatccaaacttccatcatagatacagaggtgttaccatctcccactcccaaatttctttgtcacgctgaggatactcaagaggagcaggacatgttggtcgcagcaggagaaacttgaaagcattcacttttatggaactcataagggagagaatctcttatttagtatcgtccttgatacatttattattttaaaagataatgtagccaaatgtcttcctctgtgttaaatctttacaaaactgaaatcttaaaatggtgacaaaaattctacttctgatagaatctattcatttttccaattagatagggcataattcttaatttgcaaaacaaaacgtaatatgcttatgaggttccatcccaaagaacctgctattgagagtagcattcagaataacgggtggaaatgccaactccagagtttcagatcctaccggtaattggggtagggaggggctttgggcggggcctccctagaggaggaggcgttgttagaaagctgtctggccagtccacagctgtcactaatcggggtaagccttgttgtatttgtgcgtgtgggtggcattctcaatgagaactagcttcacttgtcatttgagtgaaatctacaacccgaggcggctagtgctcccgcactactgggatctgagatcttcggagatgactgtcgcccgcagtacggagccagcagaagtccgacccttcctgggaatgggctgtaccgagaggtccgactagccccagggttttagtgagggggcagtggaactcagcgagggactgagagcttcacagcatgcacgagtttgatgccagagaaaaagtcgggagataaaggagccgcgtgtcactaaattgccgtcgcagccgcagccactcaagtgccggacttgtgagtactctgcgtctccagtcctcggacagaagttggagaactctcttggagaactccccgagttaggagacgagatctcctaacaattactactttttcttgcgctccccacttgccgctcgctgggacaaacgacagccacagttcccctgacgacaggatggaggccaagggcaggagctgaccagcgccgccctcccccgcccccgacccaggaggtggagatccctccggtccagccacattcaacacccactttctcctccctctgcccctatattcccgaaaccccctcctccttcccttttccctcctcctggagacgggggaggagaaaaggggagtccagtcgtcatgactgagctgaaggcaaagggtccccgggctccccacgtggcgggcggcccgccctcccccgaggtcggatccccactgctgtgtcgcccagccgcaggtccgttcccggggagccagacctcggacaccttgcctgaagtttcggccatacctatctccctggacgggctactcttccctcggccctgccagggacaggacccctccgacgaaaagacgcaggaccagcagtcgctgtcggacgtggagggcgcatattccagagctgaagctacaaggggtgctggaggcagcagttctagtcccccagaaaaggacagcggactgctggacagtgtcttggacactctgttggcgccctcaggtcccgggcagagccaacccagccctcccgcctgcgaggtcaccagctcttggtgcctgtttggccccgaacttcccgaagatccaccggctgcccccgccacccagcgggtgttgtccccgctcatgagccggtccgggtgcaaggttggagacagctccgggacggcagctgcccataaagtgctgccccggggcctgtcaccagcccggcagctgctgctcccggcctctgagagccctcactggtccggggccccagtgaagccgtctccgcaggccgctgcggtggaggttgaggaggaggatggctctgagtccgaggagtctgcgggtccgcttctgaagggcaaacctcgggctctgggtggcgcggcggctggaggaggagccgcggctgtcccgccgggggcggcagcaggaggcgtcgccctggtccccaaggaagattcccgcttctcagcgcccagggtcgccctggtggagcaggacgcgccgatggcgcccgggcgctccccgctggccaccacggtgatggatttcatccacgtgcctatcctgcctctcaatcacgccttattggcagcccgcactcggcagctgctggaagacgaaagttacgacggcggggccggggctgccagcgcctttgccccgccgcggagttcaccctgtgcctcgtccaccccggtcgctgtaggcgacttccccgactgcgcgtacccgcccgacgccgagcccaaggacgacgcgtaccctctctatagcgacttccagccgcccgctctaaagataaaggaggaggaggaaggcgcggaggcctccgcgcgctccccgcgttcctaccttgtggccggtgccaaccccgcagccttcccggatttcccgttggggccaccgcccccgctgccgccgcgagcgaccccatccagacccggggaagcggcggtgacggccgcacccgccagtgcctcagtctcgtctgcgtcctcctcggggtcgaccctggagtgcatcctgtacaaagcggagggcgcgccgccccagcagggcccgttcgcgccgccgccctgcaaggcgccgggcgcgagcggctgcctgctcccgcgggacggcctgccctccacctccgcctctgccgccgccgccggggcggcccccgcgctctaccctgcactcggcctcaacgggctcccgcagctcggctaccaggccgccgtgctcaaggagggcctgccgcaggtctacccgccctatctcaactacctgaggccggattcagaagccagccagagcccacaatacagcttcgagtcattacctcagaagatttgtttaatctgtggggatgaagcatcaggctgtcattatggtgtccttacctgtgggagctgtaaggtcttctttaagagggcaatggaagggcagcacaactacttatgtgctggaagaaatgactgcatcgttgataaaatccgcagaaaaaactgcccagcatgtcgccttagaaagtgctgtcaggctggcatggtccttggaggtcgaaaatttaaaaagttcaataaagtcagagttgtgagagcactggatgctgttgctctcccacagccagtgggcgttccaaatgaaagccaagccctaagccagagattcactttttcaccaggtcaagacatacagttgattccaccactgatcaacctgttaatgagcattgaaccagatgtgatctatgcaggacatgacaacacaaaacctgacacctccagttctttgctgacaagtcttaatcaactaggcgagaggcaacttctttcagtagtcaagtggtctaaatcattgccaggttttcgaaacttacatattgatgaccagataactctcattcagtattcttggatgagcttaatggtgtttggtctaggatggagatcctacaaacacgtcagtgggcagatgctgtattttgcacctgatctaatactaaatgaacagcggatgaaagaatcatcattctattcattatgccttaccatgtggcagatcccacaggagtttgtcaagcttcaagttagccaagaagagttcctctgtatgaaagtattgttacttcttaatacaattcctttggaagggctacgaagtcaaacccagtttgaggagatgaggtcaagctacattagagagctcatcaaggcaattggtttgaggcaaaaaggagttgtgtcgagctcacagcgtttctatcaacttacaaaacttcttgataacttgcatgatcttgtcaaacaacttcatctgtactgcttgaatacatttatccagtcccgggcactgagtgttgaatttccagaaatgatgtctgaagttattgctgcacaattacccaagatattggcagggatggtgaaaccccttctctttcataaaaagtgaatgtcatctttttcttttaaagaattaaattttgtggtatgtctttttgttttggtcaggattatgaggtcttgagtttttataatgttcttctgaaagccttacatttataacatcatagtgtgtaaatttaaaagaaaaattgtgaggttctaattattttcttttataaagtataattagaatgtttaactgttttgtttacccatattttcttgaagaatttacaagattgaaaaagtactaaaattgttaaagtaaactatcttatccatattatttcataccatgtaggtgaggatttttaacttttgcatctaacaaatcatcgacttaagagaaaaaatcttacatgtaataacacaaagctattatatgttatttctaggtaactccctttgtgtcaattatatttccaaaaatgaacctttaaaatggtatgcaaaattttgtctatatatatttgtgtgaggaggaaattcataactttcctcagattttcaaaagtatttttaatgcaaaaaatgtagaaagagtttaaaaccactaaaatagattgatgttcttcaaactaggcaaaacaactcatatgttaagaccattttccagattggaaacacaaatctcttaggaagttaataagtagattcatatcattatgcaaatagtattgtgggttttgtaggtttttaaaataaccttttttggggagagaattgtcctctaatgaggtattgcgagtggacataagaaatcagaagattatggcctaactgtactccttaccaactgtggcatgctgaaagttagtcactcttactgattctcaattctctcacctttgaaagtagtaaaatatctttcctgccaattgctcctttgggtcagagcttattaacatcttttcaaatcaaaggaaagaagaaagggagaggaggaggagggaggtatcaattcacatacctttctcctctttatcctccactatcatgaattcatattatgtttcagccatgcaaatctttttaccatgaaatttcttccagaattttccccctttgacacaaattccatgcatgtttcaaccttcgagactcagccaaatgtcatttctgtaaaatcttccctgagtcttccaagcagtaatttgccttctcctagagtttacctgccattttgtgcacatttgagttacagtagcatgttattttacaattgtgactctcctgggagtctgggagccatataaagtggtcaatagtgtttgctgactgagagttgaatgacattttctctctgtcttggtattactgtagatttcgatcattctttggttacatttctgcatatttctgtacccatgactttatcactttcttctcccatgctttatctccatcaattatcttcattacttttaaattttccacctttgcttcctactttgtgagatctctccctttactgactataacatagaagaatagaagtgtattttatgtgtcttaaggacaatactttagattccttgttctaagtttttaaactgaatgaatggaatattatttctctccctaagcaaaattccacaaaacaattatttcttatgtttatgtagccttaaattgttttgtactgtaaacctcagcataaaaactttcttcatttctaatttcattcaacaaatattgattgaatacctggtattagcacaagaaaaatgtgctaataagccttatgagaatttggagctgaagaaagacatataactcaggaaagttacagtccagtagtaggtataaattacagtgcctgataaataggcattttaatatttgtacactcaacgtatactaggtaggtgcaaaacatttacatataattttactgatacccatgcagcacaaaggtactaactttaaatattaaataacacctttatgtgtcagtaattcatttgcattaaatcttattgaaaaggctttcaatatattttccccacaaatgtcatcccaagaaaaaagtatttttaacatctcccaaatataatagttacaggaaatctacctctgtgagagtgacacctctcagaatgaactgtgtgacacaagaaaatgaatgtaggtctatccaaaaaaaaccccaagaaacaaaaacaatattattagccctttatgcttaagtgatggactcagggaacagttgatgttgtgatcattttattatctgattcttgttactttgaattaaaccaatattttgatgatataaatcatttccaccagcatatatttaatttccataataactttaaaattttctaatttcactcaactatgagggaatagaatgtggtggccacaggtttggcttttgttaaaatgtttgatatcttcgatgttgatctctgtctgcaatgtagatgtctaaacactaggatttaatatttaaggctaagctttaaaaataaagtacctttttaaaaagaatatggcttcaccaaatggaaaatacctaatttctaaatctttttctctacaaagtcctatctactaatgtctccattactatttagtcatcataaccattatcttcattttacatgtcgtgttctttctggtagctctaaaatgacactaaatcataagaagacaggttacatatcaggaaatacttgaaggttactgaaatagattcttgagttaatgaaaatattttctgtaaaaaggtttgaaaagccatttgagtctaaagcattatacctccattatcagtagttatgtgacaattgtgtgtgtgtttaatgtttaaagatgtggcactttttaataaggcaatgctatgctattttttcccatttaacattaagataatttattgctatacagatgatatggaaatatgatgaacaatattttttttgccaaaactatgccttgtaagtagccatggaatgtcaacctgtaacttaaattatccacagatagtcatgtgtttgatgatgggcactgtggagataactgacataggactgtgccccccttctctgccacttactagctggatgagattaagcaagtcatttaactgctctgattaaacctgcctttcccaagtgctttgtaatgaatagaaatggaaaccaaaaaaaacgtatacaggccttcagaaatagtaattgctactattttgttttcattaagccatagttctggctataattttatcaaactcaccagctatattctacagtgaaagcaggattctagaaagtctcactgttttatttatgtcaccatgtgctatgatatatttggttgaattcatttgaaattagggctggaagtattcaagtaatttcttctgctgaaaaaatacagtgttttgagtttagggcctgttttatcaaagttctaaagagcctatcactcttccattgtagacattttaaaataatgacactgattttaacatttttaagtgtctttttagaacagagagcctgactagaacacagcccctccaaaaacccatgctcaaattatttttactatggcagcaattccacaaaagggaacaatgggtttagaaattacaatgaagtcatcaacccaaaaaacatccctatccctaagaaggttatgatataaaatgcccacaagaaatctatgtctgctttaatctgtcttttattgctttggaaggatggctattacatttttagtttttgctgtgaatacctgagcagtttctctcatccatacttatccttcacacatcagaagtcaggatagaatatgaatcattttaaaaacttttacaactccagagccatgtgcataagaagcattcaaaacttgccaaaacatacattttttttcaaatttaaagatactctatttttgtattcaatagctcaacaactgtggtccccactgataaagtgaagtggacaaggagacaagtaatggcataagtttgtttttcccaaagtatgcctgttcaatagccattggatgtgggaaatttctacatctcttaaaattttacagaaaatacatagccagatagtctagcaaaagttcaccaagtcctaaattgcttatccttacttcactaagtcatgaaatcattttaatgaaaagaacatcacctaggttttgtggtttctttttttcttattcatggctgagtgaaaacaacaatctctgtttctccctagcatctgtggactatttaatgtaccattattccacactctatggtccttactaaatacaaaattgaacaaaaagcagtaaaacaactgactcttcacccatattataaaatataatccaagccagattagtcaacatccataagatgaatccaagctgaactgggcctagattattgagttcaggttggatcacatccctatttattaataaacttaggaaagaaggccttacagaccatcagttagctggagctaatagaacctacacttctaaagttcggcctagaatcaatgtggccttaaaagctgaaaagaagcaggaaagaacagttttcttcaataatttgtccaccctgtcactggagaaaatttaagaatttgggggtgttggtagtaagttaaacacagcagctgttcatggcagaaattattcaatacataccttctctgaatatcctataaccaaagcaaagaaaaacaccaaggggtttgttctcctccttggagttgacctcattccaaggcagagctcaggtcacaggcacaggggctgcgcccaagcttgtccgcagccttatgcagctgtggagtctggaagactgttgcaggactgctggcctagtcccagaatgtcagcctcattttcgatttactggctcttgttgctgtatgtcatgctgaccttattgttaaacacaggtttgtttgctttttttccactcatggagacatgggagaggcattatttttaagctggttgaaagctttaaccgataaagcatttttagagaaatgtgaatcaggcagctaagaaagcatactctgtccattacggtaaagaaaatgcacagattattaactctgcagtgtggcattagtgtcctggtcaatattcggatagatatgaataaaatatttaaatggtattgtaaatagttttcaggacatatgctatagcttatttttattatcttttgaaattgctcttaatacatcaaatcctgatgtattcaatttatcagatataaattattctaaatgaagcccagttaaatgtttttgtcttgtcagttatatgttaagtttctgatctctttgtctatgacgtttactaatctgcatttttactgttatgaattattttagacagcagtggtttcaagctttttgccactaaaaataccttttattttctcctcccccagaaaagtctataccttgaagtatctatccaccaaactgtacttctattaagaaatagttattgtgttttcttaatgttttgttattcaaagacatatcaatgaaagctgctgagcagcatgaataacaattatatccacacagatttgatatattttgtgcagccttaacttgatagtataaaatgtcattgctttttaaataatagttagtcaatggacttctatcatagctttcctaaactaggttaagatccagagctttggggtcataatatattacatacaattaagttatctttttctaagggctttaaaattcatgagaataaccaaaaaaggtatgtggagagttaatacaaacataccatattcttgttgaaacagagatgtggctctgcttgttctccataaggtagaaatactttccagaatttgcctaaactagtaagccctgaatttgctatgattagggataggaagagattttcacatggcagactttagaattcttcactttagccagtaaagtatctccttttgatcttagtattctgtgtattttaacttttctgagttgtgcatgtttataagaaaaatcagcacaaagggtttaagttaaagcctttttactgaaatttgaaagaaacagaagaaaatatcaaagttctttgtattttgagaggattaaatatgatttacaaaagttacatggagggctctctaaaacattaaattaattattttttgttgaaaagtcttactttaggcatcattttattcctcagcaactagctgtgaagcctttactgtgctgtatgccagtcactctgctagattgtggagattaccagtgttcccgtcttctccgagcttagagttggatggggaataaagacaggtaaacagatagctacaatattgtactgtgaatgcttatgctggaggaagtacagggaactattggagcacctaagaggagcacctaccttgaatttaggggttagcagaggcatcctgaaaaaagtcaaagctaagccacaatctataagcagtttaggaattagcagaacgtgcgtggtgaggagatgccaaaggcaagaagagaagagtattccaaacaggagggattccaaagagagaagagtatcccaaacaacatttgcacaaacctgatggggagagagaatgtggggtggggatggatgatgagactgaagaagaaagccaggtctagataatcagtggccttgtacaccatgttaaagagtgtagacttgattctgttgtaaacaggaaagcagcacaattcatatgaatattttagaagactcccactggaatatggagaataaagttggagatgactaatcctggaagcagggagaacatttttgaggaagttgcactattttggtgaaaatgatgatcataaacatgaagaattgtaggtgatcatgacctcctctctaattttccagaagggttttggaagatataacataggaacattgacaggactgacgaaaggagatgaaatacaccatataaattgtcaaacacaaggccagatgtctaattattttgcttatgtgttgaaattacaaatttttcatcaggaaaccaaaaactacaaaacttagttttcccaagtcccagaattctatctgtccaaacaatctgtaccactccacctatatccctacctttgcatgtctgtccaacctcaaagtccaggtctatacacacgggtaagactagagcagttcaagtttcagaaaatgagaaagaggaactgagttgtgctgaacccatacaaaataaacacattctttgtatagattcttggaacctcgagaggaattcacctaactcataggtatttgatggtatgaatccatggctgggctcggcttttaaaaagccttatctgggattccttctatggaaccaagttccatcaaagcccatttaaaagcctacattaaaaacaaaattcttgctgcattgtatacaaataatgatgtcatgatcaaataatcagatgccattatcaagtggaattacaaaatggtatacccactccaaaaaaaaaaaaaaagctaaattctcagtagaacattgtgacttcatgagccctccacagccttggagctgaggagggagcactggtgagcagtaggttgaagagaaaacttggcgcttaataatctatccatgttttttcatctaaaagagccttctttttggattaccttattcaatttccatcaaggaaattgttagttccactaaccagacagcagctgggaaggcagaagcttactgtatgtacatggtagctgtgggaaggaggtttctttctccaggtcctcactggccatacaccagtcccttgttagttatgcctggtcatagacccccgttgctatcatctcatatttaagtctttggcttgtgaatttatctattctttcagcttcagcactgcagagtgctgggactttgctaacttccatttcttgctggcttagcacattcctcataggcccagctcttttctcatctggccctgctgtggagtcaccttgccccttcaggagagccatggcttaccactgcctgctaagcctccactcagctgccaccacactaaatccaagcttctctaagatgttgcagactttacaggcaagcataaaaggcttgatcttcctggacttccctttacttgtctgaatctcacctccttcaactttcagtctcagaatgtaggcatttgtcctctttgccctacatcttccttcttctgaatcatgaaagcctctcacttcctcttgctatgtgctggaggcttctgtcaggttttagaatgagttctcatctagtcctagtagcttttgatgcttaagtccaccttttaaggatacctttgagatttagaccatgtttttcgcttgagaaagccctaatctccagacttgcctttctgtggatttcaaagaccaactgaggaagtcaaaagctgaatgttgactttctttgaacatttccgctataacaattccaattctcctcagagcaatatgcctgcctccaactgaccaggagaaaggtccagtgccaaagagaaaaacacaaagattaattatttcagttgagcacatactttcaaagtggtttgggtattcatatgaggttttctgtcaagagggtgagactcttcatctatccatgtgtgcctgacagttctcctggcactggctggtaacagatgcaaaactgtaaaaattaagtgatcatgtattttaacgatatcatcacatacttattttctatgtaatgttttaaatttcccctaacatactttgactgttttgcacatggtagatattcacatttttttgtgttgaagttgatgcaatcttcaaagttatctaccccgttgcttattagtaaaactagtgttaatacttggcaagagatgcagggaatctttctcatgactcacgccctatttagttattaatgctactaccctattttgagtaagtagtaggtccctaagtacattgtccagagttatacttttaaagatatttagccccatatacttcttgaatctaaagtcatacaccttgctcctcatttctgagtgggaaagacatttgagagtatgttgacaattgttctgaaggtttttgccaagaaggtgaaactgtcctttcatctgtgtatgcctggggctgggtccctggcagtgatggggtgacaatgcaaagctgtaaaaactaggtgctagtgggcacctaatatcatcatcatatacttattttcaagctaatatgcaaaatcccatctctgtttttaaactaagtgtagatttcagagaaaatattttgtggttcacataagaaaacagtctactcagcttgacaagtgttttatgttaaattggctggtggtttgaaatgaatcatcttcacataatgttttctttaaaaatattgtgaatttaactctaattcttgttattctgtgtgataataaagaataaactaatttcta

SEQ ID NO: 3271 - DNA, 2365 bp, Homo sapiens
atgactgagctgaaggcaaagggtccccgggctccccacgtggcgggcggcccgccctcccccgaggtcggatccccactgctgtgtcgcccagccgcaggtccgttcccggggagccagacctcggacaccttgcctgaagtttcggccatacctatctccctggacgggctactcttccctcggccctgccagggacaggacccctccgacgaaaagacgcaggaccagcagtcgctgtcggacgtggagggcgcatattccagagctgaagctacaaggggtgctggaggcagcagttctagtcccccagaaaaggacagcggactgctggacagtgtcttggacactctgttggcgccctcaggtcccgggcagagccaacccagccctcccgcctgcgaggtcaccagctcttggtgcctgtttggccccgaacttcccgaagatccaccggctgcccccgccacccagcgggtgttgtccccgctcatgagccggtccgggtgcaaggttggagacagctccgggacggcagctgcccataaagtgctgccccggggcctgtcaccagcccggcagctgctgctcccggcctctgagagccctcactggtccggggccccagtgaagccgtctccgcaggccgctgcggtggaggttgaggaggaggatggctctgagtccgaggagtctgcgggtccgcttctgaagggcaaacctcgggctctgggtggcgcggcggctggaggaggagccgcggctgtcccgccgggggcggcagcaggaggcgtcgccctggtccccaaggaagattcccgcttctcagcgcccagggtcgccctggtggagcaggacgcgccgatggcgcccgggcgctccccgctggccaccacggtgatggatttcatccacgtgcctatcctgcctctcaatcacgccttattggcagcccgcactcggcagctgctggaagacgaaagttacgacggcggggccggggctgccagcgcctttgccccgccgcggagttcaccctgtgcctcgtccaccccggtcgctgtaggcgacttccccgactgcgcgtacccgcccgacgccgagcccaaggacgacgcgtaccctctctatagcgacttccagccgcccgctctaaagataaaggaggaggaggaaggcgcggaggcctccgcgcgctccccgcgttcctaccttgtggccggtgccaaccccgcagccttcccggatttcccgttggggccaccgcccccgctgccgccgcgagcgaccccatccagacccggggaagcggcggtgacggccgcacccgccagtgcctcagtctcgtctgcgtcctcctcggggtcgaccctggagtgcatcctgtacaaagcggagggcgcgccgccccagcagggcccgttcgcgccgccgccctgcaaggcgccgggcgcgagcggctgcctgctcccgcgggacggcctgccctccacctccgcctctgccgccgccgccggggcggcccccgcgctctaccctgcactcggcctcaacgggctcccgcagctcggctaccaggccgccgtgctcaaggagggcctgccgcaggtctacccgccctatctcaactacctgaggccggattcagaagccagccagagcccacaatacagcttcgagtcattacctcagaagatttgtttaatctgtggggatgaagcatcaggctgtcattatggtgtccttacctgtgggagctgtaaggtcttctttaagagggcaatggaagggcagcacaactacttatgtgctggaagaaatgactgcatcgttgataaaatccgcagaaaaaactgcccagcatgtcgccttagaaagtgctgtcaggctggcatggtccttggaggttttcgaaacttacatattgatgaccagataactctcattcagtattcttggatgagcttaatggtgtttggtctaggatggagatcctacaaacacgtcagtgggcagatgctgtattttgcacctgatctaatactaaatgattcctttggaagggctacgaagtcaaacccagtttgaggagatgaggtcaagctacattagagagctcatcaaggcaattggtttgaggcaaaaaggagttgtgtcgagctcacagcgtttctatcaacttacaaaacttcttgataacttgcatgatcttgtcaaacaacttcatctgtactgcttgaatacatttatccagtcccgggcactgagtgttgaatttccagaaatgatgtctgaagttattgctgcacaattacccaagatattggcagggatggtgaaaccccttctctttcataaaaagtga

SEQ ID NO: 3272 - DNA, 2633 bp, Homo sapiens
atgactgagctgaaggcaaagggtccccgggctccccacgtggcgggcggcccgccctcccccgaggtcggatccccactgctgtgtcgcccagccgcaggtccgttcccggggagccagacctcggacaccttgcctgaagtttcggccatacctatctccctggacgggctactcttccctcggccctgccagggacaggacccctccgacgaaaagacgcaggaccagcagtcgctgtcggacgtggagggcgcatattccagagctgaagctacaaggggtgctggaggcagcagttctagtcccccagaaaaggacagcggactgctggacagtgtcttggacactctgttggcgccctcaggtcccgggcagagccaacccagccctcccgcctgcgaggtcaccagctcttggtgcctgtttggccccgaacttcccgaagatccaccggctgcccccgccacccagcgggtgttgtccccgctcatgagccggtccgggtgcaaggttggagacagctccgggacggcagctgcccataaagtgctgccccggggcctgtcaccagcccggcagctgctgctcccggcctctgagagccctcactggtccggggccccagtgaagccgtctccgcaggccgctgcggtggaggttgaggaggaggatggctctgagtccgaggagtctgcgggtccgcttctgaagggcaaacctcgggctctgggtggcgcggcggctggaggaggagccgcggctgtcccgccgggggcggcagcaggaggcgtcgccctggtccccaaggaagattcccgcttctcagcgcccagggtcgccctggtggagcaggacgcgccgatggcgcccgggcgctccccgctggccaccacggtgatggatttcatccacgtgcctatcctgcctctcaatcacgccttattggcagcccgcactcggcagctgctggaagacgaaagttacgacggcggggccggggctgccagcgcctttgccccgccgcggagttcaccctgtgcctcgtccaccccggtcgctgtaggcgacttccccgactgcgcgtacccgcccgacgccgagcccaaggacgacgcgtaccctctctatagcgacttccagccgcccgctctaaagataaaggaggaggaggaaggcgcggaggcctccgcgcgctccccgcgttcctaccttgtggccggtgccaaccccgcagccttcccggatttcccgttggggccaccgcccccgctgccgccgcgagcgaccccatccagacccggggaagcggcggtgacggccgcacccgccagtgcctcagtctcgtctgcgtcctcctcggggtcgaccctggagtgcatcctgtacaaagcggagggcgcgccgccccagcagggcccgttcgcgccgccgccctgcaaggcgccgggcgcgagcggctgcctgctcccgcgggacggcctgccctccacctccgcctctgccgccgccgccggggcggcccccgcgctctaccctgcactcggcctcaacgggctcccgcagctcggctaccaggccgccgtgctcaaggagggcctgccgcaggtctacccgccctatctcaactacctgaggccggattcagaagccagccagagcccacaatacagcttcgagtcattacctcagaagatttgtttaatctgtggggatgaagcatcaggctgtcattatggtgtccttacctgtgggagctgtaaggtcttctttaagagggcaatggaaggtcgaaaatttaaaaagttcaataaagtcagagttgtgagagcactggatgctgttgctctcccacagccagtgggcgttccaaatgaaagccaagccctaagccagagattcactttttcaccaggtcaagacatacagttgattccaccactgatcaacctgttaatgagcattgaaccagatgtgatctatgcaggacatgacaacacaaaacctgacacctccagttctttgctgacaagtcttaatcaactaggcgagaggcaacttctttcagtagtcaagtggtctaaatcattgccaggttttcgaaacttacatattgatgaccagataactctcattcagtattcttggatgagcttaatggtgtttggtctaggatggagatcctacaaacacgtcagtgggcagatgctgtattttgcacctgatctaatactaaatgaatcccacaggagtttgtcaagcttcaagttagccaagaagagttcctctgtatgaaagtattgttacttcttaatacaattcctttggaagggctacgaagtcaaacccagtttgaggagatgaggtcaagctacattagagagctcatcaaggcaattggtttgaggcaaaaaggagttgtgtcgagctcacagcgtttctatcaacttacaaaacttcttgataacttgcatgatcttgtcaaacaacttcatctgtactgcttgaatacatttatccagtcccgggcactgagtgttgaatttccagaaatgatgtctgaagttattgctgcacaattacccaagatattggcagggatggtgaaaccccttctctttcataaaaagtga

SEQ ID NO: 3273 - DNA, 1901 bp, Homo sapiens
atttgagtgaaatctacaacccgaggcggctagtgctcccgcactactgggatctgagatcttcggagatgactgtcgcccgcagtacggagccagcagaagtccgacccttcctgggaatgggctgtaccgagaggtccgactagccccagggttttagtgagggggcagtggaactcagcgagggactgagagcttcacagcatgcacgagtttgatgccagagaaaaagtcgggagataaaggagccgcgtgtcactaaattgccgtcgcagccgcagccactcaagtgccggacttgccggattcagaagccagccagagcccacaatacagcttcgagtcattacctcagaagatttgtttaatctgtggggatgaagcatcaggctgtcattatggtgtccttacctgtgggagctgtaaggtcttctttaagagggcaatggaagggcagcacaactacttatgtgctggaagaaatgactgcatcgttgataaaatccgcagaaaaaactgcccagcatgtcgccttagaaagtgctgtcaggctggcatggtccttggaggtcgaaaatttaaaaagttcaataaagtcagagttgtgagagcactggatgctgttgctctcccacagccagtgggcgttccaaatgaaagccaagccctaagccagagattcactttttcaccaggtcaagacatacagttgattccaccactgatcaacctgttaatgagcattgaaccagatgtgatctatgcaggacatgacaacacaaaacctgacacctccagttctttgctgacaagtcttaatcaactaggcgagaggcaacttctttcagtagtcaagtggtctaaatcattgccaggttttcgaaacttacatattgatgaccagataactctcattcagtattcttggatgagcttaatggtgtttggtctaggatggagatcctacaaacacgtcagtgggcagatgctgtattttgcacctgatctaatactaaatgaacagcggatgaaagaatcatcattctattcattatgccttaccatgtggcagatcccacaggagtttgtcaagcttcaagttagccaagaagagttcctctgtatgaaagtattgttacttcttaatacaattcctttggaagggctacgaagtcaaacccagtttgaggagatgaggtcaagctacattagagagctcatcaaggcaattggtttgaggcaaaaaggagttgtgtcgagctcacagcgtttctatcaacttacaaaacttcttgataacttgcatgatcttgtcaaacaacttcatctgtactgcttgaatacatttatccagtcccgggcactgagtgttgaatttccagaaatgatgtctgaagttattgctgcacaattacccaagatattggcagggatggtgaaaccccttctctttcataaaaagtgaatgtcatctttttcttttaaagaattaaattttgtggtatgtctttttgttttggtcaggattatgaggtcttgagtttttataatgttcttctgaaagccttacatttataacatcatagtgtgtaaatttaaaagaaaaattgtgaggttctaattattttcttttataaagtataattagaatgtttaactgttttgtttacccatattttcttgaagaatttacaagattgaaaaagtactaaaattgttaaagtaaactatcttatccatattatttcataccatgtaggtgaggatttttaacttttgcatctaacaaatcatcgacttaagagaaaaaatcttacatgtaataacacaaagctattatatgttatttctaggtaactccctttgtgtcaattatatttccaaaaatgaacctttaaaat

SEQ ID NO: 3274 - DNA, 2750 bp, Homo sapiens
atgactgagctgaaggcaaagggtccccgggctccccacgtggcgggcggcccgccctcccccgaggtcggatccccactgctgtgtcgcccagccgcaggtccgttcccggggagccagacctcggacaccttgcctgaagtttcggccatacctatctccctggacgggctactcttccctcggccctgccagggacaggacccctccgacgaaaagacgcaggaccagcagtcgctgtcggacgtggagggcgcatattccagagctgaagctacaaggggtgctggaggcagcagttctagtcccccagaaaaggacagcggactgctggacagtgtcttggacactctgttggcgccctcaggtcccgggcagagccaacccagccctcccgcctgcgaggtcaccagctcttggtgcctgtttggccccgaacttcccgaagatccaccggctgcccccgccacccagcgggtgttgtccccgctcatgagccggtccgggtgcaaggttggagacagctccgggacggcagctgcccataaagtgctgccccggggcctgtcaccagcccggcagctgctgctcccggcctctgagagccctcactggtccggggccccagtgaagccgtctccgcaggccgctgcggtggaggttgaggaggaggatggctctgagtccgaggagtctgcgggtccgcttctgaagggcaaacctcgggctctgggtggcgcggcggctggaggaggagccgcggctgtcccgccgggggcggcagcaggaggcgtcgccctggtccccaaggaagattcccgcttctcagcgcccagggtcgccctggtggagcaggacgcgccgatggcgcccgggcgctccccgctggccaccacggtgatggatttcatccacgtgcctatcctgcctctcaatcacgccttattggcagcccgcactcggcagctgctggaagacgaaagttacgacggcggggccggggctgccagcgcctttgccccgccgcggagttcaccctgtgcctcgtccaccccggtcgctgtaggcgacttccccgactgcgcgtacccgcccgacgccgagcccaaggacgacgcgtaccctctctatagcgacttccagccgcccgctctaaagataaaggaggaggaggaaggcgcggaggcctccgcgcgctccccgcgttcctaccttgtggccggtgccaaccccgcagccttcccggatttcccgttggggccaccgcccccgctgccgccgcgagcgaccccatccagacccggggaagcggcggtgacggccgcacccgccagtgcctcagtctcgtctgcgtcctcctcggggtcgaccctggagtgcatcctgtacaaagcggagggcgcgccgccccagcagggcccgttcgcgccgccgccctgcaaggcgccgggcgcgagcggctgcctgctcccgcgggacggcctgccctccacctccgcctctgccgccgccgccggggcggcccccgcgctctaccctgcactcggcctcaacgggctcccgcagctcggctaccaggccgccgtgctcaaggagggcctgccgcaggtctacccgccctatctcaactacctgaggccggattcagaagccagccagagcccacaatacagcttcgagtcattacctcagaagatttgtttaatctgtggggatgaagcatcaggctgtcattatggtgtccttacctgtgggagctgtaaggtcttctttaagagggcaatggaagggcagcacaactacttatgtgctggaagaaatgactgcatcgttgataaaatccgcagaaaaaactgcccagcatgtcgccttagaaagtgctgtcaggctggcatggtccttggaggtcgaaaatttaaaaagttcaataaagtcagagttgtgagagcactggatgctgttgctctcccacagccagtgggcgttccaaatgaaagccaagccctaagccagagattcactttttcaccaggtcaagacatacagttgattccaccactgatcaacctgttaatgagcattgaaccagatgtgatctatgcaggacatgacaacacaaaacctgacacctccagttctttgctgacaagtcttaatcaactaggcgagaggcaacttctttcagtagtcaagtggtctaaatcattgccaggttttcgaaacttacatattgatgaccagataactctcattcagtattcttggatgagcttaatggtgtttggtctaggatggagatcctacaaacacgtcagtgggcagatgctgtattttgcacctgatctaatactaaatgaatcccacaggagtttgtcaagcttcaagttagccaagaagagttcctctgtatgaaagtattgttacttcttaatacaattcctttggaagggctacgaagtcaaacccagtttgaggagatgaggtcaagctacattagagagctcatcaaggcaattggtttgaggcaaaaaggagttgtgtcgagctcacagcgtttctatcaacttacaaaacttcttgataacttgcatgatcttgtcaaacaacttcatctgtactgcttgaatacatttatccagtcccgggcactgagtgttgaatttccagaaatgatgtctgaagttattgctgcacaattacccaagatattggcagggatggtgaaaccccttctctttcataaaaagtga

SEQ ID NO: 3275 - DNA, 2816 bp, Homo sapiens
agtccacagctgtcactaatcggggtaagccttgttgtatttgtgcgtgtgggtggcattctcaatgagaactagcttcacttgtcatttgagtgaaatctacaacccgaggcggctagtgctcccgcactactgggatctgagatcttcggagatgactgtcgcccgcagtacggagccagcagaagtccgacccttcctgggaatgggctgtaccgagaggtccgactagccccagggttttagtgagggggcagtggaactcagcgagggactgagagcttcacagcatgcacgagtttgatgccagagaaaaagtcgggagataaaggagccgcgtgtcactaaattgccgtcgcagccgcagccactcaagtgccggacttgtgagtactctgcgtctccagtcctcggacagaagttggagaactctcttggagaactccccgagttaggagacgagatctcctaacaattactactttttcttgcgctccccacttgccgctcgctgggacaaacgacagccacagttcccctgacgacaggatggaggccaagggcaggagctgaccagcgccgccctcccccgcccccgacccaggaggtggagatccctccggtccagccacattcaacacccactttctcctccctctgcccctatattcccgaaaccccctcctccttcccttttccctcctcctggagacgggggaggagaaaaggggagtccagtcgtcatgactgagctgaaggcaaagggtccccgggctccccacgtggcgggcggcccgccctcccccgaggtcggatccccactgctgtgtcgcccagccgcaggtccgttcccggggagccagacctcggacaccttgcctgaagtttcggccatacctatctccctggacgggctactcttccctcggccctgccagggacaggacccctccgacgaaaagacgcaggaccagcagtcgctgtcggacgtggagggcgcatattccagagctgaagctacaaggggtgctggaggcagcagttctagtcccccagaaaaggacagcggactgctggacagtgtcttggacactctgttggcgccctcaggtcccgggcagagccaacccagccctcccgcctgcgaggtcaccagctcttggtgcctgtttggccccgaacttcccgaagatccaccggctgcccccgccacccagcgggtgttgtccccgctcatgagccggtccgggtgcaaggttggagacagctccgggacggcagctgcccataaagtgctgccccggggcctgtcaccagcccggcagctgctgctcccggcctctgagagccctcactggtccggggccccagtgaagccgtctccgcaggccgctgcggtggaggttgaggaggaggatggctctgagtccgaggagtctgcgggtccgcttctgaagggcaaacctcgggctctgggtggcgcggcggctggaggaggagccgcggctgtcccgccgggggcggcagcaggaggcgtcgccctggtccccaaggaagattcccgcttctcagcgcccagggtcgccctggtggagcaggacgcgccgatggcgcccgggcgctccccgctggccaccacggtgatggatttcatccacgtgcctatcctgcctctcaatcacgccttattggcagcccgcactcggcagctgctggaagacgaaagttacgacggcggggccggggctgccagcgcctttgccccgccgcggagttcaccctgtgcctcgtccaccccggtcgctgtaggcgacttccccgactgcgcgtacccgcccgacgccgagcccaaggacgacgcgtaccctctctatagcgacttccagccgcccgctctaaagataaaggaggaggaggaaggcgcggaggcctccgcgcgctccccgcgttcctaccttgtggccggtgccaaccccgcagccttcccggatttcccgttggggccaccgcccccgctgccgccgcgagcgaccccatccagacccggggaagcggcggtgacggccgcacccgccagtgcctcagtctcgtctgcgtcctcctcggggtcgaccctggagtgcatcctgtacaaagcggagggcgcgccgccccagcagggcccgttcgcgccgccgccctgcaaggcgccgggcgcgagcggctgcctgctcccgcgggacggcctgccctccacctccgcctctgccgccgccgccggggcggcccccgcgctctaccctgcactcggcctcaacgggctcccgcagctcggctaccaggccgccgtgctcaaggagggcctgccgcaggtctacccgccctatctcaactacctgaggccggattcagaagccagccagagcccacaatacagcttcgagtcattacctcagaagatttgtttaatctgtggggatgaagcatcaggctgtcattatggtgtccttacctgtgggagctgtaaggtcttctttaagagggcaatggaagggcagcacaactacttatgtgctggaagaaatgactgcatcgttgataaaatccgcagaaaaaactgcccagcatgtcgccttagaaagtgctgtcaggctggcatggtccttggaggttttcgaaacttacatattgatgaccagataactctcattcagtattcttggatgagcttaatggtgtttggtctaggatggagatcctacaaacacgtcagtgggcagatgctgtattttgcacctgatctaatactaaatgaggaaagtattgttacttcttaa

SEQ ID NO: 3276 - DNA, 3602 bp, Homo sapiens
agctccggctccgccgccacgattggccagccgaccacccggcctcggccaataagcgccgccctctcgcccccgtgttactgggtagaagaaaacaaaaacaaacagagcgagaagggccagagactctccgaggcggcggcagagacagaagagcggggtcggggccggctgaccaggaacctgggcgagcagcggcgggggcccgagggattctgaaggaagatttccattaggtaatttgtttaatcagtgcaagcgaaattaagggaaaatggatgtagaaaatgagcagatactgaatgtaaaccctgcagatcctgataacttaagtgactctctcttttccggtgatgaagaaaatgctgggactgaggaaataaagaatgaaataaatggaaattggatttcagcatcctccattaacgaagctagaattaatgccaaggcaaaaaggcgactaaggaaaaactcatcccgggactctggcagaggcgattcggtcagcgacagtgggagtgacgcccttagaagtggattaactgtgccaaccagtccaaagggaaggttgctggataggcgatccagatctgggaaaggaaggggactaccaaagaaaggtggtgcaggaggcaaaggtgtctggggtacacctggacaggtgtatgatgtggaggaggtggatgtgaaagatcctaactatgatgatgaccaggagaactgtgtttatgaaactgtagttttgcctttggatgaaagggcatttgagaagactttaacaccaatcatacaggaatattttgagcatggagatactaatgaagttgcggaaatgttaagagatttaaatcttggtgaaatgaaaagtggagtaccagtgttggcagtatccttagcattggaggggaaggctagtcatagagagatgacatctaagcttctttctgacctttgtgggacagtaatgagcacaactgatgtggaaaaatcatttgataaattgttgaaagatctacctgaattagcactggatactcctagagcaccacagttggtgggccagtttattgctagagctgttggagatggaattttatgtaatacctatattgatagttacaaaggaactgtagattgtgtgcaggctagagctgctctggataaggctaccgtgcttctgagtatgtctaaaggtggaaagcgtaaagatagtgtgtggggctctggaggtgggcagcaatctgtcaatcaccttgttaaagagattgatatgctgctgaaagaatatttactctctggagacatatctgaagctgaacattgccttaaggaactggaagtacctcattttcaccatgagcttgtatatgaagctattataatggttttagagtcaactggagaaagtacatttaagatgattttggatttattaaagtccctttggaagtcttctaccattactgtagaccaaatgaaaagaggttatgagagaatttacaatgaaattccggacattaatctggatgtcccacattcatactctgtgctggagcggtttgtagaagaatgttttcaggctggaataatttccaaacaactcagagatctttgtccttcaaggggcagaaagcgttttgtaagcgaaggagatggaggtcgtcttaaaccagagagctactgaatataagaactcttgcagtcttagatgttataaaaatatatatctgaattgtaagagttgttagcacaagttttttttttttttttttttaagcacttgttttgggtacaaggcatttctgacattttataaacctacatttaaggggaatttttaaaggaaatgttttttcttttttttttgtttttcgagggggcaaggagggacagaaaagtaacctcttcttaagtggaatattctaataagctaccttttgtaagtgccatgtttattatctaatcattccaagttttgcattgatgtctgactgccactcctttctttcaaggacagtgttttttgtagtaaaatcactggtttatacaaagctttatttagggggtaaagttaagctgctaaaaccccatgttggctgctgctgttgagatactgtgctttgggagtaaaaaaagaaagttatttctttgtcttaaagaatttttaaaaaattagtcatgagacttattcatctttccagggaacatactgattggtcttaaaagactagacagttaagtaaaaggtggctggaacatctatttttctacaaaactggaaaaatgaacctggttctagaagaatgtacaccaaaataaaacatgtgaagcagtattgattctttattgggagtacatttttttaggtctcttaaactttaatttcacacagtaaattttgaatctcataaggaagcatatttgaacctagtcaatttaatcttagtgttcccttgaaaactttttttccctacaaaattttaagtgaaaaatacaatagtaaattaagattacactggggaaaaaaatgcaggtatcactttactccattgttatctgacctagagcttaattaagttttagaaatatgtaataccttccatcattccatcatccttaaattctgttaccaaataatggctaatgttacaaaaagttatactccagagacccaaagcttgacatttacctaatgtatgagaaaatattaccaattaacaataaagaatgatcatatttttaacctcttttacatagcctaataactcagcaaggcctcaacgtctgtgctaatttaaactgccaaatattgactgcagcaaacaagaattatattcagaatttatgagggtactgttaggagtatactgcttacaggtttagatatagtctgttagaattaaaaccaagtttagtgttcatatttacctcatgggctttatcaagcccatattacctcagcttatatatagttaccatttttaggtttttaattgtttgacacttggatgataaatgcagtcattttattctcaagtgcttaaaattaatgtaattaaaagcttagctgactacagaataggtgagggtttcttaaaaatgagatttaagggctgggcacggtggctcatgcctgtaatcccagcactttgggaggccgaggtgggcggatcacttgaggttgggagttcatgaccagcttgaccaacatgaagaaaccctgtctctattaaaaatacaaaagtagccaggcatggtggcgcatgcgtgtaatcccagctacttgggaggctgaggcaggagaattgcttgaacctgggaggcagaggttgcagtgagtcgagatggtgccattgctctcgtttgggcaacaagagtgaaactcttgtctcaaaaaaaaaaaaaaatgaggtttaagacagttttgtcattactggtgggatctggtcacacaagatagcattaaacgtgacatggcacataaaattggttaaaaaattttgttttttaattacgtaatgtaaaagcccaacaaacactttatgcaagattggaatgtatcttcaaattcagatttaataaacatgtaaagatcctctgta

SEQ ID NO: 3277 - DNA, 3654 bp, Homo sapiens
cgaccacccggcctcggccaataagcgccgccctctcgcccccgtgttactgggtagaagaaaacaaaaacaaacagagcgagaagggccagagactctccgaggcggcggcagagacagaagagcggggtcggggccggctgaccaggaacctgggcgagcagcggcgggggcccgagggattctgaaggaagatttccattaggtaatttgtttaatcagtgcaagcgaaattaagggaaaatggatgtagaaaatgagcagatactgaatgtaaaccctgcagggtattttccctaattctccatggtgcttcaatagcatgttattatcataaaaatgaacagttttgtggaatagatgaccaaatatcctgataacttaagtgactctctcttttccggtgatgaagaaaatgctgggactgaggaaataaagaatgaaataaatggaaattggatttcagcatcctccattaacgaagctagaattaatgccaaggcaaaaaggcgactaaggaaaaactcatcccgggactctggcagaggcgattcggtcagcgacagtgggagtgacgcccttagaagtggattaactgtgccaaccagtccaaagggaaggttgctggataggcgatccagatctgggaaaggaaggggactaccaaagaaaggtggtgcaggaggcaaaggtgtctggggtacacctggacaggtgtatgatgtggaggaggtggatgtgaaagatcctaactatgatgatgaccaggagaactgtgtttatgaaactgtagttttgcctttggatgaaagggcatttgagaagactttaacaccaatcatacaggaatattttgagcatggagatactaatgaagttgcggaaatgttaagagatttaaatcttggtgaaatgaaaagtggagtaccagtgttggcagtatccttagcattggaggggaaggctagtcatagagagatgacatctaagcttctttctgacctttgtgggacagtaatgagcacaactgatgtggaaaaatcatttgataaattgttgaaagatctacctgaattagcactggatactcctagagcaccacagttggtgggccagtttattgctagagctgttggagatggaattttatgtaatacctatattgatagttacaaaggaactgtagattgtgtgcaggctagagctgctctggataaggctaccgtgcttctgagtatgtctaaaggtggaaagcgtaaagatagtgtgtggggctctggaggtgggcagcaatctgtcaatcaccttgttaaagagattgatatgctgctgaaagaatatttactctctggagacatatctgaagctgaacattgccttaaggaactggaagtacctcattttcaccatgagcttgtatatgaagctattataatggttttagagtcaactggagaaagtacatttaagatgattttggatttattaaagtccctttggaagtcttctaccattactgtagaccaaatgaaaagaggttatgagagaatttacaatgaaattccggacattaatctggatgtcccacattcatactctgtgctggagcggtttgtagaagaatgttttcaggctggaataatttccaaacaactcagagatctttgtccttcaaggggcagaaagcgttttgtaagcgaaggagatggaggtcgtcttaaaccagagagctactgaatataagaactcttgcagtcttagatgttataaaaatatatatctgaattgtaagagttgttagcacaagttttttttttttttttttttaagcacttgttttgggtacaaggcatttctgacattttataaacctacatttaaggggaatttttaaaggaaatgttttttcttttttttttgtttttcgagggggcaaggagggacagaaaagtaacctcttcttaagtggaatattctaataagctaccttttgtaagtgccatgtttattatctaatcattccaagttttgcattgatgtctgactgccactcctttctttcaaggacagtgttttttgtagtaaaatcactggtttatacaaagctttatttagggggtaaagttaagctgctaaaaccccatgttggctgctgctgttgagatactgtgctttgggagtaaaaaaagaaagttatttctttgtcttaaagaatttttaaaaaattagtcatgagacttattcatctttccagggaacatactgattggtcttaaaagactagacagttaagtaaaaggtggctggaacatctatttttctacaaaactggaaaaatgaacctggttctagaagaatgtacaccaaaataaaacatgtgaagcagtattgattctttattgggagtacatttttttaggtctcttaaactttaatttcacacagtaaattttgaatctcataaggaagcatatttgaacctagtcaatttaatcttagtgttcccttgaaaactttttttccctacaaaattttaagtgaaaaatacaatagtaaattaagattacactggggaaaaaaatgcaggtatcactttactccattgttatctgacctagagcttaattaagttttagaaatatgtaataccttccatcattccatcatccttaaattctgttaccaaataatggctaatgttacaaaaagttatactccagagacccaaagcttgacatttacctaatgtatgagaaaatattaccaattaacaataaagaatgatcatatttttaacctcttttacatagcctaataactcagcaaggcctcaacgtctgtgctaatttaaactgccaaatattgactgcagcaaacaagaattatattcagaatttatgagggtactgttaggagtatactgcttacaggtttagatatagtctgttagaattaaaaccaagtttagtgttcatatttacctcatgggctttatcaagcccatattacctcagcttatatatagttaccatttttaggtttttaattgtttgacacttggatgataaatgcagtcattttattctcaagtgcttaaaattaatgtaattaaaagcttagctgactacagaataggtgagggtttcttaaaaatgagatttaagggctgggcacggtggctcatgcctgtaatcccagcactttgggaggccgaggtgggcggatcacttgaggttgggagttcatgaccagcttgaccaacatgaagaaaccctgtctctattaaaaatacaaaagtagccaggcatggtggcgcatgcgtgtaatcccagctacttgggaggctgaggcaggagaattgcttgaacctgggaggcagaggttgcagtgagtcgagatggtgccattgctctcgtttgggcaacaagagtgaaactcttgtctcaaaaaaaaaaaaaaatgaggtttaagacagttttgtcattactggtgggatctggtcacacaagatagcattaaacgtgacatggcacataaaattggttaaaaaattttgttttttaattacgtaatgtaaaagcccaacaaacactttatgcaagattggaatgtatcttcaaattcagatttaataaacatgtaaagatcctctgt

SEQ ID NO: 3278 - DNA, 819 bp, Homo sapiens
cagaagagcggggtcggggccggctgaccaggaacctgggcgagcagcggcgggggcccgagggattctgaaggaagatttccattaggtaatttgtttaatcagtgcaagcgaaattaagggaaaatggatgtagaaaatgagcagatactgaatgtaaaccctgcagaaaatgctgggactgaggaaataaagaatgaaataaatggaaattggatttcagcatcctccattaacgaagctagaattaatgccaaggcaaaaaggcgactaaggaaaaactcatcccgggactctggcagaggcgattcggtcagcgacagtgggagtgacgcccttagaagtggattaactgtgccaaccagtccaaagggaaggttgctggataggcgatccagatctgggaaaggaaggggactaccaaagaaaggtggtgcaggaggcaaaggtgtctggggtacacctggacaggtgtatgatgtggaggaggtggatgtgaaagatcctaactatgatgatgaccaggagaactgtgtttatgaaactgtagttttgcctttggatgaaagggcatttgagaagactttaacaccaatcatacaggaatattttgagcatggagatactaatgaagttgcggaaatgttaagagatttaaatcttggtgaaatgaaaagtggagtaccagtgttggcagtatccttagcattggaggggaaggctagtcatagagagatgacatctaagcttctttctgacctttgtgggacagtaatgagcacaactgatgtggaaaaatcatttgataaattgttgaaa

SEQ ID NO: 3279 - DNA, 1344 bp, Homo sapiens
gggctggacagcgtggtgacgtcgcaacgcggcgcagggtgagagcgcgcgcttgcggacgcggcggcattaaacggttgcaggcgtagcagagtggtcgttgtctttctaggtctcagccggtcgtcgcgacgttcgcccgctcgctctgaggctcctgaagccgaaaccagctagactttcctccttcccgcctgcctgtagcggcgttgttgccactccgccaccatgttcgaggcgcgcctggtccagggctccatcctcaagaaggtgttggaggcactcaaggacctcatcaacgaggcctgctgggatattagctccagcggtgtaaacctgcagagcatggactcgtcccacgtctctttggtgcagctcaccctgcggtctgagggcttcgacacctaccgctgcgaccgcaacctggccatgggcgtgaacctcaccagtatgtccaaaatactaaaatgcgccggcaatgaagatatcattacactaagggccgaagataacgcggataccttggcgctagtatttgaagcaccaaaccaggagaaagtttcagactatgaaatgaagttgatggatttagatgttgaacaacttggaattccagaacaggagtacagctgtgtagtaaagatgccttctggtgaatttgcacgtatatgccgagatctcagccatattggagatgctgttgtaatttcctgtgcaaaagacggagtgaaattttctgcaagtggagaacttggaaatggaaacattaaattgtcacagacaagtaatgtcgataaagaggaggaagctgttaccatagagatgaatgaaccagttcaactaacttttgcactgaggtacctgaacttctttacaaaagccactccactctcttcaacggtgacactcagtatgtctgcagatgtaccccttgttgtagagtataaaattgcggatatgggacacttaaaatactacttggctcccaagatcgaggatgaagaaggatcttaggcattcttaaaattcaagaaaataaaactaagctctttgagaactgcttctaagatgccagcatatactgaagtcttttctgtcaccaaatttgtacctctaagtacatatgtagatattgttttctgtaaataacctatttttttctctattctctgcaatttgtttaaagaataaagtccaaagtcagatctggtctagttaacctagaagtatttttgtctcttagaaatacttgtgatttttataatacaaaagggtcttgactctaaatgcagttttaagaattgtttttgaatttaaataaagttacttgaatttcaaacatca

SEQ ID NO: 3280 - DNA, 1359 bp, Homo sapiens
ccgcggatggccggagctggcgccctggttctggaggtaaccggttactgagggcgagaagcgccacccggaggctctagcctgacaaatgcttgctgacctgggccagagctcttcccttacgcaagtctcagccggtcgtcgcgacgttcgcccgctcgctctgaggctcctgaagccgaaaccagctagactttcctccttcccgcctgcctgtagcggcgttgttgccactccgccaccatgttcgaggcgcgcctggtccagggctccatcctcaagaaggtgttggaggcactcaaggacctcatcaacgaggcctgctgggatattagctccagcggtgtaaacctgcagagcatggactcgtcccacgtctctttggtgcagctcaccctgcggtctgagggcttcgacacctaccgctgcgaccgcaacctggccatgggcgtgaacctcaccagtatgtccaaaatactaaaatgcgccggcaatgaagatatcattacactaagggccgaagataacgcggataccttggcgctagtatttgaagcaccaaaccaggagaaagtttcagactatgaaatgaagttgatggatttagatgttgaacaacttggaattccagaacaggagtacagctgtgtagtaaagatgccttctggtgaatttgcacgtatatgccgagatctcagccatattggagatgctgttgtaatttcctgtgcaaaagacggagtgaaattttctgcaagtggagaacttggaaatggaaacattaaattgtcacagacaagtaatgtcgataaagaggaggaagctgttaccatagagatgaatgaaccagttcaactaacttttgcactgaggtacctgaacttctttacaaaagccactccactctcttcaacggtgacactcagtatgtctgcagatgtaccccttgttgtagagtataaaattgcggatatgggacacttaaaatactacttggctcccaagatcgaggatgaagaaggatcttaggcattcttaaaattcaagaaaataaaactaagctctttgagaactgcttctaagatgccagcatatactgaagtcttttctgtcaccaaatttgtacctctaagtacatatgtagatattgttttctgtaaataacctatttttttctctattctctgcaatttgtttaaagaataaagtccaaagtcagatctggtctagttaacctagaagtatttttgtctcttagaaatacttgtgatttttataatacaaaagggtcttgactctaaatgcagttttaagaattgtttttgaatttaaataaagttacttgaatttcaaacatca

SEQ ID NO: 3281 - DNA, 1767 bp, Homo sapiens
attcggctgcccccaaggccaggcatccagtgtgcttagtgctgagcagggtttcagagctcacccccaggagggtgcagacctcagccaaggtcgcagagcagaggagacccgtgggctgggattccacctgtgcccaccctggcagcatcccacctcctgagtcctctcggcacccagcaaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggaaaagcgcctcctccgccgctcccgctcgggggacgtgctggccaagaaccctgtggtgcgctccaagagctacaacacgcctctgctgaaccccgtgcaggagcacgaggcggagggcgcggcggccggcggtaccagcatccgcaggcactctgtgtcggagatgacgtcctgccccgagcctcagggcttctccgacccgcccggccagggccccaccgggaccttcaggtcctccccggcgccccactcagggccctgccccagcagactgtaccccacgacccagccccctgagcagggcttggatcccacccgcagctccctgccccgctccagcccggagaacctggtggaccagatcctggagtccgtggactcggattctgaagggattttcattgactttggccggggccggggctctggcatgtccgacttggagggctctgggggccggcagagtgtcgtgtgaggcctcacagctggccttgagtttttactgacacgtccctgtgtgcgggggtgtccatgtggcgtgtgtgtgagtgagacttttttactgcgtcccgtcccgccagccctatcggcctcgtcactggccttggtcactttgtatttctgtcttggttggaaataccatcagccttccttgctcggcccaggtctgtttcaggcatctgagtcggcgtttacccaggggccgggccagagacgggggtcggccgctcgctcccacgctcctcctgccccagccctctggtgtccacacctgcccacagagaatgtaaacccagtgggctctgcccacgccgggccccaaagtgaccagactccagcacacctgtctcctcctgcctggggtggccatggggatggaagggggtggaataaaacctgtcaacctg

SEQ ID NO: 3282 - DNA, 1878 bp, Homo sapiens
gcccccggcctccgtttgcgccgggtctgtgctggccgcgcgcctggcgctccacgctgagcctctccgtgcaatgattaacccggcggggcggccggcgcgggacccgagacggaggcgcggggccggggcgggaccccgcaggaccgctcggcttcctgctctcgccggagtttccgcgtagagggcgcatcgccggcccggggcccttggtgcggcgtggcgcagggcgcggcgtggggcgcgcgtgggcgcggcgcaggcggcccgggtcaccatgaggactctccgcaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggaaaagcgcctcctccgccgctcccgctcgggggacgtgctggccaagaaccctgtggtgcgctccaagagctacaacacgcctctgctgaaccccgtgcaggagcacgaggcggagggcgcggcggccggcggtaccagcatccgcaggcactctgtgtcggagatgacgtcctgccccgagcctcagggcttctccgacccgcccggccagggccccaccgggaccttcaggtcctccccggcgccccactcagggccctgccccagcagactgtaccccacgacccagccccctgagcagggcttggatcccacccgcagctccctgccccgctccagcccggagaacctggtggaccagatcctggagtccgtggactcggattctgaagggattttcattgactttggccggggccggggctctggcatgtccgacttggagggctctgggggccggcagagtgtcgtgtgaggcctcacagctggccttgagtttttactgacacgtccctgtgtgcgggggtgtccatgtggcgtgtgtgtgagtgagacttttttactgcgtcccgtcccgccagccctatcggcctcgtcactggccttggtcactttgtatttctgtcttggttggaaataccatcagccttccttgctcggcccaggtctgtttcaggcatctgagtcggcgtttacccaggggccgggccagagacgggggtcggccgctcgctcccacgctcctcctgccccagccctctggtgtccacacctgcccacagagaatgtaaacccagtgggctctgcccacgccgggccccaaagtgaccagactccagcacacctgtctcctcctgcctggggtggccatggggatggaagggggtggaataaaacctgtcaacctgg

SEQ ID NO: 3283 - DNA, 905 bp, Homo sapiens
ctccgcggccccctcccccggccccgggctccggctccggctccggctctggctctgcgcggtggcagcggcggcggcggcgcggggaccgaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggaaaagcgcctcctccgccgctcccgctcgggggacgtgctggccaagaaccctgtggtgcgctccaagagctacaacacgcctctgctgaaccccgtgcaggagcacgaggcggagggcgcggcggccggcggtacca

SEQ ID NO: 3284 - DNA, 881 bp, Homo sapiens
ccgggtctgtgctggccgcgcgcctggcgctccacgctgagcctctccgtgcaatgattaacccggcggggcggccggcgcgggacccgagacggaggcgcggggccggggcgggaccccgcaggaccgctcggcttcctgctctcgccggagtttccgcgtagagggcgcatcgccggcccggggcccttggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggaaaagcgcctcctcc

SEQ ID NO: 3285 - DNA, 2279 bp, Homo sapiens
agtgtgcttagtgctgagcagggtttcagagctcacccccaggagggtgcagacctcagccaaggtcgcagagcagaggagacccgtgggctgggattccacctgtgcccaccctggcagcatcccacctcctgagtcctctcggcacccagcaagagtcccttcagtgacttcgagcgtgcattgagagcccagtaacactggggggcaactgccacaaagacacagcctcagccaggcgcagtgactcatgcctgtaatcccagcaccttgggaggccaaggcttgtggatcacctgaggtcaggagtttgagaccagccggaccaacatggagaaaccccatctctactaaaaatacaaaaaaattagctaggcattgtggcgcatgcctgtaatcccggctactcgggaggctgagggaggagaagcacttgaacccaggaggcgcggttgcagtgagccgagatcgccccattgcactccagcctgggcaacaagagcgaaactccatctcaaaataataataataacaataatagtaagactcagcctccccgctctgggacactcagtctgatggggcaggctggtcagaagacatagagccatggtgtgtttggaactttcacagagggaagcctggggctcgggaagcccggaaaagatgccggcgcagcctgagggcttgtacaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggaaaagcgcctcctccgccgctcccgctcgggggacgtgctggccaagaaccctgtggtgcgctccaagagctacaacacgcctctgctgaaccccgtgcaggagcacgaggcggagggcgcggcggccggcggtaccagcatccgcaggcactctgtgtcggagatgacgtcctgccccgagcctcagggcttctccgacccgcccggccagggccccaccgggaccttcaggtcctccccggcgccccactcagggccctgccccagcagactgtaccccacgacccagccccctgagcagggcttggatcccacccgcagctccctgccccgctccagcccggagaacctggtggaccagatcctggagtccgtggactcggattctgaagggattttcattgactttggccggggccggggctctggcatgtccgacttggagggctctgggggccggcagagtgtcgtgtgaggcctcacagctggccttgagtttttactgacacgtccctgtgtgcgggggtgtccatgtggcgtgtgtgtgagtgagacttttttactgcgtcccgtcccgccagccctatcggcctcgtcactggccttggtcactttgtatttctgtcttggttggaaataccatcagccttccttgctcggcccaggtctgtttcaggcatctgagtcggcgtttacccaggggccgggccagagacgggggtcggccgctcgctcccacgctcctcctgccccagccctctggtgtccacacctgcccacagagaatgtaaacccagtgggctctgcccacgccgggccccaaagtgaccagactccagcacacctgtctcctcctgcctggggtggccatggggatggaagggggtggaataaaacctgtcaacctgg

SEQ ID NO: 3286 - DNA, 4508 bp, Homo sapiens
gctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcagaggaacgcgttgtggtgatcagcagctcggaagactcagatgccgaaaactcgtcctcccgagagctggatgacagcagcagtgagtccagtgacctccagctggaaggccccagcaccctcagggtcctggacgagaaccttgctgacccccaagcagaagacagacctctggttttctttgacctcaagattgacaatgaaacccagaagattagccagctggctgcggtgaaccgggaaagcaagttccgcgtggtcatccagcctgaagccttcttcagcatctactccaaggccgtgtccctggaggtggggctgcagcacttcctcagctttctgagctccatgcgccgccctatcttggcctgctacaagctgtgggggcctggcctcccaaacttcttccgggccctggaggacattaacaggctgtgggaattccaggaggccatctcgggcttcctggctgccctgcctctcatccgggagcgtgtgcccggggccagcagcttcaaactcaagaacctggcccagacctacctggcgagaaacatgagcgagcgcagcgccatggctgccgtgctggccatgcgtgacctgtgccgcctcctcgaggtctccccgggcccccagctggcccagcatgtctaccccttcagtagcctgcagtgctttgcctccctgcagcccctggtgcaggcagctgtgctgccccgggctgaggcccgcctcctggccctacacaacgtgagcttcatggagctgctgagtgcacaccgccgtgaccggcaggggggcctgaagaagtacagccgctatctaagcctgcagaccaccacgttgccccctgcccagcctgctttcaacctgcaggctctgggcacctactttgaaggcctgttggagggtccggcgctggcacgggcagaaggagtctccaccccacttgctggccgtggcttggcagagagggcctcccagcagagctgagaggagggggtgaccagcttggagtctctggtgggcagagagggatggggtccctgagccaggccccacccatcacagcattcccaggtcctggtacccagccctcagttgtcatttggttcagaatcagttccctttctctgggaccaaatttcccttctctaaacatcctacagagaaggttccaaagctgagcacccatcaccctaggtgtgcaccagactcctattagcccctccttccaggagctagaaccagggaggtcctgagtgaggaaggcatgacctctgggctctctaggtggccctggtcttgccccatccatcccacctgccactaccttgggtgtccttacagctctgccctgaccccagcccctgcccctggacacctgctgacagctcccacacagaacagtctgaggtgatgctggctacagccctggcagcccatggcaactcaaagtgccttccaaaccaaactgcccctcatgaggttagggtcccccaccctccacctgcccagaggccaactctgttcccttctcctttcatcccagaggggcctcatcagcaaagacagaaactgatgttccatgcatgtccctgcttccaaagcctgaccttccaaagcttgcttccttcctcctggctgcacagacacctctgcttggccacagctttgctctttggtcctcaggccaccagacccctcacagcatggcccttggctcttcctgcactgccctcaccctcagccgtcccaaggagtgcccagcactactcagcatgtagtccaggacctgcggcatcagcatcccctgggagcttcttagaaatgcagacctgtgggctctaccacaggcctctggaatcagaatcttcagggtggggcccagcagtctgtgttttaacaggttctcccggtgatgctggtgcatgctcaagtttgagaaccgctgctctcatagactgctcctccaaggggaagcagtgtggaacagcagagaaagtcccgtccctatctctgactgtgcagtgagtgtggcctaggaacaggtcccttcctaagctctagtgtccccatctgtaaaatgggctgattggcctccacggtcagagcggccatctggctgtgccatcctgcatttttaggaatggaaagcaggcctctgaggcagtggacaggaagacttctcatccttgaattctagctcccattccaaactgttagtccccaaccttgtggtcacatcagaggtcaacagcagaacagaggcaggtcagggttgtccgctctgattagcagaacgacagccccttcctcctcctccctccttcccatccctactcattagctccctgctcctgggatgcttcccaagcagcccaggcctctagcctccatggctgatgacctcagctttcacactggtgaagtctgtgtacccatactgcagccccatcccatggggcccctgaagacccactgaggaattccgtagggtcttgttcccacgaccggagtgctggctctcacagtgaattttgatgcatttaaaataagattctgatgccagactgttaaaacaggcgctggttctgaagcaccgatggaaacagattgatgcagatggaaggaggaagggagactgggcccactgatttccagccccaccatgtgtgctgttttcagatgtgattgaggggtgttctgccctgcctccactgtcacagcctttaataaagatgtgaatcttgaaa

SEQ ID NO: 3287 - DNA, 3029 bp, Homo sapiens
gctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcagaggaacgcgttgtggtgatcagcagctcggaagactcagatgccgaaaactcgtgcatggagcccatggagaccgccgagccacagtcctcgccagcccactcctcgccagcccactcctcgccagcccactcctcgccagtccagtctctgctgagagcacaaggagcctccagcctgccctgtggcacataccaccccccagcttggcctccccaccagcccgctgagcaggctgccacccccgatgctgagcctcacagcgagcctcctgatcaccaggagcgccctgccgtccaccgtgggatccgctacctgttgtacagagcacagagagccatccgccttcgccatgccctccgcttgcaccctcaattgcatcgggcccctattcggacttggtctccccatgtggtccaagccagcactcctgccatcacagggcccctcaaccatcctgccaatgcccaggaacatcctgcccagctgcaaaggggcatcagcccaccccaccggatacgaggggctgtgcgatcccgcagccgctccctccggggctcctcccatttatcccagtggctcaacaacttttttgccctccccttctcctccatggcttcccagcttgacatgtcttccgtggtgggggcaggggaaagcagagcccagactcttggagcaggtgttccccctggggactctgtcagaggctccatggaggcctctcaagtccaagtgcctctggaagcctctccaattacattcccaccaccctgtgccccagaaaggccccccatcagcccagtcccaggcgcccgtcaagcaggcctctgagagtgctacccttctcttgtaaccttgcagccaacacccctgcccggcccctgagctgcctcctccagcccatgctcttacaggccctgcacagagtagcactcattaattcttggttaaggaatgaatcaacgaatgaatggctatgcatggacctctgggcagggagacctgggtcttctctggctgagaggggaaggctaaggcatggctgagattcaagccaccattccaggcctctttgcccaagaaagaaacttctgtcacccttgcactctcctgtattctgagtccctggccaatagcacagccttccatgccccgacccccaccccaagcctctccactaggcctctgccaggatctaagcccatgagcacagggactggctatcccaagacctggcagatgtggctgctcaataaacacttgttgaaccatca

SEQ ID NO: 3288 - DNA, 2885 bp, Homo sapiens
gctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcagaggaacgcgttgtggtgatcagcagctcggaagactcagatgccgaaaactcgtgcatggagcccatggagaccgccgagccacagtcctcgccagcccactcctcgccagcccactcctcgccagcccactcctcgccagtccagtctctgctgagagcacaaggagcctccagcctgccctgtggcacataccaccccccagcttggcctccccaccagcccgctgagcaggctgccacccccgatgctgagcctcacagcgagcctcctgatcaccaggagcgccctgccgtccaccgtgggatccgctacctgttgtacagagcacagagagccatccgccttcgccatgccctccgcttgcaccctcaattgcatcgggcccctattcggacttggtctccccatgtggtccaagccagcactcctgccatcacagggcccctcaaccatcctgccaatgcccaggaacatcctgcccagctgcaaaggggcatcagcccaccccaccggatacgaggggctgtgcgatcccgcagccgctccctccggggctcctcccatttatcccagtggctcaacaacttttttgccctccccttctcctccatggcttcccagcttgacatgtcttccgtggtgggggcaggggaaagcagagcccagactcttggagcaggtgttccccctggggactctgtcagaggctccatggaggcctctcaagtccaagtgcctctggaagcctctccaattacattcccaccaccctgtgccccagaaaggccccccatcagcccagtcccaggcgcccgtcaagcaggcctctgagagtgctacccttctcttgtaaccttgcagccaacacccctgcccggcccctgagctgcctcctccagcccatgctcttacaggccctgcacagagtagcactcattaattcttggttaaggaatgaatcaacgaatgaatggctatgcatggacctctgggcagggagacctgggtcttctctggctgagaggggaaggctaaggcatggctgagattcaagccaccattccaggcctctttgcccaagaaagaaacttctgtcacccttgcactctcctgtattctgagtccctggccaatagcacagccttccatgccccgacccccaccccaagcctctccactaggcctctgccaggatctaagcccatgagcacagggactggctatcccaagacctggcagatgtggctgctcaataaacacttgttgaaccatca

SEQ ID NO: 3289 - DNA, 1834 bp, Homo sapiens
ctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgaggaacgcgttgtggtgatcagcagctcggaagactcagatgccgaaaactcgtcctcccgagagctggatgacagcagcagtgagtccagtgacctccagctggaaggccccagcaccctcagggtcctggacgagaaccttgctgacccccaagcagaagacagacctctggttttctttgacctcaagattgacaatgaaagtgggttctcctggggctacccccacccctttctaatttagtctctgagtcccaaaaagaagtgcaggcagagccatctgccaggcccaggagagctctgagctctggccaacaactgcagccaggctgggcagagcactccggctcacctgggctcctggcgtgtcatttgctggcttgaataaagatgtccgccttatccagtgcctgagtgtgcgagagaggcagatgcctcc

SEQ ID NO: 3290 - DNA, 1738 bp, Homo sapiens
gctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgctgcctcctccagcccatgctcttacaggccctgcacagagtagcactcattaattcttggttaaggaatgaatcaacgaatgaatggctatgcatggacctctgggcagggagacctgggtcttctctggctgagaggggaaggctaaggcatggctgagattcaagccaccattccaggcctctttgcccaagaaagaaacttctgtcacccttgcactctcctgtattctgagtccctggccaatagcacagccttccatgccccgacccccaccccaagcctctccactaggcctctgccaggatctaagcccatgagcacagggactggctatcccaagacctggcagatgtggctgctcaataaacacttgttgaaccatca

SEQ ID NO: 3291 - DNA, 2237 bp, Homo sapiens
ctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcagaggaacgcgttgtggtgatcagcagctcggaagactcagatgccgaaaactcgtcctcccgagagctggatgacagcagcagtgagtccagtgacctccagctggaaggccccagcaccctcagggtcctggacgagaaccttgctgacccccaagcagaagacagacctctggttttctttgacctcaagattgacaatgaaagtgggttctcctggggctacccccacccctttctaatttagtctctgagtcccaaaaagaagtgcaggcagagccatctgccaggcccaggagagctctgagctctggccaacaactgcagccaggctgggcagagcactccggctcacctgggctcctggcgtgtcatttgctggcttgaataaagatgtccgccttatccagtgcctgagtgtgcgagagaggcagatgcctcc

SEQ ID NO: 3292 - DNA, 1590 bp, Homo sapiens
agaatcgaaactaagctggggtccatggagcctgcacccgcccgatctccgaggccccagcaggaccccgcccggccccaggagcccaccatgcctccccccgagaccccctctgaaggccgccagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcagaggaacgcgttgtggtgatcagcagctcggaagactcagatgccgaaaactcgtcctcccgagagctggatgacagcagcagtgagtccagtgacctccagctggaaggccccagcaccctcagggtcctggacgagaaccttgctgacccccaagcagaagacagacctctggttttctttgacctcaagattgacaatgaaacccagaagattagccagctggctgcggtgaaccgggaaagcaagttccgcgtggtcatccagcctgaagccttcttcagcatctactccaaggccgtgtccctggaggtggggctgcagcacttcctcagctttctgagctccatgcgccgccctatcttggcctgctacaagctgtgggggcctggcctcccaaacttcttccgggccctggaggacattaacaggctgtgggaattccaggaggccatctcgggcttcctggctgccctgcctctcatccgggagcgtgtgcccggggccagcagcttcaaactcaagaacctggcccagacctacctggcgagaaacatgagcgagcgcagcgccatggctgccgtgctggccatgcgtgacctgtgccgcctcctcgaggtctccccgggcccccagctggcccagcatgtctaccccttcagtagcctgcagtgctttgcctccctgcagcccctggtgcaggcagctgtgctgccccgggctgaggcccgcctcctggccctacacaacgtgagcttcatggagctgctgagtgcacaccgccgtgaccggcaggggggcctgaagaagtacagccgctatctaagcctgcagaccaccacgttgccccctgcccagcctgctttcaacctgcaggctctgggcacctactttgaaggcctgttggagggtccggcgctggcacgggcagaaggagtctccaccccacttgctggccgtggcttggcagagagggcctcccagcagagctgagaggagggggtgaccagcttggagtctctggtgggcagagagggatggggtccctgagccaggccccacccatcacagcattcccaggtcctggtacccagccctcagttgtcatttggttcag

SEQ ID NO: 3293 - DNA, 2608 bp, Homo sapiens
gctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcagaggaacgcgttgtggtgatcagcagctcggaagactcagatgccgaaaactcgtcctcccgagagctggatgacagcagcagtgagtccagtgacctccagctggaaggccccagcaccctcagggtcctggacgagaaccttgctgacccccaagcagaagacagacctctggttttctttgacctcaagattgacaatgaaacccagaagattagccagctggctgcggtgaaccgggaaagcaagttccgcgtggtcatccagcctgaagccttcttcagctttctgagctccatgcgccgccctatcttggcctgctacaagctgtgggggcctggcctcccaaacttcttccgggccctggaggacattaacaggctgtgggaattccaggaggccatctcgggcttcctggctgccctgcctctcatccgggagcgtgtgcccggggccagcagcttcaaactcaagaacctggcccagacctacctggcgagaaacatgagcgagcgcagcgccatggctgccgtgctggccatgcgtgacctgtgccgcctcctcgaggtctccccgggcccccagctggcccagcatgtctaccccttcagtagcctgcagtgctttgcctccctgcagcccctggtgcaggcagctgtgctgccccgggctgaggcccgcctcctggccctacacaacgtgagcttcatggagctgctgagtgcacaccgccgtgaccggcaggggggcctgaagaagtacagccgctatctaagcctgcagaccaccacgttgccccctgcccagcctgctttcaacctgcaggctctgggcacctactttgaaggcctgttggagggtccggcgctggcacgggcagaaggagtctccaccccacttgctggccgtggcttggcagagagggcctcccagcagagctga

SEQ ID NO: 3294 - DNA, 3713 bp, Homo sapiens
ctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcagaggaacgcgttgtggtgatcagcagctcggaagactcagatgccgaaaactcggtgagtggcccagaagttcagcccaggactcctgcctccccccatttcaggtcccagggggcacagccacagcaggtgactctcagacttgccttgcgcctggggaattttccagtgaggcattgagtcccaagctgtgctgaggacagtctccaaatgacagctgcatgcctggaccaccccagccctcccactacaccagggccaggagctcttctgaaatgctgatagcatgtgtccagagccctgtctcttttctggaatgtccaagacctttgtctggagcttccttatgcattttctgtcctctaagtcctcagtgaggagggctggacaagaatccattccttggtttattacagccagtgggggccagtgaaggggtgtcaggccacagggcagctatataggggccaaacaagtgaggtttgactccatccatgtagaaagatatataaatccattccacagtgaaacaggtggcctcgtgggtagtgacccttctgtccctagaggtttattactagaggctggactatcacctgtccaggggaaaaggggatctgaatagagtgaaaggttggactgggtggcccctgaggtctcttccagccctcagtctgaggttctgtattggaaagtgcatggagcccatggagaccgccgagccacagtcctcgccagcccactcctcgccagcccactcctcgccagcccactcctcgccagtccagtctctgctgagagcacaaggagcctccagcctgccctgtggcacataccaccccccagcttggcctccccaccagcccgctgagcaggctgccacccccgatgctgagcctcacagcgagcctcctgatcaccaggagcgccctgccgtccaccgtgggatccgctacctgttgtacagagcacagagagccatccgccttcgccatgccctccgcttgcaccctcaattgcatcgggcccctattcggacttggtctccccatgtggtccaagccagcactcctgccatcacagggcccctcaaccatcctgccaatgcccaggaacatcctgcccagctgcaaaggggcatcagcccaccccaccggatacgaggggctgtgcgatcccgcagccgctccctccggggctcctcccatttatcccagtggctcaacaacttttttgccctccccttctcctccatggcttcccagcttgacatgtcttccgtggtgggggcaggggaaagcagagcccagactcttggagcaggtgttccccctggggactctgtcagaggctccatggaggcctctcaagtccaagtgcctctggaagcctctccaattacattcccaccaccctgtgccccagaaaggccccccatcagcccagtcccaggcgcccgtcaagcaggcctctgagagtgctacccttctcttgtaaccttgcagccaacacccctgcccggcccctgagctgcctcctccagcccatgctcttacaggccctgcacagagtagcactcattaattcttggttaaggaatgaatcaacgaatgaatggctatgcatggacctctgggcagggagacctgggtcttctctggctgagaggggaaggctaaggcatggctgagattcaagccaccattccaggcctctttgcccaagaaagaaacttctgtcacccttgcactctcctgtattctgagtccctggccaatagcacagccttccatgccccgacccccaccccaagcctctccactaggcctctgccaggatctaagcccatgagcacagggactggctatcccaagacctggcagatgtggctgctcaataaacacttgttgaaccatc

SEQ ID NO: 3295 - DNA, 3080 bp, Homo sapiens
ctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcaggtagggagaggaacgcgttgtggtgatcagcagctcggaagactcagatgccgaaaactcgtgcatggagcccatggagaccgccgagccacagtcctcgccagcccactcctcgccagcccactcctcgccagcccactcctcgccagtccagtctctgctgagagcacaaggagcctccagcctgccctgtggcacataccaccccccagcttggcctccccaccagcccgctgagcaggctgccacccccgatgctgagcctcacagcgagcctcctgatcaccaggagcgccctgccgtccaccgtgggatccgctacctgttgtacagagcacagagagccatccgccttcgccatgccctccgcttgcaccctcaattgcatcgggcccctattcggacttggtctccccatgtggtccaagccagcactcctgccatcacagggcccctcaaccatcctgccaatgcccaggaacatcctgcccagctgcaaaggggcatcagcccaccccaccggatacgaggggctgtgcgatcccgcagccgctccctccggggctcctcccatttatcccagtggctcaacaacttttttgccctccccttctcctccatggcttcccagcttgacatgtcttccgtggtgggggcaggggaaagcagagcccagactcttggagcaggtgttccccctggggactctgtcagaggctccatggaggcctctcaagtccaagtgcctctggaagcctctccaattacattcccaccaccctgtgccccagaaaggccccccatcagcccagtcccaggcgcccgtcaagcaggcctctgagagtgctacccttctcttgtaaccttgcagccaacacccctgcccggcccctgagctgcctcctccagcccatgctcttacaggccctgcacagagtagcactcattaattcttggttaaggaatgaatcaacgaatgaatggctatgcatggacctctgggcagggagacctgggtcttctctggctgagaggggaaggctaaggcatggctgagattcaagccaccattccaggcctctttgcccaagaaagaaacttctgtcacccttgcactctcctgtattctgagtccctggccaatagcacagccttccatgccccgacccccaccccaagcctctccactaggcctctgccaggatctaagcccatgagcacagggactggctatcccaagacctggcagatgtggctgctcaataaacacttgttgaaccatc

SEQ ID NO: 3296 - DNA, 1985 bp, Homo sapiens
cgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcagaggaacgcgttgtggtgatcagcagctcggaagactcagatgccgaaaactcgtcctcccgagagctggatgacagcagcagtgagtccagtgacctccagctggaaggccccagcaccctcagggtcctggacgagaaccttgctgacccccaagcagaagacagacctctggttttctttgacctcaagattgacaatgaaagtgggttctcctggggctacccccacccctttctaatttagtctctgagtcccaaaaagaagtgcaggcagagccatctgccaggcccaggagagctctgagctctggccaacaactgcagccaggctgggcagagcactccggctcacctgggctcctggcgtgtcatttgctggcttgaataaagatgtccgcctta

SEQ ID NO: 3297 - DNA, 1920 bp, Homo sapiens
ccagccgccgcccggcctcaccacccctcgtttgcacgcacgcacgttcattctccgtcctcgcgccccttttcctacactttcctcttctccccgaccggaggagccgctctttccgcgcggtgcattctggggcccgaggtcgagcccgccgctgccgccgtcgcctgagggaagcgagaagaggccgcgaccggagagaaaaagcggagtcgccaccggagagaagtcgactccctagcagcagccgccgccagagaggcccgcccaccagttcgcccgtccccctgccccgttcacaatgcagcctgcttctgcaaagtggtacgatcgaagggactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatccaaatgattccaagcataaaagaacggacagatcaattttatgttgtttacgaaaaggagaatctggccagtcatggccaaggttaacaaaagaaagggcaaagcttaattggcttagtgtcgacttcaataattggaaagactgggaagatgattcagatgaagacatgtctaattttgatcgtttctctgagatgatgaacaacatgggtggtgatgaggatgtagatttaccagaagtagatggagcagatgatgattcacaagacagtgatgatgaaaaaatgccagatctggagtaaggaatattgtcatcacctggattttgagaaagaaaaataacttctctgcaagatttcataattgagagaattcctgagttgatagctctaaaggcagatatgctgtatttgcctactttaacccatttttcaacctgtttgttttttaaaaggcttcactaagggttgatatgtaccattgtatggggcaattttaagtcagctaaggcaataaccttatgcatgaacatttcccagactttcatgaagctgttgaggtcctaggcaattaatgcagcagttgcgataaataaaaacatctcacctaagtctccttttcttcataacatagatactgacatgataggaagctctcagcttagggaaagagaataaattttagattatagaacatggattcaaaagtgactggaacaaattggctgacaccttactggtaacctgctattcttctggtgttatccttcaggattgttccactaaaatttatttttcaaaaaatttacttcacattattctatgtaagtgatgacttgtcagtgttccaggtgtatcttagctaaaactagagaatgccctaacttagatggtttttgaagcctatacaattggtattgtttgacccttaagcttttacatctcttagcatggaggacgaagaaagctgtacattgttgcttgagagtctgtacatttagtccagatttgtatttgcactgtcagtatggcaaatgagtgaaaaatgtttaatacactattggattttttatttcctttttttgattcagcttatacccgggctgaaaacctcaatttatgttcatgacagtggggatttttttaaatgtctacattctttctaataaactgttggaagacttcttggctgtccttttaagtgtctggcttactgtaatttttatgtatttaccatttactggaatggagtttatttgaggaagaatttgggattattcctctgtttgaaaaaagaggcttgctgtaatgtcacaggaaaccttttaaaagtggatctgtaatagcatattgtagatgcactttgcagcagttggaaaagaaagtgttgtgtgatttgattgaaataaaactaaatgtgttgtcctcctaaatctttg

SEQ ID NO: 3298 - DNA, 2328 bp, Homo sapiens
gcgccatgagccggagtctcttgctctggttcttgctgttcctgctcctgctcccgccgctccccgtcctgctcgcggacccaggggcgcccacgccagtgaatccctgttgttactatccatgccagcaccagggcatctgtgtccgcttcggccttgaccgctaccagtgtgactgcacccgcacgggctattccggccccaactgcaccatccctggcctgtggacctggctccggaattcactgcggcccagcccctctttcacccacttcctgctcactcacgggcgctggttctgggagtttgtcaatgccaccttcatccgagagatgctcatgcgcctggtactcacagtgcgctccaaccttatccccagtccccccacctacaactcagcacatgactacatcagctgggagtctttctccaacgtgagctattacactcgtattctgccctctgtgcctaaagattgccccacacccatgggaaccaaagggaagaagcagttgccagatgcccagctcctggcccgccgcttcctgctcaggaggaagttcatacctgacccccaaggcaccaacctcatgtttgccttctttgcacaacacttcacccaccagttcttcaaaacttctggcaagatgggtcctggcttcaccaaggccttgggccatggggtagacctcggccacatttatggagacaatctggagcgtcagtatcaactgcggctctttaaggatgggaaactcaagtaccaggtgctggatggagaaatgtacccgccctcggtagaagaggcgcctgtgttgatgcactacccccgaggcatcccgccccagagccagatggctgtgggccaggaggtgtttgggctgcttcctgggctcatgctgtatgccacgctctggctacgtgagcacaaccgtgtgtgtgacctgctgaaggctgagcaccccacctggggcgatgagcagcttttccagacgacccgcctcatcctcataggggagaccatcaagattgtcatcgaggagtacgtgcagcagctgagtggctatttcctgcagctgaaatttgacccagagctgctgttcggtgtccagttccaataccgcaaccgcattgccatggagttcaaccatctctaccactggcaccccctcatgcctgactccttcaagatcggtgggggcaggaacatggaccaccacatcctgcatgtggctgtggatgtcatcagggagtctcgggagatgcggctgcagcccttcaatgagtaccgcaagaggtttggcatgaaaccctacacctccttccaggagctcgtaggagagaaggagatggcagcagagttggaggaattgtatggagacattgatgcgttggagttctaccctggactgcttcttgaaaagtgccatccaaactctatctttggggagagtatgatagagattggggctcccttttccctcaagggtctcctagggaatcccatctgttctccggagtactggaagccgagcacatttggcggcgaggtgggctttaacattgtcaagacggccacactgaagaagctggtctgcctcaacaccaagacctgtccctacgtttccttccgtgtgccggatgccagtcaggatgatgggcctgctgtggagcgaccatccacagagctctgaggggcaggaaagcagcattctggaggggagagctttgtgcttgtcattccagagtgctgaggccagggctgatggtcttaaatgctcattttctggtttggcatggtgagtgttggggttgacatttagaactttaagtctcacccattatctggaatattgtgattctgtttattcttccagaatgctgaactccttgttagcccttcagattgttaggagtggttctcatttggtctgccagaatactgggttcttagttgacaacctagaatgtcagatttctggttgatttgtaacacagtcattctaggatgtggagctactgatgaaatctgctagaaagttagggggttcttattttgcattccagaatcttgactttctgattggtgattcaaagtgttgtgttcctggctgatgatccagaacagtggctcgtatcccaaatctgtcagcatctggctgtctagaatgtggatttgattcattttcctgttcagtgagatatcatagagacggagatcctaaggtccaacaagaatgcattccctgaatctgtgcctgcactgagagggcaaggaagtggggtgttcttcttgggacccccactaagaccctggtctgaggatgt

SEQ ID NO: 3299 - DNA, 4964 bp, Homo sapiens
gcgccatgagccggagtctcttgctctggttcttgctgttcctgctcctgctcccgccgctccccgtcctgctcgcggacccaggggcgcccacgccagtgaatccctgttgttactatccatgccagcaccagggcatctgtgtccgcttcggccttgaccgctaccagtgtgactgcacccgcacgggctattccggccccaactgcaccatccctggcctgtggacctggctccggaattcactgcggcccagcccctctttcacccacttcctgctcactcacgggcgctggttctgggagtttgtcaatgccaccttcatccgagagatgctcatgcgcctggtactcacagtgcgctccaaccttatccccagtccccccacctacaactcagcacatgactacatcagctgggagtctttctccaacgtgagctattacactcgtattctgccctctgtgcctaaagattgccccacacccatgggaaccaaagggaagaagcagttgccagatgcccagctcctggcccgccgcttcctgctcaggaggaagttcatacctgacccccaaggcaccaacctcatgtttgccttctttgcacaacacttcacccaccagttcttcaaaacttctggcaagatgggtcctggcttcaccaaggccttgggccatggggtagacctcggccacatttatggagacaatctggagcgtcagtatcaactgcggctctttaaggatgggaaactcaagtaccaggtgctggatggagaaatgtacccgccctcggtagaagaggcgcctgtgttgatgcactacccccgaggcatcccgccccagagccagatggctgtgggccaggaggtgtttgggctgcttcctgggctcatgctgtatgccacgctctggctacgtgagcacaaccgtgtgtgtgacctgctgaaggctgagcaccccacctggggcgatgagcagcttttccagacgacccgcctcatcctcataggggagaccatcaagattgtcatcgaggagtacgtgcagcagctgagtggctatttcctgcagctgaaatttgacccagagctgctgttcggtgtccagttccaataccgcaaccgcattgccatggagttcaaccatctctaccactggcaccccctcatgcctgactccttcaaggtgggctcccaggagtacagctacgagcagttcttgttcaacacctccatgttggtggactatggggttgaggccctggtggatgccttctctcgccagattgctggccggatcggtgggggcaggaacatggaccaccacatcctgcatgtggctgtggatgtcatcagggagtctcgggagatgcggctgcagcccttcaatgagtaccgcaagaggtttggcatgaaaccctacacctccttccaggagctcgtaggagagaaggagatggcagcagagttggaggaattgtatggagacattgatgcgttggagttctaccctggactgcttcttgaaaagtgccatccaaactctatctttggggagagtatgatagagattggggctcccttttccctcaagggtctcctagggaatcccatctgttctccggagtactggaagccgagcacatttggcggcgaggtgggctttaacattgtcaagacggccacactgaagaagctggtctgcctcaacaccaagacctgtccctacgtttccttccgtgtgccggatgccagtcaggatgatgggcctgctgtggagcgaccatccacagagctctgaggggcaggaaagcagcattctggaggggagagctttgtgcttgtcattccagagtgctgaggccagggctgatggtcttaaatgctcattttctggtttggcatggtgagtgttggggttgacatttagaactttaagtctcacccattatctggaatattgtgattctgtttattcttccagaatgctgaactccttgttagcccttcagattgttaggagtggttctcatttggtctgccagaatactgggttcttagttgacaacctagaatgtcagatttctggttgatttgtaacacagtcattctaggatgtggagctactgatgaaatctgctagaaagttagggggttcttattttgcattccagaatcttgactttctgattggtgattcaaagtgttgtgttcctggctgatgatccagaacagtggctcgtatcccaaatctgtcagcatctggctgtctagaatgtggatttgattcattttcctgttcagtgagatatcatagagacggagatcctaaggtccaacaagaatgcattccctgaatctgtgcctgcactgagagggcaaggaagtggggtgttcttcttgggacccccactaagaccctggtctgaggatgtagagagaacaggtgggctgtattcacgccattggttggaagctaccagagctctatccccatccaggtcttgactcatggcagctgtttctcatgaagctaataaaattcgctttctaaagttacctgttatatatctcttttggtcccatcctctaaagcagaggcaacactggaacatggctagcctttcttgtagccatggctgggcgtgctagaggttgcagcatgagactttctgctgggatccttgggcccatcactgtatagacatgctaccactggtacttcctttctccctgcgggccaggcactgcccttttcaggaagctctcttaaaatacccattgccccagacctggaagatataacattcagttcccaccatctgattaaaacaacttcctcccttacagagcatacaacagagggggcacccggggaggagagcacatactgtgttccaatttcacgcttttaattctcatttgttctcacaccaacagtgtgaagtgcgtggtataatctccatttcaaaaccaaggaagcagcctcagagtggtcgagtgacacacctcacgcaggctgagtccagagcttgtgctcctcttgattcctggtttgactcagttccaggcctgatcttgcctgtctggctcagggtcaaagacagaatggtggagtgtagcctccacctgatattcaggctactcattcagtcccaaatatgtattttcctaagtgtttactatgtgccagttcctgtaacaggtgtggggacacagcagtgagtaatcaatacagacaaggttctgcccttatggagctcacactccagtggcagacaaacagaccataaataaggaaacgatgaaataagatatatacaaggtgagtgtgacttcccttctaaccccctctgctctgtcctcccctattgcgctctcaagaccagagacccaacagcagtgatctcagggcagacagccctccactccagctctgagacccttttctcaggacctctgtaggcagcagagagagaggacagaggggtaagatgaggggttgagggaaggttcttcatgatccacactttgggcttagtatttctcaggaagagctatggcccagaaacaacaggggaaactagagttcggtctgacagtccttggggttaagtctcctgtcttatggtccagaaactcctgtttctccttagttggctggaaactgctcccatcattccttctggcctctgctgaatgcagggaatgcaatccttccctgctcttgcagttgctctgacgtagaaagatccttcgggtgctggaagtctccatgaagagcttgtgtcctgtcctttcttgcagattctatttcccctcttctgctaatacctcttactttgcttgagaatcctctcctttcttattaatttcagtcttggtggttctatcaggggtgcattctggccaaggggtgggcctgtgaatcaatcctgggcaatcagacaccctctccttaaaaactggcccgtggagactgagatcactgactctgactcatccccacagctggctctgacaagatggtccatttgttcctgcttccgagatccccagggcagcctggatccctgcccttctcaagactttagcttttccttccatccggtggcctattccaggaattcctcttttgcttaaatcagttggagtttgtgtctgttgcttgtaatcaagcctttatggctgctgggctgagtgacacaagcactttaatggcctggagggacttttaatcagtgaagatgcaatcagacaagtgttttggaaagagcaccctcgagaagggtggatgacagggcagagcaggaaggacaggaagctggcagaacggaggaggctgcagccgtggtccaaccaggagctgatggcagctggggctaggggaagggctttgagggtggaaggatgggatgggttccagaggtattcctctcttaaatgcaagtgcctagattaggtagactttgcttagtattgacaactgcacatgaaagttttgcaaagggaaacaggctaaatgcaccaagaaagcttcttcagagtgaagaatcttaatgcttgtaatttaaacatttgttcctggagttttgatttggtggatgtgatggttggttttatttgtcagtttggttgggctatagcacacagttatttaatcaaacagtaatctaggtgtggctgtgaaggtattttgtagatgtgattaacatctacaatcagttgactttaagtgaaagagattacttaaataatttgggtgagctgcacctgattagttgaaaggcctcaagaacaaacactgcagtttcctggaaaagaagaaactttgcctcaagactatagccatcgactcctgcctgagtttccagcctgctagtctgccctatggatttgaagtttgccaaccccaacaattgtgtgaattaatttctaaaaataaagctatatacagcca

SEQ ID NO: 3300 - DNA, 2073 bp, Homo sapiens
agcttgtggctcttctgcctgccgaggcagagctctagggccatggcgggaggccttccggctccacctcagacagctgttgagggcctggaagatgagggactccttttggtcaggctggagtgaatccctgttgttactatccatgccagcaccagggcatctgtgtccgcttcggccttgaccgctaccagtgtgactgcacccgcacgggctattccggccccaactgcaccatccctggcctgtggacctggctccggaattcactgcggcccagcccctctttcacccacttcctgctcactcacgggcgctggttctgggagtttgtcaatgccaccttcatccgagagatgctcatgcgcctggtactcacagtgcgctccaaccttatccccagtccccccacctacaactcagcacatgactacatcagctgggagtctttctccaacgtgagctattacactcgtattctgccctctgtgcctaaagattgccccacacccatgggaaccaaagggaagaagcagttgccagatgcccagctcctggcccgccgcttcctgctcaggaggaagttcatacctgacccccaaggcaccaacctcatgtttgccttctttgcacaacacttcacccaccagttcttcaaaacttctggcaagatgggtcctggcttcaccaaggccttgggccatggggtagacctcggccacatttatggagacaatctggagcgtcagtatcaactgcggctctttaaggatgggaaactcaagtaccaggtgctggatggagaaatgtacccgccctcggtagaagaggcgcctgtgttgatgcactacccccgaggcatcccgccccagagccagatggctgtgggccaggaggtgtttgggctgcttcctgggctcatgctgtatgccacgctctggctacgtgagcacaaccgtgtgtgtgacctgctgaaggctgagcaccccacctggggcgatgagcagcttttccagacgacccgcctcatcctcataggggagaccatcaagattgtcatcgaggagtacgtgcagcagctgagtggctatttcctgcagctgaaatttgacccagagctgctgttcggtgtccagttccaataccgcaaccgcattgccatggagttcaaccatctctaccactggcaccccctcatgcctgactccttcaaggtgggctcccaggagtacagctacgagcagttcttgttcaacacctccatgttggtggactatggggttgaggccctggtggatgccttctctcgccagattgctggccggatcggtgggggcaggaacatggaccaccacatcctgcatgtggctgtggatgtcatcagggagtctcgggagatgcggctgcagcccttcaatgagtaccgcaagaggtttggcatgaaaccctacacctccttccaggagctcgtaggagagaaggagatggcagcagagttggaggaattgtatggagacattgatgcgttggagttctaccctggactgcttcttgaaaagtgccatccaaactctatctttggggagagtatgatagagattggggctcccttttccctcaagggtctcctagggaatcccatctgttctccggagtactggaagccgagcacatttggcggcgaggtgggctttaacattgtcaagacggccacactgaagaagctggtctgcctcaacaccaagacctgtccctacgtttccttccgtgtgccggatgccagtcaggatgatgggcctgctgtggagcgaccatccacagagctctgaggggcaggaaagcagcattctggaggggagagctttgtgcttgtcattccagagtgctgaggccagggctgatggtcttaaatgctcattttctggtttggcatggtgagtgttggggttgacatttagaactttaagtctcacccattatctggaatattgtgattctgtttattcttccagaatgctgaactccttgttagcccttcagattgttaggagtggttctcatttggtctgccag

SEQ ID NO: 3301 - DNA, 468 bp, Homo sapiens
agtctcttgctctggttcttgctgttcctgctcctgctcccgccgctccccgtcctgctcgcggacccaggggcgcccacgccagctggcctgtggacctggctccggaattcactgcggcccagcccctctttcacccacttcctgctcactcacgggcgctggttctgggagtttgtcaatgccaccttcatccgagagatgctcatgcgcctggtactcacagtgcgctccaaccttatccccagtccccccacctacaactcagcacatgactacatcagctgggagtctttctccaacttcttcaaaacttctggcaagatgggtcctggcttcaccaaggccttgggccatggggtagacctcggccacatttatggagacaatctggagcgtcagtatcaactgcggctctttaaggatgggaaactcaagtaccaggtgctggatggagaaatgtacccg

SEQ ID NO: 3302 - DNA, 2312 bp, Homo sapiens
atctaggaaaccatcagcaggccaggctggactgccccatttctagccccctttcttctctgcagactgccctgtttctagccccttttcttctctacccttttctgtagagtgcgttagacccattttacagaaggggactctgagaccctttcttctctgcggggcagggtatgtggttcagacgagccgcttccatccccagttctgtccctaagccctgggtgacctcagcattgagcatcgtctctgagcctcagtttcctgtctatatctagtgccaccaggcatcagaaacggagtctcttgctctggttcttgctgttcctgctcctgctcccgccgctccccgtcctgctcgcggacccaggggcgcccacgccaggggcctctttgggaggaagccgcaggcaccaagggaaatgagttccctttctccagcctctaaccgtctgggaacccatcctgattcccattgccagtggagaaggtctcccctggtgaagacttcgggagaacatgggagatggaaatacatttaggagccgggatgcttcatctggggtttaagagatccccattgagcaaatgaggaaaccgaggctcatgaatccctgttgttactatccatgccagcaccagggcatctgtgtccgcttcggccttgaccgctaccagtgtgactgcacccgcacgggctattccggccccaactgcaccatccctggcctgtggacctggctccggaattcactgcggcccagcccctctttcacccacttcctgctcactcacgggcgctggttctgggagtttgtcaatgccaccttcatccgagagatgctcatgcgcctggtactcacagtgcgctccaaccttatccccagtccccccacctacaactcagcacatgactacatcagctgggagtctttctccaacgtgagctattacactcgtattctgccctctgtgcctaaagattgccccacacccatgggaaccaaagggaagaagcagttgccagatgcccagctcctggcccgccgcttcctgctcaggaggaagttcatacctgacccccaaggcaccaacctcatgtttgccttctttgcacaacacttcacccaccagttcttcaaaacttctggcaagatgggtcctggcttcaccaaggccttgggccatggggtagacctcggccacatttatggagacaatctggagcgtcagtatcaactgcggctctttaaggatgggaaactcaagtaccaggtgctggatggagaaatgtacccgccctcggtagaagaggcgcctgtgttgatgcactacccccgaggcatcccgccccagagccagatggctgtgggccaggaggtgtttgggctgcttcctgggctcatgctgtatgccacgctctggctacgtgagcacaaccgtgtgtgtgacctgctgaaggctgagcaccccacctggggcgatgagcagcttttccagacgacccgcctcatcctcataggggagaccatcaagattgtcatcgaggagtacgtgcagcagctgagtggctatttcctgcagctgaaatttgacccagagctgctgttcggtgtccagttccaataccgcaaccgcattgccatggagttcaaccatctctaccactggcaccccctcatgcctgactccttcaagatcggtgggggcaggaacatggaccaccacatcctgcatgtggctgtggatgtcatcagggagtctcgggagatgcggctgcagcccttcaatgagtaccgcaagaggtttggcatgaaaccctacacctccttccaggagctcgtaggagagaaggagatggcagcagagttggaggaattgtatggagacattgatgcgttggagttctaccctggactgcttcttgaaaagtgccatccaaactctatctttggggagagtatgatagagattggggctcccttttccctcaagggtctcctagggaatcccatctgttctccggagtactggaagccgagcacatttggcggcgaggtgggctttaacattgtcaagacggccacactgaagaagctggtctgcctcaacaccaagacctgtccctacgtttccttccgtgtgccggatgccagtcaggatgatgggcctgctgtggagcgaccatccacagagctctgaggggcaggaaagcagcattctggaggggagagctttgtgcttgtcattccagagtgctgaggccagggctgatggtcttaaatgctcattttctggtttggcatggtgag

SEQ ID NO: 3303 - DNA, 4514 bp, Homo sapiens
gaccaattgtcatacgacttgcagtgagcgtcaggagcacgtccaggaactcctcagcagcgcctccttcagctccacagccagacgccctcagacagcaaagcctacccccgcgccgcgccctgcccgccgctgcgatgctcgcccgcgccctgctgctgtgcgcggtcctggcgctcagccatacagcaaatccttgctgttcccacccatgtcaaaaccgaggtgtatgtatgagtgtgggatttgaccagtataagtgcgattgtacccggacaggattctatggagaaaactgctcaacaccggaatttttgacaagaataaaattatttctgaaacccactccaaacacagtgcactacatacttacccacttcaagggattttggaacgttgtgaataacattcccttccttcgaaatgcaattatgagttatgtgttgacatccagatcacatttgattgacagtccaccaacttacaatgctgactatggctacaaaagctgggaagccttctctaacctctcctattatactagagcccttcctcctgtgcctgatgattgcccgactcccttgggtgtcaaaggtaaaaagcagcttcctgattcaaatgagattgtggaaaaattgcttctaagaagaaagttcatccctgatccccagggctcaaacatgatgtttgcattctttgcccagcacttcacgcatcagtttttcaagacagatcataagcgagggccagctttcaccaacgggctgggccatggggtggacttaaatcatatttacggtgaaactctggctagacagcgtaaactgcgccttttcaaggatggaaaaatgaaatatcagataattgatggagagatgtatcctcccacagtcaaagatactcaggcagagatgatctaccctcctcaagtccctgagcatctacggtttgctgtggggcaggaggtctttggtctggtgcctggtctgatgatgtatgccacaatctggctgcgggaacacaacagagtatgcgatgtgcttaaacaggagcatcctgaatggggtgatgagcagttgttccagacaagcaggctaatactgataggagagactattaagattgtgattgaagattatgtgcaacacttgagtggctatcacttcaaactgaaatttgacccagaactacttttcaacaaacaattccagtaccaaaatcgtattgctgctgaatttaacaccctctatcactggcatccccttctgcctgacacctttcaaattcatgaccagaaatacaactatcaacagtttatctacaacaactctatattgctggaacatggaattacccagtttgttgaatcattcaccaggcaaattgctggcagggttgctggtggtaggaatgttccacccgcagtacagaaagtatcacaggcttccattgaccagagcaggcagatgaaataccagtcttttaatgagtaccgcaaacgctttatgctgaagccctatgaatcatttgaagaacttacaggagaaaaggaaatgtctgcagagttggaagcactctatggtgacatcgatgctgtggagctgtatcctgcccttctggtagaaaagcctcggccagatgccatctttggtgaaaccatggtagaagttggagcaccattctccttgaaaggacttatgggtaatgttatatgttctcctgcctactggaagccaagcacttttggtggagaagtgggttttcaaatcatcaacactgcctcaattcagtctctcatctgcaataacgtgaagggctgtccctttacttcattcagtgttccagatccagagctcattaaaacagtcaccatcaatgcaagttcttcccgctccggactagatgatatcaatcccacagtactactaaaagaacgttcgactgaactgtagaagtctaatgatcatatttatttatttatatgaaccatgtctattaatttaattatttaataatatttatattaaactccttatgttacttaacatcttctgtaacagaagtcagtactcctgttgcggagaaaggagtcatacttgtgaagacttttatgtcactactctaaagattttgctgttgctgttaagtttggaaaacagtttttattctgttttataaaccagagagaaatgagttttgacgtctttttacttgaatttcaacttatattataagaacgaaagtaaagatgtttgaatacttaaacactgtcacaagatggcaaaatgctgaaagtttttacactgtcgatgtttccaatgcatcttccatgatgcattagaagtaactaatgtttgaaattttaaagtacttttggttatttttctgtcatcaaacaaaaacaggtatcagtgcattattaaatgaatatttaaattagacattaccagtaatttcatgtctactttttaaaatcagcaatgaaacaataatttgaaatttctaaattcatagggtagaatcacctgtaaaagcttgtttgatttcttaaagttattaaacttgtacatataccaaaaagaagctgtcttggatttaaatctgtaaaatcagtagaaattttactacaattgcttgttaaaatattttataagtgatgttcctttttcaccaagagtataaacctttttagtgtgactgttaaaacttccttttaaatcaaaatgccaaatttattaaggtggtggagccactgcagtgttatcttaaaataagaatattttgttgagatattccagaatttgtttatatggctggtaacatgtaaaatctatatcagcaaaagggtctacctttaaaataagcaataacaaagaagaaaaccaaattattgttcaaatttaggtttaaacttttgaagcaaacttttttttatccttgtgcactgcaggcctggtactcagattttgctatgaggttaatgaagtaccaagctgtgcttgaataatgatatgttttctcagattttctgttgtacagtttaatttagcagtccatatcacattgcaaaagtagcaatgacctcataaaatacctcttcaaaatgcttaaattcatttcacacattaattttatctcagtcttgaagccaattcagtaggtgcattggaatcaagcctggctacctgcatgctgttccttttcttttcttcttttagccattttgctaagagacacagtcttctcatcacttcgtttctcctattttgttttactagttttaagatcagagttcactttctttggactctgcctatattttcttacctgaacttttgcaagttttcaggtaaacctcagctcaggactgctatttagctcctcttaagaagattaaaagagaaaaaaaaaggcccttttaaaaatagtatacacttattttaagtgaaaagcagagaattttatttatagctaattttagctatctgtaaccaagatggatgcaaagaggctagtgcctcagagagaactgtacggggtttgtgactggaaaaagttacgttcccattctaattaatgccctttcttatttaaaaacaaaaccaaatgatatctaagtagttctcagcaataataataatgacgataatacttcttttccacatctcattgtcactgacatttaatggtactgtatattacttaatttattgaagattattatttatgtcttattaggacactatggttataaactgtgtttaagcctacaatcattgatttttttttgttatgtcacaatcagtatatcttctttggggttacctctctgaatattatgtaaacaatccaaagaaatgattgtattaagatttgtgaataaatttttagaaatctgattggcatattgagatatttaaggttgaatgtttgtccttaggataggcctatgtgctagcccacaaagaatattgtctcattagcctgaatgtgccataagactgaccttttaaaatgttttgagggatctgtggatgcttcgttaatttgttcagccacaatttattgagaaaatattctgtgtcaagcactgtgggttttaatatttttaaatcaaacgctgattacagataatagtatttatataaataattgaaaaaaattttcttttgggaagagggagaaaatgaaataaatatcattaaagataactcaggagaatcttctttacaattttacgtttagaatgtttaaggttaagaaagaaatagtcaatatgcttgtataaaacactgttcactgttttttttaaaaaaaaaacttgatttgttattaacattgatctgctgacaaaacctgggaatttgggttgtgtatgcgaatgtttcagtgcctcagacaaatgtgtatttaacttatgtaaaagataagtctggaaataaatgtctgtttatttttgtactatttaaaaattgacagatcttttctgaagataaactttgattgtttctata

SEQ ID NO: 3304 - DNA, 1611 bp, Homo sapiens
agtttggttccagcaacaaattatatatatacacccctgaatcaacttaagggtggtacaattgtcaatgtctatggtgttgtgaagttctttaagcccccatatctaagcaaaggaactgattattgctcagttgtaactattgtggaccagacaaatgtaaaactaacttgcctgctctttagtggaaactatgaagcccttccaataatttataaaaatggagatattgttcgctttcacaggctgaagattcaagtatataaaaaggagactcagggtatcaccagctctggctttgcatctttgacgtttgagggaactttgggagcccctatcatacctcgcacttcaagcaagtattttaacttcactactgaggaccacaaaatggtagaagccttacgtgtttgggcatctactcatatgtcaccgtcttggacattactaaaattgtgtgatgttcagccaatgcagtattttgacctgacttgtcagctcttgggcaaagcagaagtggacggagcatcatttcttctaaaggtatgggatggcaccaggacaccatttccatcttggagagtcttaatacaagaccttgttcttgaaggtgatttaagtcacatccatcggctacaaaatctgacaatagacattttagtctacgataaccatgttcatgtggcaagatctctgaaggttggaagctttcttagaatctatagccttcataccaaacttcaatcaatgaattcagagaatcagacaatgttaagtttagagtttcatcttcatggaggtaccagttacggtcggggaatcagggtcttgccagaaagtaactctgatgtggatcaactgaaaaaggatttagaatctgcaaatttgacagccaatcagcattcagatgttatctgtcaatcagaacctgacgacagctttccaagctctggatcagtatcattatacgaggtagaaagatgtcaacagctatctgctacaatacttacagatcatcagtatttggagaggacaccactatgtgccattttgaaacaaaaagctcctcaacaataccgcatccgagcaaaattgaggtcatataagcccagaagactatttcagtctgttaaacttcattgccctaaatgtcatttgctgcaagaagttccacatgagggcgatttggatataatttttcaggatggtgcaactaaaaccccagatgtcaagctacaaaatacatcattatatgattcaaaaatctggaccactaaaaatcaaaaaggacgaaaagtagcagttcattttgtgaaaaataatggtattctcccgctttcaaatgaatgtctacttttgatagaaggaggtacactcagtgaaatttgcaaactctcgaacaagtttaatagtgtaattcctgtgagatctggccacgaagacctggaacttttggacctttcagcaccatttcttatacaaggaacaatacatcactatggatgtaaacagtgttctagtttgagatccatacaaaatctaaattccctggttgataaaacatcgtggattccttcttctgtggcagaagagctggacattgtgctgcag

SEQ ID NO: 3305 - DNA, 4080 bp, Homo sapiens
cagtatttcgccaaacctccaggcgccatcagtgtgtgaaccgttacgcagctggtccaccgcgggcggagaacaagcgactatgcccagggatcctgcacgcatgcgtggagctgaaccgtcagcgtgcgtgtgacgtcacctgcgcgcccgcctaaactcttcctagggttctttctagagtacggcagcaagttgtcagattccctagttgaatttgctttggacatcagtgtgaagcagaactgatatgccacttgaattaataaaggaagtcaatggggtgcctgaagttcagccgctgagtaaattacataaagtagatttcggatccctacagccaggttacaattatagcaagaaatatattcagggaaaactttcacttatctcttctttaacttatcgtggaaataaaacagctgttttgcagattggactacaaggacaccattgcagtggctagatttattgtttttttagcttcttcatctacaagcagagatggtaaaccttgcatatttttgaaagcatttgaagacctcaaatcaactgtttatgtttatgtcaaatctttaagagatttttctacagaatcaatgtctttggttccagcaacaaattatatatatacacccctgaatcaacttaagggtggtacaattgtcaatgtctatggtgttgtgaagttctttaagcccccatatctaagcaaaggaactgattattgctcagttgtaactattgtggaccagacaaatgtaaaactaacttgcctgctctttagtggaaactatgaagcccttccaataatttataaaaatggagatattgttcgctttcacaggctgaagattcaagtatataaaaaggagactcagggtatcaccagctctggctttgcatctttgacgtttgagggaactttgggagcccctatcatacctcgcacttcaagcaagtattttaacttcactactgaggaccacaaaatggtagaagccttacgtgtttgggcatctactcatatgtcaccgtcttggacattactaaaattgtgtgatgttcagccaatgcagtattttgacctgacttgtcagctcttgggcaaagcagaagtggacggagcatcatttcttctaaaggtatgggatggcaccaggacaccatttccatcttggagagtcttaatacaagaccttgttcttgaaggtgatttaagtcacatccatcggctacaaaatctgacaatagacattttagtctacgataaccatgttcatgtggcaagatctctgaaggttggaagctttcttagaatctatagccttcataccaaacttcaatcaatgaattcagagaatcagacaatgttaagtttagagtttcatcttcatggaggtaccagttacggtcggggaatcagggtcttgccagaaagtaactctgatgtggatcaactgaaaaaggatttagaatctgcaaatttgacagccaatcagcattcagatgttatctgtcaatcagaacctgacgacagctttccaagctctggatcagtatcattatacgaggtagaaagatgtcaacagctatctgctacaatacttacagatcatcagtatttggagaggacaccactatgtgccattttgaaacaaaaagctcctcaacaataccgcatccgagcaaaattgaggtcatataagcccagaagactatttcagtctgttaaacttcattgccctaaatgtcatttgctgcaagaagttccacatgagggcgatttggatataatttttcaggatggtgcaactaaaaccccagatgtcaagctacaaaatacatcattatatgattcaaaaatctggaccactaaaaatcaaaaaggacgaaaagtagcagttcattttgtgaaaaataatggtattctcccgctttcaaatgaatgtctacttttgatagaaggaggtacactcagtgaaatttgcaaactctcgaacaagtttaatagtgtaattcctgtgagatctggccacgaagacctggaacttttggacctttcagcaccatttcttatacaaggaacaatacatcactatggatgtaaacagtgttctagtttgagatccatacaaaatctaaattccctggttgataaaacatcgtggattccttcttctgtggcagaagcactgggtattgtacccctccaatatgtgtttgttatgacctttacacttgatgatggaacaggagtactagaagcctatctcatggattctgacaaattcttccagattccagcatcagaagttctgatggatgatgaccttcagaaaagtgtggatatgatcatggatatgttttgtcctccaggaataaaaattgatgcatatccgtggttggaatgcttcatcaagtcatacaatgtcacaaatggaacagataatcaaatttgctatcagatttttgacaccacagttgcagaagatgtaatctaatattgccatccaatttagcatacataaaatgttgccactcaccttccctgtttgagcttcttttcctgacctgagttttgtatcagcaatgttgatgatgttagcatgggtatgggattagaaaatgtccttaccttaaatctcttggcttttactgggtgcaaggtaaataatggctatggattttgttttgctttctgttttgcttttgtacaaagagacctgcttaaacaagtactgctgagataagtgtctgatcaagctacagtgtactttaagtagaaatggcaaagttgctttgttggggtgctgatactgatgattttaggataaattcatttctttaaacttgtaatacatggttttattgcttgtttctctccaggatagtagagatttctctatttcacctcaacctaataaaagtggtcagatttataatgttaatgacttaatattatccttttctaatagtctcatgtaaaatatgccgctattacaacttacaactaattgaatgagatgttaacttagtaaaatagtttgatttttacctgacagtgtttgtcaaatttaaaatcatgaatattcaattttatacaaacatttatatatatatatatagatttgtgtatgttatttgccaaagacagatataaattacctggtttaatattagtgaagaataaataagtgcacacatttcaactgtttcatttatttgccctaagttgagctgaaaaatgatatgaggcaaagaatcgaaataggtgtggcaatgcagcagatgtttagggctgtctacatcccaggtactgtgctaagcactaaacatgtatttgatcctcacagcaacctatttttccgataagaaatctgaggcttgattgataagctgacttgactaagttcacacagtttgtaaaagctagagtctgtgccttaattcacataatctctattcagagcctgtactgttaaccactcaaggattctggaacagaagctaacagttttctgcaacgagtctttgacttaaacatctgaaataacattggaaatagattataagaggagtcagtgtgtttttctatagtttcaaaatacttttaacatcttattgtcaaaaagattggataactgactttctttgctcataataactctaaattctagttcctgagtacattaacacatcttctttacctaactaccaatgtcccccatcatcgacttatcagcttgtttgagacaatgagaaagactgattttattttcaagaatatagactcttggttcaaaacattttcaggaaaaatattttaaaaccctacagttgaacaggtgtgtttccgtgttgatgatgtgctcaggatacaaaggtgaaataaacattttttctgccttcaggaagccctcaatctagaagagtagaggtccaaaggtgccatatgttcacactgtgagcctgcaagatctccacgttaacaaaggaaaactcttcctatgaatcttcatgatgataggccatgtctcttcttatttttgttttaaataaacatccaccttatcatga

SEQ ID NO: 3306 - DNA, 2028 bp, Homo sapiens
tctctttctttagttccagcaacaaattatatatatacacccctgaatcaacttaagggtggtacaattgtcaatgtctatggtgttgtgaagttctttaagcccccatatctaagcaaaggaactgattattgctcagttgtaactattgtggaccagacaaatgtaaaactaacttgcctgctctttagtggaaactatgaagcccttccaataatttataaaaatggagatattgttcgctttcacaggctgaagattcaagtatataaaaaggagactcagggtatcaccagctctggctttgcatctttgacgtttgagggaactttgggagcccctatcatacctcgcacttcaagcaagtattttaacttcactactgaggaccacaaaatggtagaagccttacgtgtttgggcatctactcatatgtcaccgtcttggacattactaaaattgtgtgatgttcagccaatgcagtattttgacctgacttgtcagctcttgggcaaagcagaagtggacggagcatcatttcttctaaaggtatgggatggcaccaggacaccatttccatcttggagagtcttaatacaagaccttgttcttgaaggtgatttaagtcacatccatcggctacaaaatctgacaatagacattttagtctacgataaccatgttcatgtggcaagatctctgaaggttggaagctttcttagaatctatagccttcataccaaacttcaatcaatgaattcagagaatcagacaatgttaagtttagagtttcatcttcatggaggtaccagttacggtcggggaatcagggtcttgccagaaagtaactctgatgtggatcaactgaaaaaggatttagaatctgcaaatttgacagccaatcagcattcagatgttatctgtcaatcagaacctgacgacagctttccaaatggagtctcgcttcgtcctccaggctggagttcagtggcacggtctcggctcattgcagcctccacctcctgagttcaagcttctcctgcctcagcctcccaagtagctgggattacaggctctggatcagtatcattatacgaggtagaaagatgtcaacagctatctgctacaatacttacagatcatcagtatttggagaggacaccactatgtgccattttgaaacaaaaagctcctcaacaataccgcatccgagcaaaattgaggtcatataagcccagaagactatttcagtctgttaaacttcattgccctaaatgtcatttgctgcaagaagttccacatgagggcgatttggatataatttttcaggatggtgcaactaaaaccccagatgtcaagctacaaaatacatcattatatgattcaaaaatctggaccactaaaaatcaaaaaggacgaaaagtagcagttcattttgtgaaaaataatggtattctcccgctttcaaatgaatgtctacttttgatagaaggaggtacactcagtgaaatttgcaaactctcgaacaagtttaatagtgtaattcctgtgagatctggccacgaagacctggaacttttggacctttcagcaccatttcttatacaaggaacaatacatcactatggatgtaaacagtgttctagtttgagatccatacaaaatctaaattccctggttgataaaacatcgtggattccttcttctgtggcagaagcactgggtattgtacccctccaatatgtgtttgttatgacctttacacttgatgatggaacaggagtactagaagcctatctcatggattctgacaaattcttccagattccagcatcagaagttctgatggatgatgaccttcagaaaagtgtggatatgatcatggatatgttttgtcctccaggaataaaaattgatgcatatccgtggttggaatgcttcatcaagtcatacaatgtcacaaatggaacagataatcaaatttgctatcagatttttgacaccacagttgcagaagatgtaatctaa

SEQ ID NO: 3307 - DNA, 3950 bp, Homo sapiens
gtcagtatttcgccaaacctccaggcgccatcagtgtgtgaaccgttacgcagctggtccaccgcgggcggagaacaagcgactatgcccagggatcctgcacgcatgcgtggagctgaaccgtcagcgtgcgtgtgacgtcacctgcgcgcccgcctaaactcttcctagggttctttctagagtacggcagcaagttgtcagattccctagttgaatttgctttggacatcagtgtgaagcagaactgatatgccacttgaattaataaaggaagtcaatggggtgcctgaagttcagccgctgagtaaattacataaagtagatttcggatccctacagccaggttacaattatagcaagaaatatattcagggaaaactttcacttatctcttctttaacttatcgtggaaataaaacagctgttttgcagattggactacaaggacaccattgcagtggctagatttattgtttttttagcttcttcatctacaagcagagatggtaaaccttgcatatttttgaaagcatttgaagacctcaaatcaactgtttatgtttatgtcaaatctttaagagatttttctacagaatcaatgtctttggttccagcaacaaattatatatatacacccctgaatcaacttaagggtggtacaattgtcaatgtctatggtgttgtgaagttctttaagcccccatatctaagcaaaggaactgattcaagtatataaaaaggagactcagggtatcaccagctctggctttgcatctttgacgtttgagggaactttgggagcccctatcatacctcgcacttcaagcaagtattttaacttcactactgaggaccacaaaatggtagaagccttacgtgtttgggcatctactcatatgtcaccgtcttggacattactaaaattgtgtgatgttcagccaatgcagtattttgacctgacttgtcagctcttgggcaaagcagaagtggacggagcatcatttcttctaaaggtatgggatggcaccaggacaccatttccatcttggagagtcttaatacaagaccttgttcttgaaggtgatttaagtcacatccatcggctacaaaatctgacaatagacattttagtctacgataaccatgttcatgtggcaagatctctgaaggttggaagctttcttagaatctatagccttcataccaaacttcaatcaatgaattcagagaatcagacaatgttaagtttagagtttcatcttcatggaggtaccagttacggtcggggaatcagggtcttgccagaaagtaactctgatgtggatcaactgaaaaaggatttagaatctgcaaatttgacagccaatcagcattcagatgttatctgtcaatcagaacctgacgacagctttccaagctctggatcagtatcattatacgaggtagaaagatgtcaacagctatctgctacaatacttacagatcatcagtatttggagaggacaccactatgtgccattttgaaacaaaaagctcctcaacaataccgcatccgagcaaaattgaggtcatataagcccagaagactatttcagtctgttaaacttcattgccctaaatgtcatttgctgcaagaagttccacatgagggcgatttggatataatttttcaggatggtgcaactaaaaccccagatgtcaagctacaaaatacatcattatatgattcaaaaatctggaccactaaaaatcaaaaaggacgaaaagtagcagttcattttgtgaaaaataatggtattctcccgctttcaaatgaatgtctacttttgatagaaggaggtacactcagtgaaatttgcaaactctcgaacaagtttaatagtgtaattcctgtgagatctggccacgaagacctggaacttttggacctttcagcaccatttcttatacaaggaacaatacatcactatggatgtaaacagtgttctagtttgagatccatacaaaatctaaattccctggttgataaaacatcgtggattccttcttctgtggcagaagcactgggtattgtacccctccaatatgtgtttgttatgacctttacacttgatgatggaacaggagtactagaagcctatctcatggattctgacaaattcttccagattccagcatcagaagttctgatggatgatgaccttcagaaaagtgtggatatgatcatggatatgttttgtcctccaggaataaaaattgatgcatatccgtggttggaatgcttcatcaagtcatacaatgtcacaaatggaacagataatcaaatttgctatcagatttttgacaccacagttgcagaagatgtaatctaatattgccatccaatttagcatacataaaatgttgccactcaccttccctgtttgagcttcttttcctgacctgagttttgtatcagcaatgttgatgatgttagcatgggtatgggattagaaaatgtccttaccttaaatctcttggcttttactgggtgcaaggtaaataatggctatggattttgttttgctttctgttttgcttttgtacaaagagacctgcttaaacaagtactgctgagataagtgtctgatcaagctacagtgtactttaagtagaaatggcaaagttgctttgttggggtgctgatactgatgattttaggataaattcatttctttaaacttgtaatacatggttttattgcttgtttctctccaggatagtagagatttctctatttcacctcaacctaataaaagtggtcagatttataatgttaatgacttaatattatccttttctaatagtctcatgtaaaatatgccgctattacaacttacaactaattgaatgagatgttaacttagtaaaatagtttgatttttacctgacagtgtttgtcaaatttaaaatcatgaatattcaattttatacaaacatttatatatatatatatagatttgtgtatgttatttgccaaagacagatataaattacctggtttaatattagtgaagaataaataagtgcacacatttcaactgtttcatttatttgccctaagttgagctgaaaaatgatatgaggcaaagaatcgaaataggtgtggcaatgcagcagatgtttagggctgtctacatcccaggtactgtgctaagcactaaacatgtatttgatcctcacagcaacctatttttccgataagaaatctgaggcttgattgataagctgacttgactaagttcacacagtttgtaaaagctagagtctgtgccttaattcacataatctctattcagagcctgtactgttaaccactcaaggattctggaacagaagctaacagttttctgcaacgagtctttgacttaaacatctgaaataacattggaaatagattataagaggagtcagtgtgtttttctatagtttcaaaatacttttaacatcttattgtcaaaaagattggataactgactttctttgctcataataactctaaattctagttcctgagtacattaacacatcttctttacctaactaccaatgtcccccatcatcgacttatcagcttgtttgagacaatgagaaagactgattttattttcaagaatatagactcttggttcaaaacattttcaggaaaaatattttaaaaccctacagttgaacaggtgtgtttccgtgttgatgatgtgctcaggatacaaaggtgaaataaacattttttctgccttcaggaagccctcaatctagaagagtagaggtccaaaggtgccatatgttcacactgtgagcctgcaagatctccacgttaacaaaggaaaactcttcctatgaatcttcatgatgataggccatgtctcttcttatttttgttttaaataaacatccaccttatcatg

SEQ ID NO: 3308 - DNA, 2006 bp, Homo sapiens
tctctttctttagttccagcaacaaattatatatatacacccctgaatcaacttaagggtggtacaattgtcaatgtctatggtgttgtgaagttctttaagcccccatatctaagcaaaggaactgattattgctcagttgtaactattgtggaccagacaaatgtaaaactaacttgcctgctctttagtggaaactatgaagcccttccaataatttataaaaatggagatattgttcgctttcacaggctgaagattcaagtatataaaaaggagactcagggtatcaccagctctggctttgcatctttgacgtttgagggaactttgggagcccctatcatacctcgcacttcaagcaagtattttaacttcactactgaggaccacaaaatggtagaagccttacgtgtttgggcatctactcatatgtcaccgtcttggacattactaaaattgtgtgatgttcagccaatgcagtattttgacctgacttgtcagctcttgggcaaagcagaagtggacggagcatcatttcttctaaaggtatgggatggcaccaggacaccatttccatcttggagagtcttaatacaagaccttgttcttgaaggtgatttaagtcacatccatcggctacaaaatctgacaatagacattttagtctacgataaccatgttcatgtggcaagatctctgaaggttggaagctttcttagaatctatagccttcataccaaacttcaatcaatgaattcagagaatcagacaatgttaagtttagagtttcatcttcatggaggtaccagttacggtcggggaatcagggtcttgccagaaagtaactctgatgtggatcaactgaaaaaggatttagaatctgcaaatttgacagccaatcagcattcagatgttatctgtcaatcagaacctgacgacagctttccaagctctggatcagtatcattatacgaggtagaaagatgtcaacagctatctgctacaatacttacagatcatcagtatttggagaggacaccactatgtgccattttgaaacaaaaagctcctcaacaataccgcatccgagcaaaattgaggtcatataagcccagaagactatttcagtctgttaaacttcattgccctaaatgtcatttgctgcaagaagttccacatgagggcgatttggatataatttttcaggatggtgcaactaaaaccccagatgtcaagctacaaaatacatcattatatgattcaaaaatctggaccactaaaaatcaaaaaggacgaaaagtagcagttcattttgtgaaaaataatggtattctcccgctttcaaatgaatgtctacttttgatagaagttcttctgtaagctggatatatcccctttgtaaacagaagaggaaactgagaccaagagaaaatggtgaagtactcaaggttaaagacttaataaatggaggtacactcagtgaaatttgcaaactctcgaacaagtttaatagtgtaattcctgtgagatctggccacgaagacctggaacttttggacctttcagcaccatttcttatacaaggaacaatacatcactatggatgtaaacagtgttctagtttgagatccatacaaaatctaaattccctggttgataaaacatcgtggattccttcttctgtggcagaagcactgggtattgtacccctccaatatgtgtttgttatgacctttacacttgatgatggaacaggagtactagaagcctatctcatggattctgacaaattcttccagattccagcatcagaagttctgatggatgatgaccttcagaaaagtgtggatatgatcatggatatgttttgtcctccaggaataaaaattgatgcatatccgtggttggaatgcttcatcaagtcatacaatgtcacaaatggaacagataatcaaatttgctatcagatttttgacaccacagttgcagaagatgtaatctaa

SEQ ID NO: 3309 - DNA, 806 bp, Homo sapiens
gaaccgttacgcagctggtccaccgcgggcggagaacaagcgactatgcccagggatcctgcacgcatgcgtggagctgaaccgtcagcgtgcgtgtgacgtcacctgcgcgcccgcctaaactcttcctagggttctttctagagtacggcaagttgtcagattccctagttgaatttgctttggacatcagtgtgaagcagaactgatatgccacttgaattaataaaggaagtcaatggggtgcctgaagttcagccgctgagtaaattacataaagtagatttcggatccctacagccaggttacaattatagcaagaaatatattcagggaaaactttcacttatctcttctttaacttatcgtggaaataaaacagctgttttgcagattggactacaaggacaccattgcagtggctagatttattgtttttttagcttcttcatctacaagcagagatggtaaaccttgcatatttttgaaagcatttgaagacctcaaatcaactgtttatgtttatgtcaaatctttaagagatttttctacagaatcaatgtctttggttccagcaacaaattatatatatacacccctgaatcaacttaagggtggtacaattgtcaatgtctatggtgttgtgaagttctttaagcccccatatctaagcaaaggaactgattattgctcagttgtaactattgtggaccagacaaatgtaaaactaacttgcctgctctttagtggaaactatgaagcccttccaataatttataaaaatggagatattgttcgctttcaca

SEQ ID NO: 3310 - DNA, 1819 bp, Homo sapiens
tctctttctttagttccagcaacaaattatatatatacacccctgaatcaacttaagggtggtacaattgtcaatgtctatggtgttgtgaagttctttaagcccccatatctaagcaaaggaactgattattgctcagttgtaactattgtggaccagacaaatgtaaaactaacttgcctgctctttagtggaaactatgaagcccttccaataatttataaaaatggagatattgttcgctttcacaggctgaagattcaagtatataaaaaggagactcagggtatcaccagctctggctttgcatctttgacgtttgagggaactttgggagcccctatcatacctcgcacttcaagcaagtattttaacttcactactgaggaccacaaaatggtagaagccttacgtgtttgggcatctactcatatgtcaccgtcttggacattactaaaattgtgtgatgttcagccaatgcagtattttgacctgacttgtcagctcttgggcaaagcagaagtggacggagcatcatttcttctaaaggtatgggatggcaccaggacaccatttccatcttggagagtcttaatacaagaccttgttcttgaaggtgatttaagtcacatccatcggctacaaaatctgacaatagacattttagtctacgataaccatgttcatgtggcaagatctctgaaggttggaagctttcttagaatctatagccttcataccaaacttcaatcaatgaattcagagaatcagacaatgttaagtttagagtttcatcttcatggaggtaccagttacggtcggggaatcagggtcttgccagaaagtaactctgatgtggatcaactgaaaaaggatttagaatctgcaaatttgacagccaatcagcattcagatgttatctgtcaatcagaacctgacgacagctttccaagctctggatcagtatcattatacgaggtagaaagatgtcaacagctatctgctacaatacttacagatcatcagtatttggagaggacaccactatgtgccattttgaaacaaaaagctcctcaacaataccgcatccgagcaaaattgaggtcatataagcccagaagactatttcagtctgttaaacttcattgccctaaatgtcatttgctgcaagaagttccacatgagggcgatttggatataatttttcaggatggtgcaactaaaaccccagatgtcaagctacaaaatacatcattatatgattcaaaaatctggaccactaaaaatcaaaaaggacgaaaagtagcagttcattttgtgaaaaataatggtattctcccgctttcaaatgaatgtctacttttgatagaaggaggtacactcagtgaaatttgcaaactctcgaacaagtttaatagtgtaattcctgtgagatctggccacgaagacctggaacttttggacctttcagcaccatttcttatacaaggaacaatacatcactatggcactgggtattgtacccctccaatatgtgtttgttatgacctttacacttgatgatggaacaggagtactagaagcctatctcatggattctgacaaattcttccagattccagcatcagaagttctgatggatgatgaccttcagaaaagtgtggatatgatcatggatatgttttgtcctccaggaataaaaattgatgcatatccgtggttggaatgcttcatcaagtcatacaatgtcacaaatggaacagataatcaaatttgctatcagatttttgacaccacagttgcagaagatgtaatctaa

SEQ ID NO: 3311 - DNA, 5675 bp, Homo sapiens
tcacctgaggaccccaggagcaagcacaagttcaaaatccacacttacggaagccccaccttctgcgatcactgtgggtcactgctctatggacttatccatcaagggatgaaatgtgacacctgcgatatgaacgttcacaagcaatgcgtcatcaatgtccccagcctctgcggaatggatcacactgagaagagggggcggatttacctaaaggctgaggttgctgatgaaaagctccatgtcacagtacgagatgcaaaaaatctaatccctatggatccaaacgggctttcagatccttatgtgaagctgaaacttattcctgatcccaagaatgaaagcaagcaaaaaaccaaaaccatccgctccacactaaatccgcagtggaatgagtcctttacattcaaattgaaaccttcagacaaagaccgacgactgtctgtagaaatctgggactgggatcgaacaacaaggaatgacttcatgggatccctttcctttggagtttcggagctgatgaagatgccggccagtggatggtacaagttgcttaaccaagaagaaggtgagtactacaacgtacccattccggaaggggacgaggaaggaaacatggaactcaggcagaaattcgagaaagccaaacttggccctgctggcaacaaagtcatcagtccctctgaagacaggaaacaaccttccaacaaccttgaccgagtgaaactcacggacttcaatttcctcatggtgttgggaaaggggagttttggaaaggtgatgcttgccgacaggaagggcacagaagaactgtatgcaatcaaaatcctgaagaaggatgtggtgattcaggatgatgacgtggagtgcaccatggtagaaaagcgagtcttggccctgcttgacaaacccccgttcttgacgcagctgcactcctgcttccagacagtggatcggctgtacttcgtcatggaatatgtcaacggtggggacctcatgtaccacattcagcaagtaggaaaatttaaggaaccacaagcagtattctatgcggcagagatttccatcggattgttctttcttcataaaagaggaatcatttatagggatctgaagttagataacgtcatgttggattcagaaggacatatcaaaattgctgactttgggatgtgcaaggaacacatgatggatggagtcacgaccaggaccttctgtgggactccagattatatcgccccagagataatcgcttatcagccgtatggaaaatctgtggactggtgggcctatggcgtcctgttgtatgaaatgcttgccgggcaggtaatgttttgctacattttcatgtttgtttattgctgtgttatgtgaatacttcagctctggttgggcctcgagagcaagacctgacgttttagtgcagctggtgttggcgtgacttccctgacccaggcgaaagagggagaaacgcccccttcaaagtggatcacgttcagtatgcacagaaattatctctggtcatagaaactccaaattgaaagctacaacctggagtgtagacagtgtcagtttcacgttatgaaatgtacatgttggccaggcgcggtggctcatggctataatcccagcactttcagaagccaaggcaggcggatcgcctgaggtcaggagttcgagaccaccctggccaacatggcgaaaccccatctctactaaaaatacaaaaattagccaggcgtggtggtgcacatctgtaaactcagctacttgagctactgaggcatgagaattgcttaagcctgagaggcggaggctgcagtgagccaagatcgtgccactgcactgcagcctgggcaacagagtgagacggtctcaaaaaagaaaaaaatgtgcacgttgatgacagcagtggcctctaagttttcagtatcttaaaactggggttgggttatatggttccctgcaagtttgtctgcaaagattgccccagctgctgccaatgtgtgtaattagtattattatttaaggaagaagacagttaccttgaagaagtgttttaatagtttctccccatctcctcctatctcacccttggcaattcgttgtaattttcactgaagtccagtgaggctgaacatccagttaaggaaggtaaattagctttctcttatgatgtgacatgtaccagataaccatgtgccttattgcctaacatggcactttctaatataatggccttaatatctgtgtcatcagggtgaatcgtactatctgccacttctaggcctggcccctaagacatcctttatgactgtcctcatgctctaggctgaaattaggaggaattagtggagaaatctgagaccctacaagatggtggggcactgacccacaggttcattcaaggacacaggtttctcctgtccgtcagccctactaccttttagggtctcagatttctccgctaattcctcctcctttcagccgagcacagatcagttacataggatatcttaggggccggcctagaaatggcatgtatcacttctgcctaggttccactggccacttggccccagtgggacacaaagaggcaggaagtatagcatatctgagagctcagcaggggaagcaggcttggtaatcacgaagcaggcttggtaatcacccagcagatctctgccttatactaaacatgattctgccgtgggcagctttttataattcccagcactcacatgctagtgccaagacctgtgactctccatagccagaagccttagtcagagacaatggaaagagatggccatgctgtgcgacagagccacccccaaagacatctttgtttctggggaaaaagtcttcccttcccacatgttacgtccattgactcatttattcattcactcaccacgtatttattcactgaatgcttacaatgtgcatggccataaggatgaacaaaacagacgagaatccttaacttcgtgaagcttacagcttagaggaggagagacagcagacaggttagataaggaaaatgtataacacagcagaggtaagctaggaagaaaagtaataaagcaggaaagaagatagtgttgggggaggttgaaattggccagagaggataaggttaagacctaaaggaagtatggggttgtctgtgtgcatatctgttgaaagggcattccaggcagagggagccaccacgcgaaggccctaaggccagggaatgtgcagccacgtttaagaaatggaagctcccagcagggctagagcagaattgagctagagagggagggagtaggaggcctgaggccagagaggaagaggctctggatcctgttgttagcagtggtgcatccccatgaggctgcagcaacctcagttcttgcctcctcagaagaaagaatttgactgtggggcatcaggtagagtgagagcctaagacaagctgtttctgttttgttttgttttgtttttgagatggagttttgctctgttgcccaggctggagtcggtggcgcgatctcagctcactgcaccctccgcctcccaggttcaagcaattttctgcctcagcctccttagtagctgggattacaggcacctgccaacacgcttggctaatttttgtatttttagtaaagacggggtttcaccatcttggccaggctggtcctgagctcctgacctcgtgatccacccgcctcagcctcccaaagtgctgggattacaggcatgagccactgcacctggcctaagacaagttttagagaggaatgaaagttcatggaaaagctttcaagcaggagcaaaaggaagtaaagtacacttggaagagggccaagccggcgacttgagagatctagtgcactctttgacttttgacttggggttttatgcattggtgttcttccagggtcttacatctcttctcccctgattcttcccttgggttgggctgtctgcgtgcgcagtggcctgctagtgcttgggaggggcggcatgtgcagtgtgtttactggagttacgtgtgtgctcagctgaggcattcttcccttaccagtcagatgtcctagaaggtggtgtaccagttaaactccgccatgttgccttttcatgcgcgtgcttgagcccactcgcccaactcctgaaatcttattgggaagctgctgctcaccagtttcaggtgtttccctttattgggagactgcctttccttggtgctggctgcgaccaattattattttacagagagagagttaaccacctgatggtcgcctgacattcctggtgggtagggggagccctctcctgccctgcccatgtccgaacagccacctgttgtaacactgtgaccatgaacgtcatctccagatcagcggctttgcctctaggatgggaggctgtggatgatctctcctttatgtgtctttcattatatttcctaaatactgaaatggtcttgtagacattgaaagacataaagctttagcctgcatttgatcattatttctcaatggtgttaaggcttgactgacatcaaaagagtggtttattatttatttagttcccctccccccaccccaaatcaaagcattcctcttaggccaaatacgtccgggtgtaaacacagaaaggcagttcgtacacagtcaccatcagtgagtcaatggctggagaaacaggagttgtctgctcctcaagttaatttccccctctttaaaatttttacagtaaaattcggctctgaattacaggccccctaagagtcctgcttttcatgaagtcacaaaaagccaagtccccctcttgatcccacttgaatgttcagctcttgagtctggaaaacaaaccctgctttcattaagagtcacatttgcatatgctaacatgcaaaaggggctgggcggaaacgaagccaggatctgtttccgagggcgctttacaagaggtcacgtgagtagactcttggccagcaggagacaagaatttcagaacccaggtctgcaggaaagtcctcctccctcccgcagcctggcttctcccctctccaagccttcctgggatctcattcactaggggagaactcagggaatgctttcttctggcagagaagtcccctttggggggtgcattttgaagctctgccacactggcctcagacctcatttgcaaattggcctgaggtgatttacaggccttatttaaaggtttccctactaagctcacgccccctggagagcaccaggctccagctctcaatagttctgcaaactttctggcctgtttccaatatttcccacactgcttctcagagccacttagcctgccttatatgcatactttcaggtctccatcatctctattaaaaacggtgatggctgggcccggtggctcacacctgtaatcccagcacttcgggaggccgaggcgggcggatcacgaggtcaggagattgagaccatcctggctaacacagtgaaaccccatctctactaaaaatgcaaaaaaaaattagccgagtgtggtggcgggcgcctgtagtcccagctactcgggaggctgaggcaggagaatggcgtgaacccgggaggcggagcttgcagtgagccgagatcgcgccactgcactgcagcctgggcgacagagcgagactccatctc

SEQ ID NO: 3312 - DNA, 3004 bp, Homo sapiens
gaggcaagaggtggttgggggggaccatggctgacgttttcccgggcaacgactccacggcgtctcaggacgtggccaaccgcttcgcccgcaaaggggcgctgaggcagaagaacgtgcacgaggtgaaggaccacaaattcatcgcgcgcttcttcaagcagcccaccttctgcagccactgcaccgacttcatctgggggtttgggaaacaaggcttccagtgccaagtttgctgttttgtggtccacaagaggtgccatgaatttgttactttttcttgtccgggtgcggataagggacccgacactgatgaccccaggagcaagcacaagttcaaaatccacacttacggaagccccaccttctgcgatcactgtgggtcactgctctatggacttatccatcaagggatgaaatgtgacacctgcgatatgaacgttcacaagcaatgcgtcatcaatgtccccagcctctgcggaatggatcacactgagaagagggggcggatttacctaaaggctgaggttgctgatgaaaagctccatgtcacagtacgagatgcaaaaaatctaatccctatggatccaaacgggctttcagatccttatgtgaagctgaaacttattcctgatcccaagaatgaaagcaagcaaaaaaccaaaaccatccgctccacactaaatccgcagtggaatgagtcctttacattcaaattgaaaccttcagacaaagaccgacgactgtctgtagaaatctgggactgggatcgaacaacaaggaatgacttcatgggatccctttcctttggagtttcggagctgatgaagatgccggccagtggatggtacaagttgcttaaccaagaagaaggtgagtactacaacgtacccattccggaaggggacgaggaaggaaacatggaactcaggcagaaattcgagaaagccaaacttggccctgctggcaacaaagtcatcagtccctctgaagacaggaaacaaccttccaacaaccttgaccgagtgaaactcacggacttcaatttcctcatggtgttgggaaaggggagttttggaaaggtgatgcttgccgacaggaagggcacagaagaactgtatgcaatcaaaatcctgaagaaggatgtggtgattcaggatgatgacgtggagtgcaccatggtagaaaagcgagtcttggccctgcttgacaaacccccgttcttgacgcagctgcactcctgcttccagacagtggatcggctgtacttcgtcatggaatatgtcaacggtggggacctcatgtaccacattcagcaagtaggaaaatttaaggaaccacaagcagtattctatgcggcagagatttccatcggattgttctttcttcataaaagaggaatcatttatagggatctgaagttagataacgtcatgttggattcagaaggacatatcaaaattgctgactttgggatgtgcaaggaacacatgatggatggagtcacgaccaggaccttctgtgggactccagattatatcgccccagagataatcgcttatcagccgtatggaaaatctgtggactggtgggcctatggcgtcctgttgtatgaaatgcttgccgggcagcctccatttgatggtgaagatgaagacgagctatttcagtctatcatggagcacaacgtttcctatccaaaatccttgtccaaggaggctgtttctgtctgcaaaggactgatgaccaaacacccagccaagcggctgggctgtgggcctgagggggagagggacgtgagagagcatgccttcttccggaggatcgactgggaaaaactggagaacagggagatccagccaccattcaagcccaaagtgtgtggcaaaggagcagagaactttgacaagttcttcacacgaggacagcccgtcttaacaccacctgatcagctggttattgctaacatagaccagtctgattttgaagggttctcgtatgtcaacccccagtttgtgcaccccatcttacagagtgcagtatgaaactcaccagcgagaacaaacacctccccagcccccagccctccccgcagtgggaagtgaatccttaaccctaaaattttaaggccacggccttgtgtctgattccatatggaggcctgaaaattgtagggttattagtccaaatgtgatcaactgttcagggtctctctcttacaaccaagaacattatcttagtggaagatggtacgtcatgctcagtgtccagtttaattctgtagaagttacgtctggctctaggttaacccttcctagaaagcaagcagactgttgccccattttgggtacaatttgatatactttccataccctccatctgtggatttttcagcattggaatcccccaaccagagatgttaaagtgagcctgtcccaggaaacatctccacccaagacgtctttggaatccaagaacaggaagccaagagagtgagcagggagggattgggggtgggggaggcctcaaaataccgactgcgtccattctctgcctccatggaaacagcccctagaatctgaaaggccgggataaacctaatcactgttcccaaacattgacaaatcctaacccaaccatggtccagcagttaccagtttaaacaaaaaaacctcagatgagtgttgggtgaatctgtcatctggtaccctccttggttgataactgtcttgatacttttcattctttgtaagaggccaaatcgtctaaggacgttgctgaacaagcgtgtgaaatcatttcagatcaaggataagccagtgtgtacatatgttcattttaatctctgggagattatttttccatccagggtgccatcagtaatcatgccactactcaccagtgttgttcaccaacacccacccccacacacaccaacattttgctgcctaccttgttatccttctcaagaagctgaagtgtacgccctctccccttttgtgct

SEQ ID NO: 3313 - DNA, 7969 bp, Homo sapiens
gcgcgccgcggccgccagagccggcgcaggggaagcgcccgcggccccgggtgcagcagcggccgccgcctcccgcgcctccccggcccgcagcccgcggtcccgcggccccggggccggcacctctcgggctccggctccccgcgcgcaagatggctgacccggctgcggggccgccgccgagcgagggcgaggagagcaccgtgcgcttcgcccgcaaaggcgccctccggcagaagaacgtgcatgaggtcaagaaccacaaattcaccgcccgcttcttcaagcagcccaccttctgcagccactgcaccgacttcatctggggcttcgggaagcagggattccagtgccaagtttgctgctttgtggtgcacaagcggtgccatgaatttgtcacattctcctgccctggcgctgacaagggtccagcctccgatgacccccgcagcaaacacaagtttaagatccacacgtactccagccccacgttttgtgaccactgtgggtcactgctgtatggactcatccaccaggggatgaaatgtgacacctgcatgatgaatgtgcacaagcgctgcgtgatgaatgttcccagcctgtgtggcacggaccacacggagcgccgcggccgcatctacatccaggcccacatcgacagggacgtcctcattgtcctcgtaagagatgctaaaaaccttgtacctatggaccccaatggcctgtcagatccctacgtaaaactgaaactgattcccgatcccaaaagtgagagcaaacagaagaccaaaaccatcaaatgctccctcaaccctgagtggaatgagacatttagatttcagctgaaagaatcggacaaagacagaagactgtcagtagagatttgggattgggatttgaccagcaggaatgacttcatgggatctttgtcctttgggatttctgaacttcagaaagccagtgttgatggctggtttaagttactgagccaggaggaaggcgagtacttcaatgtgcctgtgccaccagaaggaagtgaggccaatgaagaactgcggcagaaatttgagagggccaagatcagtcagggaaccaaggtcccggaagaaaagacgaccaacactgtctccaaatttgacaacaatggcaacagagaccggatgaaactgaccgattttaacttcctaatggtgctggggaaaggcagctttggcaaggtcatgctttcagaacgaaaaggcacagatgagctctatgctgtgaagatcctgaagaaggacgttgtgatccaagatgatgacgtggagtgcactatggtggagaagcgggtgttggccctgcctgggaagccgcccttcctgacccagctccactcctgcttccagaccatggaccgcctgtactttgtgatggagtacgtgaatgggggcgacctcatgtatcacatccagcaagtcggccggttcaaggagccccatgctgtattttacgctgcagaaattgccatcggtctgttcttcttacagagtaagggcatcatttaccgtgacctaaaacttgacaacgtgatgctcgattctgagggacacatcaagattgccgattttggcatgtgtaaggaaaacatctgggatggggtgacaaccaagacattctgtggcactccagactacatcgcccccgagataattgcttatcagccctatgggaagtccgtggattggtgggcatttggagtcctgctgtatgaaatgttggctgggcaggcaccctttgaaggggaggatgaagatgaactcttccaatccatcatggaacacaacgtagcctatcccaagtctatgtccaaggaagctgtggccatctgcaaagggctgatgaccaaacacccaggcaaacgtctgggttgtggacctgaaggcgaacgtgatatcaaagagcatgcatttttccggtatattgattgggagaaacttgaacgcaaagagatccagcccccttataagccaaaagcttgtgggcgaaatgctgaaaacttcgaccgatttttcacccgccatccaccagtcctaacacctcccgaccaggaagtcatcaggaatattgaccaatcagaattcgaaggattttcctttgttaactctgaatttttaaaacccgaagtcaagagctaagtagatgtgtagatctccgtccttcatttctgtcattcaagctcaacggctattgtggtgacatttttatgtttttcattgccaagttgcatccatgtttgattttctgatgagactagagtgacagtgtttcagaacccaaatgtcctcaggtagtttggagcatctctatgagatgggattatgcagatggcctatggaaaatgcagctgcataattaacacattatcaaagtcctcttacaatttattttccgcagcatgtcagctaagtagacccaatggggagagaaaatgcctgctttctttccctctttttctgcactgccatattcacccccaaccatccaatctgtggataattggatgttagcggtactcttccacttccgggcctggagcttggcttgtatccaagtgtatggttgctttgcctaagaggaatccctctatttcacctgttctggaggcaccagaccttgaaaagaacatgctcaaaataaaatgttatctgttatttttgtaaactcaaagttaagatgatcaaagttctaaaattccaagaatgtgcttttagacggtctcaatctaaaagcacttcaaggggtcaaagggcaaccagcttgggtgctacctcagtgttgtagtttctgatactttatgtctttgctcaccctcatccccaaactacttgaaaagggcatttggcaccactctctgaaacaacacagtcactctagcaaggcccccaaagggccctggttttacattacatttcaaactttatttgctttggggttttgtttctgttgttgttcaaatgcaaaaaaaagaaaaaaaaagaaaaaaaaaggtgactcacattgttacacatgctttaaaatatgtattcaaatgttattaaccacaatgacgacctgctttgatttaaccaagaagacggctgcggagcctagcagactcaggcctgtgggaatgggatttgttacaaatctaggtttgttactggcttcagaaagctaattaagtgctctgaaaaagacaccgtttcttgaaacaaagatggttgtattcctcactttgatgttgttttgcaagatgtttgtggaaatgttcatttgtatctggatctctgttatgtgccatttttcttctagcatcgagatacaataaaaaaaaaaaaaaagaaaagaagaagaaatactatttcaaggaaaactgctctttttgagaaacgtggacctaaactacaaagtgggaactgaggagggaactcaggagaaaggaactaactgcggagctttaatcttggccccagtgttcagccactcggaggggcgggggctgtggcccattcaggggctgctggtgggctgtagtggggtgggatgacctggccagagccaacgaggatactggagcccaaagtcaagtttagagaccagctgggaacgtgaatggggctcttgattttcttatcaaaatcaccactcctcccagcttggactaaatattctttctagcaagcagctttgtgagctccctgaagcccaaggaaacccttcggtgggagaaatttcatttctgtctgagaggattaaggcagcaggtgactccccctcctcgcctgccgtgtcctgctattctcaggcagctctaaggagaattcttatcacagttcaagtgatttccagaagttccagggcttctgagagaccatcaagggaactttaacaacttgacaaatgtccttgaagtaagatgcctcatctttagggaaaaatggggtttggatttctgcttaggcaaagtctcctgcagttcatccttctctgtcctcttcttgcttcaggcttggggaccgtccctgctgtccccactgtggtggcaatcaggacctaaggtgaagcaaacttgaagttctatctgacaagtttaggcagtaagagaaggagggaaatcggagcaaagctccctcactttattgttgagaaactggcatctggaaagaggaaggaatttgcccaaagtcagtcagctgggataaaaacctgggtgtcctgtccagaaagtgcagggtgctttctgctctgtagcaaggcagcagacatctctgagccaggcccaccaacaggcccttatctggtggttggatcatgatcccattttgcttggacatgctctcaggaagataaaaaccatggagaaacactaggccattgacaaatgatctgagacaactttagaaaacaatgtaggatgaatggaaagagaaagaaaggaaagaaagaagaaaaagaaagaaggaaagaaagaaagagaaaggaaggaaggaaagaaggaaggaaaagaaggaaggaaggaaggaatatagtgttataaatactgcactcaacattttccaaattcttgccattatttttcaaaagtttaatagtttgcagaaatagatactcaagccaaagtctgttttagagaaactttccatggaaagtcagaatttctaccacttccttttctatccacatttccagtgcagaagaaactgagaaacagagctttttgaagagaggacagggccatagcaacaaggaccttcttgggggattaatgggaggtcagtagaattaataaccctccttggatgagtgctactgttttcacatggcttcagatgctatcaacctcaaagaaatgatctcaacagagaagcttattctctcccaacttctacggtaaaatccaggagtattttctctggggatctgcccacaggacaaagtccataaaagcaagtcctgtctggaccatgtggttatctgaagcattagccatcaccagcacaacaaacggggcagggctttccaaggtggggctggtcagaagggaatctttgataagaggcccacaggcagggaaagcgaaatagggttgatgagaccaggggagacctaaaaaaaaggcagctttgtgtcttctagctccaaatatacctgccttttagctcacacactgtcctggagttctcagacctttaggggccctaacacagttcagttcatacaggggttcaaaagggacagtggcccatttgggagacctttaggatcaatgggaatcaattccattgttttgcctcagagtaaagtttctggctcggggacaattataagttgcaaaaaggatagaggcatatcccaagtcttccttcattccacaaataattacaaacaacctactgtgtgccaggcactattcttagcactggaaatacactagtgaagaagcagatgaggaccctgtttattgtttctctccaagaaattctccaagaatattgtttcttggagagaaataataaataaacaagacaatttctgaaagcaataagtgcaatcaagataattaaaggatgctaaagtgtgacttgtggggattgggagagagatgcacagacaatattaaagaggaggcattcgagctttgttgtgaacaccggaagtaacatgccgagcgcctgggggatggaaactcctatagcaccccacaggctaacagcaagcaggacaagacaaaaagggcaggtgggacatggtagagatggaccctacccaggaaacagctccatcagcatcttagcctgccccactctagccacacatacccacgtgtgctcctgagttcagtgtgcccacctcactcccacaccctcacatagacttggcaagagtaaggagggaactccatagagacattttacctatctcaggggagcagccacaaagaagcaagtcttgtaaaaggtcttttgcaaaggagagtgaacccagcaatgagagatccttaacagctagtgcccattagggggctaaacctaaagcctgggtggtgatggctcaaacgctaatgagtcagtgaatccttaccgaccccctggcctttataatctgaggcaactttggctgcagcccgggaatgtgcagggcactagggaatacaaggccttcttccctggttgtcttgtaataaaacagccatggggttgtccctccagtccgagagactgtgatgaggcctacatagcagcgatgtggtcaggtaaaaatcaggaacccactgaaatcttgggcaagccaccctgcctgcttgtgcctcggttctctcatatgtcatatataggaggtgaggactccagctccacctgccccaggtgggtgtggtgatgatgaggaaagacaagaggcttgcaaggaccctgaagaggtcggagcatcatacagattcctttattagcccacattctgatgttccctggtgagacttgccccaagcaattgctagtaaatgggggttaatttcttctccacctccctactgaacaaaaaaagaaatgccagacttactaggagaatcgagttgctttgagtttcttttgttttgttttgttttgttttgttttaaggctccccttacacaccctcctttaagctttgggttttctctcttatagtttgttgacacatgctaaaaatgtctttggagagaacttctgcctgataaacacccaattctagactgtgggtggattttcgagctgacggtggtcaattcctttcattaagcagtgatctgatttctccacatggccattctgccttcttgggggcagagtagatgggcagcagttcaccttttcagagaaagaggtcttctagccacctgggctgctactgaatggttttctccaggacgctctacctaatgattatttctataacattaagcatggtaataagtagcttccaattcaattcatcctaaagccaaagaaaatacagcaacacacacacacacacacacacacacacacacacacacacacacacaccactttatggcaattcttaactgacattcaatgacttacttcttttcttagaaaatttccaccacatttctatccccaagccaacatacaatgtgaaatgaaagccagtgcgtggagtgcagctgctaaaaattttcagcacagggctctttctgactctgctcatgagatggtatcagccacccaatgactggcgtatcttggtcctgtgtctttcttcttacgctgtgttaatgtgtttactttccatttggcagagagacaagagagacacctccaacttcgacaaagagttcaccagacagcctgtggaactgacccccactgataaactcttcatcatgaacttggaccaaaatgaatttgctggcttctcttatactaacccagagtttgtcattaatgtgtaggtgaatgcaaactccatcgttgagcctggggtgtaagacttcaagccaagcgtatgtatcaattctagtcttccaggattcacggtgcacatgctggcattcaacatgtggaaagcttgtcttagagggcttttctttgtatgtgtagcttgctagtttgttttctacatttgaaaatgtttagtttagaataagcgcattatccaattatagaggtacaattttccaaacttccagaaactcatcaaatgaacagacaatgtcaaaactactgtgtctgataccaaaatgcttcagtatttgtaatttttcaagtcagaagctgatgttcctggtaaaagtttttacagttattctataatatcttctttgaatgctaagcatgagcgatatttttaaaaattgtgagtaagctttgcagttactgtgaactattgtctcttggaggaagttttttgtttaagaattgatatgattaaactgaattaatatatgcaa

SEQ ID NO: 3314 - DNA, 2689 bp, Homo sapiens
gggcgagtgacagccccggctccgcgcgccgcggccgccagagccggcgcaggggaagcgcccgcggccccgggtgcagcagcggccgccgcctcccgcgcctccccggcccgcagcccgcggtcccgcggccccggggccggcacctctcgggctccggctccccgcgcgcaagatggctgacccggctgcggggccgccgccgagcgagggcgaggagagcaccgtgcgcttcgcccgcaaaggcgccctccggcagaagaacgtgcatgaggtcaagaaccacaaattcaccgcccgcttcttcaagcagcccaccttctgcagccactgcaccgacttcatctggggcttcgggaagcagggattccagtgccaagtttgctgctttgtggtgcacaagcggtgccatgaatttgtcacattctcctgccctggcgctgacaagggtccagcctccgatgacccccgcagcaaacacaagtttaagatccacacgtactccagccccacgttttgtgaccactgtgggtcactgctgtatggactcatccaccaggggatgaaatgtgacacctgcatgatgaatgtgcacaagcgctgcgtgatgaatgttcccagcctgtgtggcacggaccacacggagcgccgcggccgcatctacatccaggcccacatcgacagggacgtcctcattgtcctcgtaagagatgctaaaaaccttgtacctatggaccccaatggcctgtcagatccctacgtaaaactgaaactgattcccgatcccaaaagtgagagcaaacagaagaccaaaaccatcaaatgctccctcaaccctgagtggaatgagacatttagatttcagctgaaagaatcggacaaagacagaagactgtcagtagagatttgggattgggatttgaccagcaggaatgacttcatgggatctttgtcctttgggatttctgaacttcagaaagccagtgttgatggctggtttaagttactgagccaggaggaaggcgagtacttcaatgtgcctgtgccaccagaaggaagtgaggccaatgaagaactgcggcagaaatttgagagggccaagatcagtcagggaaccaaggtcccggaagaaaagacgaccaacactgtctccaaatttgacaacaatggcaacagagaccggatgaaactgaccgattttaacttcctaatggtgctggggaaaggcagctttggcaaggtcatgctttcagaacgaaaaggcacagatgagctctatgctgtgaagatcctgaagaaggacgttgtgatccaagatgatgacgtggagtgcactatggtggagaagcgggtgttggccctgcctgggaagccgcccttcctgacccagctccactcctgcttccagaccatggaccgcctgtactttgtgatggagtacgtgaatgggggcgacctcatgtatcacatccagcaagtcggccggttcaaggagccccatgctgtattttacgctgcagaaattgccatcggtctgttcttcttacagagtaagggcatcatttaccgtgacctaaaacttgacaacgtgatgctcgattctgagggacacatcaagattgccgattttggcatgtgtaaggaaaacatctgggatggggtgacaaccaagacattctgtggcactccagactacatcgcccccgagataattgcttatcagccctatgggaagtccgtggattggtgggcatttggagtcctgctgtatgaaatgttggctgggcaggcaccctttgaaggggaggatgaagatgaactcttccaatccatcatggaacacaacgtagcctatcccaagtctatgtccaaggaagctgtggccatctgcaaagggctgatgaccaaacacccaggcaaacgtctgggttgtggacctgaaggcgaacgtgatatcaaagagcatgcatttttccggtatattgattgggagaaacttgaacgcaaagagatccagcccccttataagccaaaagctagagacaagagagacacctccaacttcgacaaagagttcaccagacagcctgtggaactgacccccactgataaactcttcatcatgaacttggaccaaaatgaatttgctggcttctcttatactaacccagagtttgtcattaatgtgtaggtgaatgcaaactccatcgttgagcctggggtgtaagacttcaagccaagcgtatgtatcaattctagtcttccaggattcacggtgcacatgctggcattcaacatgtggaaagcttgtcttagagggcttttctttgtatgtgtagcttgctagtttgttttctacatttgaaaatgtttagtttagaataagcgcattatccaattatagaggtacaattttccaaacttccagaaactcatcaaatgaacagacaatgtcaaaactactgtgtctgataccaaaatgcttcagtatttgtaatttttcaagtcagaagctgatgttcctggtaaaagtttttacagttattctataatatcttctttgaatgctaagcatgagcgatatttttaaaaattgtgagtaagctttgcagttactgtgaactattgtctcttggaggaagttttttgtttaagaattgatatgattaaactgaattaatatatgcaa

SEQ ID NO: 3315 - DNA, 1174 bp, Homo sapiens
aagagaccccgctgccaacatccccacgccctcgcgccctcccgccgccccagaaggccaactccgcctgcctgagtcacagctggagctggggaggagccagggaaaggaggcccctgaccgtagtgcggccagcagttgcaggcagacggagcagagcggtcagggatcatgagggagagtgcgttggagcgggggcctgtgcccgaggcgccggcggggggtcccgtgcacgccgtgacggtggtgaccctgctggagaagctggcctccatgctggagactctgcgggagcggcagggaggcctggctcgaaggcagggaggcctggcagggtccgtgcgccgcatccagagcggcctgggcgctctgagtcgcagccacgacaccaccagcaacaccttggcgcagctgctggccaaggcggagcgcgtgagctcgcacgccaacgccgcccaagagcgcgcggtgcgccgcgcagcccaggtgcagcggctggaggccaaccacgggctgctggtggcgcgcgggaagctccacgttctgctcttcaaggaggagggtgaagtcccagccagcgctttccagaaggcaccagagcccttgggcccggcggaccagtccgagctgggcccagagcagctggaggccgaagttggagagagctcggacgaggagccggtggagtccagggcccagcggctgcggcgcaccggattgcagaaggtacagagcctccgaagggccctttcgggccggaaaggccctgcagcgccaccgcccaccccggtcaagccgcctcgccttgggcctggccggagcgctgaagcccagccggaagcccagcctgcgctggagcccacgctggagccagagcctccgcaggacaccgaggaagatcccgggagacctggggctgccgaagaagctctgctccaaatggagagtgtagcctgagggctggtgttgcctgcctcccctgtgcttgtgccttgtcccaaaataaatcctttcagaatgtagcactcacgccctaataaggagcgaatcctacatccaccaaggcgggcgctctggccctcccttccttaagcccagtcctgtgtcctctgaaagaggtgcagtcactcacacctgcttgcgctcaccatcaataaaagtaatttcacccgaa

SEQ ID NO: 3316 - DNA, 5650 bp, Homo sapiens
cagcccccgcggcttgcagcggagccgacagctcgtcttctcttctggaggtgcagctggtggtcggggggagagacttgctccaaacacggacatcccccagctctcccccctccctgttttccgttaggaacccggcgaggaaatacatgcactggctgagaatcgcccgcgccagggcgcaacgccacaaggtgtagggagtgtgcggggtggggcgaaaggggacccaagagtccctgtggctcggagtgccgggccgtcggttcttcattcctgccctcggggcagacggagtgaccccggcccccactccccgccccgaccatggtagtgttcaatggccttcttaagatcaaaatctgcgaggccgtgagcttgaagcccacagcctggtcgctgcgccatgcggtgggaccccggccgcagactttccttctcgacccctacattgccctcaatgtggacgactcgcgcatcggccaaacggccaccaagcagaagaccaacagcccggcctggcacgacgagttcgtcaccgatgtgtgcaacggacgcaagatcgagctggctgtctttcacgatgcccccataggctacgacgacttcgtggccaactgcaccatccagtttgaggagctgctgcagaacgggagccgccacttcgaggactggattgatctggagccagaaggaagagtgtatgtgatcatcgatctctcagggtcgtcgggtgaagcccctaaagacaatgaagagcgtgtgttcagggaacgcatgcggccgaggaagcggcagggggccgtcaggcgcagggtccatcaggtcaacggccacaagttcatggccacctatcttcggcagcccacctactgctcccattgcagagacttcatctggggtgtcataggaaagcagggataccagtgtcaagtctgcacctgcgtggtccacaagcggtgccacgagctcataatcacaaagtgtgctgggttaaagaagcaggagacccccgaccaggtgggctcccagcggttcagcgtcaacatgccccacaagttcggtatccacaactacaaggtccctaccttctgcgatcactgtgggtccctgctctggggactcttgcggcagggtttgcagtgtaaagtctgcaaaatgaatgttcaccgtcgatgtgagaccaacgtggctcccaactgtggagtggatgccagaggaatcgccaaagtactggccgacctgggcgttaccccagacaaaatcaccaacagcggccagagaaggaaaaagctcattgctggtgccgagtccccgcagcctgcttctggaagctcaccatctgaggaagatcgatccaagtcagcacccacctccccttgtgaccaggaaataaaagaacttgagaacaacattcggaaagccttgtcatttgacaaccgaggagaggagcaccgggcagcatcgtctcctgatggccagctgatgagccccggtgagaatggcgaagtccggcaaggccaggccaagcgcctgggcctggatgagttcaacttcatcaaggtgttgggcaaaggcagctttggcaaggtcatgttggcagaactcaagggcaaagatgaagtatatgctgtgaaggtcttaaagaaggacgtcatccttcaggatgatgacgtggactgcacaatgacagagaagaggattttggctctggcacggaaacacccgtaccttacccaactctactgctgcttccagaccaaggaccgcctctttttcgtcatggaatatgtaaatggtggagacctcatgtttcagattcagcgctcccgaaaattcgacgagcctcgttcacggttctatgctgcagaggtcacatcggccctcatgttcctccaccagcatggagtcatctacagggatttgaaactggacaacatccttctggatgcagaaggtcactgcaagctggctgacttcgggatgtgcaaggaagggattctgaatggtgtgacgaccaccacgttctgtgggactcctgactacatagctcctgagatcctgcaggagttggagtatggcccctccgtggactggtgggccctgggggtgctgatgtacgagatgatggctggacagcctccctttgaggccgacaatgaggacgacctatttgagtccatcctccatgacgacgtgctgtacccagtctggctcagcaaggaggctgtcagcatcttgaaagctttcatgacgaagaatccccacaagcgcctgggctgtgtggcatcgcagaatggcgaggacgccatcaagcagcacccattcttcaaagagattgactgggtgctcctggagcagaagaagatcaagccacccttcaaaccacgcattaaaaccaaaagagacgtcaataattttgaccaagactttacccgggaagagccggtactcacccttgtggacgaagcaattgtaaagcagatcaaccaggaggaattcaaaggtttctcctactttggtgaagacctgatgccctgagagcccactgcagttggactttgccgatgctgcaagaaggggtgcagagaagactcctgtgttggagacactcagcaggtcttgaactacttctcctcctcggagccccagtcccatgtccactgtctatttattgcattcccttgccccaggccacctcctccccctcccacctggtgaccagaaggcgctctcggttcttgtctcaccagtaatgcagactcattgggtcagcaattagctgtatacactgccgtgtttggaccattggcaagcctggttccactcctcaggggctcctggcagtgaagcaacttcagttcttttactgcaaagaacagaaaaaagaaagaaagcaaacaagaagactccggctctgctatcggacacagatcctgatccctcttgcttcttttccctcctgcaccgcagcttgccatccctgcccttctgtcctggagaagagactggtgcttctccgcacacacgagggagggcgcccttgaggcatgccctctgagggagggagaccagagatgcagggattggccagctgggttggtttgctctggaatggctaactcttgcctgctttggttttagcttttcagcatgccaaagtcatgtaagtttgtgtcttgtggaagaaatcctctttgtggaaaaagaaacagggttttgaactctgttaacatttgaaaaatatattttcaaattcactttctaattggccaaaagagatgagttccagtctgaatacaggtagatattaaagggctaataaaaaatgagaaaccggtcgtccaaggtggatgctgtcaatgcccgagtgacacatgagagctgtatgaattgagagaaaaggcaacaagtagcattcttcatcattcaagttctacctggacacaaaggcgaggaccctggggttccaacaaagctcagctcccagattctctttccagtttcatcctaagttcctagcataaacactatttattttctgcagcagtgtgttatttttgcgcacttatacaaaatggtagtactactgtgttgtggtttttaaacattaaacatgtaaagttatatacgaaatatctgcttttggaataagcagaatgaggctaaacatgggttatacaaagggtatctggaaactgaagagcaacttgttagaaaactgacaatgtcgcaagatgtactcagttttgtttctgtgtgacatgcaatggcaactcatgtggacactattgaagggatgtgacattacctcctgtagatatgctaacagtgttattctttcatttccaagggttctctgtggctttgtgtatatgtttcccagaggtcatttgattacctaatttactgaactgatttagcagggaatggaatccattccaactattgcacgtggatttcccagctgcccctaaatatatatacttgtgagtggcaaagtggcactaatgaagcttttgccttttgtacatttgagatttttgtatatagtgtttgctgcaaggcctgtggaattaattcgttgcatatagaggtatcaactgctgcatgttcaggcatattataaaactttagtctatgaaagaataattataataatgtccaggtgcaatactctgtaagtctattggttcaagttaccgagagataggtgtgttcctttatgggggatgggggggtgtgttggggattctttgtattgtttatttcattttggtttattttaaaagatgtaaacatatattaagctatattaaatctcacatacagttcttctgtgctctattataccctgatagagatgggggagagaaaggaatgtttttgatggtggtttcaaagctcggacagtaactatcttgagcccattagagagtctgtgtccatatttgcatctggctggtcatagcctttgttactaatgatgacattcagttctcttttgtttttattttttaaaaactcaggtgtaattattatctgttcttaagataattgcaaatattaaatattatgatatatcaattcatgtgtttggcataccagtgaatgatgaagaacatgagattaatttaatttatcttcggtaacttgacattctggagagagactatcttctggagttgagtacaagcacagaaacatctttacggtggcatcatctcattttttaggaagacatgataatactgcccatcatattcatgtgtaactactgttctttcttctgctttcttcaccataataaactttggacaaccaagcaagctctaaccgcaatgccagatggccttgtccgagggcctagtgtttgcacggcagtgggaactgggcctttcctacaggacaactggcaagtttgctgggaagtcaaataatacattccacctggcagctgaaggcagccagtcagtctgtcccagaaagggcccttttcagcacccaaagctgggctggctgggatgcctctggctggtgaagttctcacataggctgatttaaatccagcaaaggtctatagaaaaaggcttgcgtgttcgttgagtaatcattgtttcattttcatttttacgagagtttgaaaatagacacactgttaacacttctgccagttttttctgatctttccagccccaccccctttctctttctctctctctctcaaagaaaaaaaaaatgggagtgcaaaaaaaacaaagccaaaaaatatatgaaggatagctgttcttctgtgttctctcattatggactttgtgaagtagaaacataattttttttcctccaaaggtgaaaaaacaatgcattcttgctttaaaaaaaaaaaagaaggctaaaaaattacctctttttaaattatgtgcaaaataattctggctaactgtaaaatgtattcaattttaggattttttttttttgtattgtgatgctttatttgtacatttttttcctttctggatgtaattttaatctcttgccattcattagtgttatttcattgtaaacgttattgtgccaaatgtactgtattcaaaaggatgtgaatgtgtattgtttcagaacctaataaatacaatgacgttaagtctta

SEQ ID NO: 3317 - DNA, 939 bp, Homo sapiens
gcggccgcccggactccgagcccgcgcggatgtgagattccgggctcctggcgcctcccgatcgccggctccggcgcggcgctgcttcgcccaggaggcggcggccccggctggccgtggggcttgtggatttttaaaaatttggctccgaggaggaccatttcctctcgacatgcatccctccggatagactgaacatccctccgttcacccccccgccccgcgcggtcagaggcaggcgctgagtgtgcgaagaggatccgggttgaaatctgcgcccccggttctcgtccccgccccgtcccaccgccccatccccctcccggagtcgaaatttcccgggattatgtttcggaaaggaacccggcgaggaaatacatgcactggctgagaatcgcccgcgccagggcgcaacgccacaaggtgtagggagtgtgcggggtggggcgaaaggggacccaagagtccctgtggctcggagtgccgggccgtcggttcttcattcctgccctcggggcagacggagtgaccccggcccccactccccgccccgaccatggtagtgttcaatggccttcttaagatcaaaatctgcgaggccgtgagcttgaagcccacagcctggtcgctgcgccatgcggtgggaccccggccgcagactttccttctcgacccctacattgccctcaatgtggacgactcgcgcatcggccaaacggccaccaagcagaagaccaacagcccggcctggcacgacgagttcgtcaccgatgtgtgcaacggacgcaagatcgagctggctgtctttcacgatgcccccataggctacgacgacttcgtggccaactgcaccatccagtttgaggagctgctgcagaacgggagccgccacttcgaggactggattgatctggagccagaaggaagagtgtatgtgat

SEQ ID NO: 3318 - DNA, 3133 bp, Homo sapiens
cggagctggagctcccaccgccgccgcccgtgcctccggctgccggcgcccctgcctttggctcttcctccccactcgcccgctccccctggcggagccggcgcgcccggggtgccgctccctgcctggcgcgctccgcacctggaggtgccttgcccctctcctgcccacctcggaatttccctgtggctcctttgatccttcgagtctccagctcctctcccttccacctgtttcccccaagaaaggcaggatcctggtccctgctacgtttctggggccatggctggtctgggccccggcgtaggcgattcagaggggggaccccggcccctgttttgcagaaagggggccctgaggcagaaggtggtccacgaagtcaagagccacaagttcaccgctcgcttcttcaagcagcccaccttctgcagccactgcaccgacttcatctggggtatcggaaagcagggcctgcaatgtcaagtctgcagctttgtggttcatcgacgatgccacgaatttgtgaccttcgagtgtccaggcgctgggaagggcccccagacggacgacccccggaacaaacacaagttccgcctgcatagctacagcagccccaccttctgcgaccactgtggctccctcctctacgggcttgtgcaccagggcatgaaatgctcctgctgcgagatgaacgtgcaccggcgctgtgtgcgtagcgtgccctccctgtgcggtgtggaccacaccgagcgccgcgggcgcctgcagctggagatccgggctcccacagcagatgagatccacgtaactgttggcgaggcccgtaacctaattcctatggaccccaatggtctctctgatccctatgtgaaactgaagctcatcccagaccctcggaacctgacgaaacagaagacccgaacggtgaaagccacgctaaaccctgtgtggaatgagacctttgtgttcaacctgaagccaggggatgtggagcgccggctcagcgtggaggtgtgggactgggaccggacctcccgcaacgacttcatgggggccatgtcctttggcgtctcggagctgctcaaggcgcccgtggatggctggtacaagttactgaaccaggaggagggcgagtattacaatgtgccggtggccgatgctgacaactgcagcctcctccagaagtttgaggcttgtaactaccccctggaattgtatgagcgggtgcggatgggcccctcttcctctcccatcccctccccttcccctagtcccaccgaccccaagcgctgcttcttcggggcgagtccaggacgcctgcacatctccgacttcagcttcctcatggttctaggaaaaggcagttttgggaaggtgatgctggccgagcgcaggggctctgatgagctctacgccatcaagatcttgaaaaaggacgtgatcgtccaggacgacgatgtggactgcacgctggtggagaaacgtgtgctggcgctggggggccggggtcctggcggccggccccacttcctcacccagctccactccaccttccagaccccggaccgcctgtatttcgtgatggagtacgtcaccgggggagacttgatgtaccacattcaacagctgggcaagtttaaggagccccatgcagcgttctacgcggcagaaatcgctatcggcctcttcttccttcacaatcagggcatcatctacagggacctgaagctggacaatgtgatgctggatgctgagggacacatcaagatcactgactttggcatgtgtaaggagaacgtcttccccgggacgacaacccgcaccttctgcgggaccccggactacatagccccggagatcattgcctaccagccctatgggaagtctgtcgattggtggtcctttggagttctgctgtatgagatgttggcaggacagcctcccttcgatggggaggacgaggaggagctgtttcaggccatcatggaacaaactgtcacctaccccaagtcgctttcccgggaagccgtggccatctgcaaggggttcctgaccaagcacccagggaagcgcctgggctcagggcctgatggggaacctaccatccgtgcacatggctttttccgctggattgactgggagcggctggaacgattggagatcccgcctcctttcagaccccgcccgtgtggccgcagcggcgagaactttgacaagttcttcacgcgggcggcgccagcgctgacccctccagaccgcctagtcctggccagcatcgaccaggccgatttccagggcttcacctacgtgaaccccgacttcgtgcacccggatgcccgcagccccaccagcccagtgcctgtgcccgtcatgtaatctcacccgccgccactaggtgtccccaacgtcccctccgccgtgccggcggcagccccacttcacccccaacttcaccaccccctgtcccattctagatcctgcaccccagcattccagctctgcccccgcgggttctagacgcccctcccaagcgttcctggccttctgaactccatacagcctctacagccgtcccgcgttcaagacttgagcggagcccgatattctccctgaccttagcgttctggactctgccccaatcgggtccagagaccacaccactaaccatccccaactccatggggttcgagactccatcttggtagttctgtgcctccccccagaccccgcccctggggaaatagcctcacggggttggctgttccagactcaggttccagaacagccctcggcctccgaggctccccgcctccactctagttctagatgagtgggaggcgtgcccccctcctccagtacgtcccgctgctgtgctctggggatttctgggatatatggaggattctttccccagaggctcccaatcagcttttgttctagacttccccatcccgaagccatcacttctccccgcagcccgcctgccgtgcatggctcctgtctggctcggacccaccccaactctccccagtgcctgccactctctgggactctcctcctcccctcctcttcccttagcctctcccacccggccacagctgctggagaataaatttgggatgctgatgctgaa

SEQ ID NO: 3319 - DNA, 1404 bp, Homo sapiens
atttcagcaggtgccggagctggagctcccaccgccgccgcccgtgcctccggctgccggcgcccctgcctttggctcttcctccccactcgcccgctccccctggcggagccggcgcgcccggggtgccgctccctgcctggcgcgctccgcacctggaggtgccttgcccctctcctgcccacctcggaatttccctgtggctcctttgatccttcgagtctccagctcctctcccttccacctgtttcccccaagaaaggcaggatcctggtccctgctacgtttctggggccatggctggtctgggccccggcgtaggcgattcagaggggggaccccggcccctgttttgcagaaagggggccctgaggcagaaggtggtccacgaagtcaagagccacaagttcaccgctcgcttcttcaagcagcccaccttctgcagccactgcaccgacttcatctggggtatcggaaagcagggcctgcaatgtcaagtctgcagctttgtggttcatcgacgatgccacgaatttgtgaccttcgagtgtccaggcgctgggaagggcccccagacggacgacccccggaacaaacacaagttccgcctgcatagctacagcagccccaccttctgcgaccactgtggctccctcctctacgggcttgtgcaccagggcatgaaatgctcctgctgcgagatgaacgtgcaccggcgctgtgtgcgtagcgtgccctccctgtgcggtgtggaccacaccgagcgccgcgggcgcctgcagctggagatccgggctcccacagcagatgagatccacgtaactgttggcgaggcccgtaacctaattcctatggaccccaatggtctctctgatccctatgtgaaactgaagctcatcccagaccctcggaacctgacgaaacagaagacccgaacggtgaaagccacgctaaaccctgtgtggaatgagacctttgtgttcaacctgaagccaggggatgtggagcgccggctcagcgtggaggtgtgggactgggaccggacctcccgcaacgacttcatgggggccatgtcctttggcgtctcggagctgctcaaggcgcccgtggatggctggcttgtaactaccccctggaattgtatgagcgggtgcggatgggcccctcttcctctcccatcccctccccttcccctagtcccaccgaccccaagcgctgcttcttcggggcgagtccaggacgcctgcacatctccgacttcagcttcctcatggttctaggaaaaggcagttttgggaaggtgatgctggccgagcgcaggggctctgatgagctctacgccatcaagatcttgaaaaaggacgtgatcgtccaggacgacgatgtggactgcacgctggtgga

SEQ ID NO: 3320 - DNA, 2579 bp, Homo sapiens
tttcagcaggtgccggagctggagctcccaccgccgccgcccgtgcctccggctgccggcgcccctgcctttggctcttcctccccactcgcccgctccccctggcggagccggcgcgcccggggtgccgctccctgcctggcgcgctccgcacctggaggtgccttgcccctctcctgcccacctcggaatttccctgtggctcctttgatccttcgagtctccagctcctctcccttccacctgtttcccccaagaaaggcaggatcctggtccctgctacgtttctggggccatggctggtctgggccccggcgtaggcgattcagaggggggaccccggcccctgttttgcagaaagggggccctgaggcagaaggtggtccacgaagtcaagagccacaagttcaccgctcgcttcttcaagcagcccaccttctgcagccactgcaccgacttcatctggggtatcggaaagcagggcctgcaatgtcaagtctgcagctttgtggttcatcgacgatgccacgaatttgtgaccttcgagtgtccaggcgctgggaagggcccccagacggacgacccccggaacaaacacaagttccgcctgcatagctacagcagccccaccttctgcgaccactgtggctccctcctctacgggcttgtgcaccagggcatgaaatgctcctgctgcgagatgaacgtgcaccggcgctgtgtgcgtagcgtgccctccctgtgcggtgtggaccacaccgagcgccgcgggcgcctgcagctggagatccgggctcccacagcagatgagatccacgtaactgttggcgaggcccgtaacctaattcctatggaccccaatggtctctctgatccctatgtgaaactgaagctcatcccagaccctcggaacctgacgaaacagaagacccgaacggtgaaagccacgctaaaccctgtgtggaatgagacctttgtgttcaacctgaagccaggggatgtggagcgccggctcagcgtggaggtgtgggactgggaccggacctcccgcaacgacttcatgggggccatgtcctttggcgtctcggagctgctcaaggcgcccgtggatggctggtacaagttactgaaccaggaggagggcgagtattacaatgtgccggtggccgatgctgacaactgcagcctcctccagaagtttgaggcttgtaactaccccctggaattgtatgagcgggtgcggatgggcccctcttcctctcccatcccctccccttcccctagtcccaccgaccccaagcgctgcttcttcggggcgagtccaggacgcctgcacatctccgacttcagcttcctcatggttctaggaaaaggcagttttgggaaggtgatgctggccgagcgcaggggctctgatgagctctacgccatcaagatcttgaaaaaggacgtgatcgtccaggacgacgatgtggactgcacgctggtggagaaacgtgtgctggcgctggggggccggggtcctggcggccggccccacttcctcacccagctccactccaccttccagaccccggaccgcctgtatttcgtgatggagtacgtcaccgggggagacttgatgtaccacattcaacagctgggcaagtttaaggagccccatgcagcgttctacgcggcagaaatcgctatcggcctcttcttccttcacaatcagggcatcatctacagggacctgaagctggacaatgtgatgctggatgctgagggacacatcaagatcactgactttggcatgtgtaaggagaacgtcttccccgggacgacaacccgcaccttctgcgggaccccggactacatagccccggagatcattgcctaccagccctatgggaagtctgtcgattggtggtcctttggagttctgctgtatgagatgttggcaggacagcctcccttcgatggggaggacgaggaggagctgtttcaggccatcatggaacaaactgtcacctaccccaagtcgctttcccgggaagccgtggccatctgcaaggggttcctgaccaagcacccagggaagcgcctgggctcagggcctgatggggaacctaccatccgtgcacatggctttttccgctggattgactgggagcggctggaacgattggagatcccgcctcctttcagaccccgcccgtgtggccgcagcggcgagaactttgacaagttcttcacgcgggcggcgccagcgctgacccctccagaccgcctagtcctggccagcatcgaccaggccgatttccagggcttcacctacgtgaaccccgacttcgtgcacccggatgcccgcagccccaccagcccagtgcctgtgcccgtcatatcctgcaccccagcattccagctctgcccccgcgggttctagacgcccctcccaagcgttcctggccttctgaactccatacagcctctacagccgtcccgcgttcaagacttgagcggagcccgatattctccctgaccttagcgttctggactctgccccaatcgggtccagagaccacaccactaaccat

SEQ ID NO: 3321 - DNA, 1781 bp, Homo sapiens
cttgagcaccagctgctactgctgagaacagatctgcagctttgtggttcatcgacgatgccacgaatttgtgaccttcgagtgtccaggcgctgggaagggcccccagacggacgctgcgagatgaacgtgcaccggcgctgtgtgcgtagcgtgccctccctgtgcggtgtggaccacaccgagcgccgcgggcgcctgcagctggagatccgggctcccacagcagatgagatccacgtaactgttggcgaggcccgtaacctaattcctatggaccccaatggtctctctgatccctatgtgaaactgaagctcatcccagaccctcggaacctgacgaaacagaagacccgaacggtgaaagccacgctaaaccctgtgtggaatgagacctttgtgttcaacctgaagccaggggatgtggagcgccggctcagcgtggaggtgtgggactgggaccggacctcccgcaacgacttcatgggggccatgtcctttggcgtctcggagctgctcaaggcgcccgtggatggctggtacaagttactgaaccaggaggagggcgagtattacaatgtgccggtggccgatgctgacaactgcagcctcctccagaagtttgaggcttgtaactaccccctggaattgtatgagcgggtgcggatgggcccctcttcctctcccatcccctccccttcccctagtcccaccgaccccaagcgctgcttcttcggggcgagtccaggacgcctgcacatctccgacttcagcttcctcatggttctaggaaaaggcagttttgggaaggtgatgctggccgagcgcaggggctctgatgagctctacgccatcaagatcttgaaaaaggacgtgatcgtccaggacgacgatgtggactgcacgctggtggagaaacgtgtgctggcgctggggggccggggtcctggcggccggccccacttcctcacccagctccactccaccttccagaccccggaccgcctgtatttcgtgatggagtacgtcaccgggggagacttgatgtaccacattcaacagctgggcaagtttaaggagccccatgcagcgttctacgcggcagaaatcgctatcggcctcttcttccttcacaatcagggcatcatctacagggacctgaagctggacaatgtgatgctggatgctgagggacacatcaagatcactgactttggcatgtgtaaggagaacgtcttccccgggacgacaacccgcaccttctgcgggaccccggactacatagccccggagatcattgcctaccagccctatgggaagtctgtcgattggtggtcctttggagttctgctgtatgagatgttggcaggacagttcctgaccaagcacccagggaagcgcctgggctcagggcctgatggggaacctaccatccgtgcacatggctttttccgctggattgactgggagcggctggaacgattggagatcccgcctcctttcagaccccgcccgtgtggccgcagcggcgagaactttgacaagttcttcacgcgggcggcgccagcgctgacccctccagaccgcctagtcctggccagcatcgaccaggccgatttccagggcttcacctacgtgaaccccgacttcgtgcacccggatgcccgcagccccaccagcccagtgcctgtgcccgtcatgtaatctcacccgccgccactaggtgtccccaacgtcccctccgccgtgccggcggcagccccacttcacccccaacttca

SEQ ID NO: 3322 - DNA, 2326 bp, Homo sapiens
gccccgcgcgccgccggagttccgcggagttgaccgggtcggcgccgtcggtcctgagcgctgccttccgcgttccgccgcggccccacctggagcccccgccccgcgccatggccggagctcccggggcgcagcgctgacggcggcggggggagcgcgccatgcccagcaggaccggccccaagatggaagggagcggcggccgcgtccgcctcaaggcgcattacgggggggacatcttcatcaccagcgtggacgccgccacgaccttcgaggagctctgtgaggaagtgagagacatgtgtcgtctgcaccagcagcacccgctcaccctcaagtgggtggacagcgaaggtgacccttgcacggtgtcctcccagatggagctggaagaggctttccgcctggcccgtcagtgcagggatgaaggcctcatcattcatgttttcccgagcacccctgagcagcctggcctgccatgtccgggagaagacaaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaatttacgccatgaaagtggtgaagaaagagctggtgcatgatgacgaggatattgactgggtacagacagagaagcacgtgtttgagcaggcatccagcaaccccttcctggtcggattacactcctgcttccagacgacaagtcggttgttcctggtcattgagtacgtcaacggcggggacctgatgttccacatgcagaggcagaggaagctccctgaggagcacgccaggttctacgcggccgagatctgcatcgccctcaacttcctgcacgagagggggatcatctacagggacctgaagctggacaacgtcctcctggatgcggacgggcacatcaagctcacagactacggcatgtgcaaggaaggcctgggccctggtgacacaacgagcactttctgcggaaccccgaattacatcgcccccgaaatcctgcggggagaggagtacgggttcagcgtggactggtgggcgctgggagtcctcatgtttgagatgatggccgggcgctccccgttcgacatcatcaccgacaacccggacatgaacacagaggactaccttttccaagtgatcctggagaagcccatccggatcccccggttcctgtccgtcaaagcctcccatgttttaaaaggatttttaaataaggaccccaaagagaggctcggctgccggccacagactggattttctgacatcaagtcccacgcgttcttccgcagcatagactgggacttgctggagaagaagcaggcgctccctccattccagccacagatcacagacgactacggtctggacaactttgacacacagttcaccagcgagcccgtgcagctgaccccagacgatgaggatgccataaagaggatcgaccagtcagagttcgaaggctttgagtatatcaacccattattgctgtccaccgaggagtcggtgtgaggccgcgtgcgtctctgtcgtggacacgcgtgattgaccctttaactgtatccttaaccaccgcatatgcatgccaggctgggcacggctccgagggcggccagggacagacgcttgcgccgagaccgcagagggaagcgtcagcgggcgctgctgggagcagaacagtccctcacacctgggcccgggcaggccagcttcgtgctggaggaacttgctgctgtgcctgcgtcgcggcggatccgcggggaccctgccgagggggctgtcatgcggtttccaaggtgcacattttccacggaaacagaactcgatgcactgacctgctccgccaggaaagtgagcgtgtagcgtcctgaggaataaaatgttccgatgatgtggaa

SEQ ID NO: 3323 - DNA, 2009 bp, Homo sapiens
agaacatcgctcggtgccagacaggcaggacgcagcgggctggcctgcggggctcactgctgccccccggggccgagcacgaaagggagagttggagggcgcttcctcgccgggtgttgcggtgtgagcggggactggtgagtgtgtgctgtcttcagagagagaagagcagttttcaggaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaatttacgccatgaaagtggtgaagaaagagctggtgcatgatgacgaggatattgactgggtacagacagagaagcacgtgtttgagcaggcatccagcaaccccttcctggtcggattacactcctgcttccagacgacaagtcggttgttcctggtcattgagtacgtcaacggcggggacctgatgttccacatgcagaggcagaggaagctccctgaggagcacgccaggttctacgcggccgagatctgcatcgccctcaacttcctgcacgagagggggatcatctacagggacctgaagctggacaacgtcctcctggatgcggacgggcacatcaagctcacagactacggcatgtgcaaggaaggcctgggccctggtgacacaacgagcactttctgcggaaccccgaattacatcgcccccgaaatcctgcggggagaggagtacgggttcagcgtggactggtgggcgctgggagtcctcatgtttgagatgatggccgggcgctccccgttcgacatcatcaccgacaacccggacatgaacacagaggactaccttttccaagtgatcctggagaagcccatccggatcccccggttcctgtccgtcaaagcctcccatgttttaaaaggatttttaaataaggaccccaaagagaggctcggctgccggccacagactggattttctgacatcaagtcccacgcgttcttccgcagcatagactgggacttgctggagaagaagcaggcgctccctccattccagccacagatcacagacgactacggtctggacaactttgacacacagttcaccagcgagcccgtgcagctgaccccagacgatgaggatgccataaagaggatcgaccagtcagagttcgaaggctttgagtatatcaacccattattgctgtccaccgaggagtcggtgtgaggccgcgtgcgtctctgtcgtggacacgcgtgattgaccctttaactgtatccttaaccaccgcatatgcatgccaggctgggcacggctccgagggcggccagggacagacgcttgcgccgagaccgcagagggaagcgtcagcgggcgctgctgggagcagaacagtccctcacacctgggcccgggcaggccagcttcgtgctggaggaacttgctgctgtgcctgcgtcgcggcggatccgcggggaccctgccgagggggctgtcatgcggtttccaaggtgcacattttccacggaaacagaactcgatgcactgacctgctccgccaggaaagtgagcgtgtagcgtcctgaggaataaaatgttccgatgatgtgg

SEQ ID NO: 3324 - DNA, 2294 bp, Homo sapiens
ctggcaggccaacctgcaggaccccgggcttagctgggttctgttctgatgtcgcattttcaaggtccgctgagtccgagccctgcctgggtctggctgctgcccgcccgctctctggactgtgctgatgcagagatgcttgttttcctgtgacgtcagcgtcagctcctgcacatccatgccgtgttttagtttgtgcctcagctgctggctacagcttcccgggggagccgggtaccacccgggcctggagacatgaggaggcagggatgtgaggggcgggggacaggacagccggccttccgttaaatatctgctcctcgcgctcgagcctccctgcctattgtcggggccggaggcgagccgacgcagcatcagctcgtcaacgggaaggaagatgcctccctgcacgcccgccgcgcacagagcataaagaatctgcgctgaggaggcaggagaagaaagccgaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaatttacgccatgaaagtggtgaagaaagagctggtgcatgatgacgaggatattgactgggtacagacagagaagcacgtgtttgagcaggcatccagcaaccccttcctggtcggattacactcctgcttccagacgacaagtcggttgttcctggtcattgagtacgtcaacggcggggacctgatgttccacatgcagaggcagaggaagctccctgaggagcacgccaggttctacgcggccgagatctgcatcgccctcaacttcctgcacgagagggggatcatctacagggacctgaagctggacaacgtcctcctggatgcggacgggcacatcaagctcacagactacggcatgtgcaaggaaggcctgggccctggtgacacaacgagcactttctgcggaaccccgaattacatcgcccccgaaatcctgcggggagaggagtacgggttcagcgtggactggtgggcgctgggagtcctcatgtttgagatgatggccgggcgctccccgttcgacatcatcaccgacaacccggacatgaacacagaggactaccttttccaagtgatcctggagaagcccatccggatcccccggttcctgtccgtcaaagcctcccatgttttaaaaggatttttaaataaggaccccaaagagaggctcggctgccggccacagactggattttctgacatcaagtcccacgcgttcttccgcagcatagactgggacttgctggagaagaagcaggcgctccctccattccagccacagatcacagacgactacggtctggacaactttgacacacagttcaccagcgagcccgtgcagctgaccccagacgatgaggatgccataaagaggatcgaccagtcagagttcgaaggctttgagtatatcaacccattattgctgtccaccgaggagtcggtgtgaggccgcgtgcgtctctgtcgtggacacgcgtgattgaccctttaactgtatccttaaccaccgcatatgcatgccaggctgggcacggctccgagggcggccagggacagacgcttgcgccgagaccgcagagggaagcgtcagcgggcgctgctgggagcagaacagtccctcacacctgggcccgggcaggccagcttcgtgctggaggaacttgctgctgtgcctgcgtcgcggcggatccgcggggaccctgccgagggggctgtcatgcggtttccaaggtgcacattttccacggaaacagaactcgatgcactgacctgctccgccaggaaagtgagcgtgtagcgtcctgaggaataaaatgttccgatgatg

SEQ ID NO: 3325 - DNA, 1916 bp, Homo sapiens
gtgctgcaggccctgtgcgtgcggaggacggtgcccgagtcagcattttgggtctgagtcccggcgttgccgctgcctgtgcgctgcacagatgctccgggcagcaacacggctggtgccacggcccggggaaggcgtgcggctgcagcagctcccagcaatgtcaggggaaacgcagtgagaggctgttgttttgcgggtgacagatttttagaaaaataaggctgtggagggaccttctgagcgaggcaggggctgctggagggacatgctcaccccgaggacggatgaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaatttacgccatgaaagtggtgaagaaagagctggtgcatgatgacgaggatattgactgggtacagacagagaagcacgtgtttgagcaggcatccagcaaccccttcctggtcggattacactcctgcttccagacgacaagtcggttgttcctggtcattgagtacgtcaacggcggggacctgatgttccacatgcagaggcagaggaagctccctgaggagcacgccaggttctacgcggccgagatctgcatcgccctcaacttcctgcacgagagggggatcatctacagggacctgaagctggacaacgtcctcctggatgcggacgggcacatcaagctcacagactacggcatgtgcaaggaaggcctgggccctggtgacacaacgagcactttctgcggaaccccgaattacatcgcccccgaaatcctgcggggagaggagtacgggttcagcgtggactggtgggcgctgggagtcctcatgtttgagatgatggccgggcgctccccgttcgacatcatcaccgacaacccggacatgaacacagaggactaccttttccaagtgatcctggagaagcccatccggatcccccggttcctgtccgtcaaagcctcccatgttttaaaaggatttttaaataaggaccccaaagagaggctcggctgccggccacagactggattttctgacatcaagtcccacgcgttcttccgcagcatagactgggacttgctggagaagaagcaggcgctccctccattccagccacagatcacagacgactacggtctggacaactttgacacacagttcaccagcgagcccgtgcagctgaccccagacgatgaggatgccataaagaggatcgaccagtcagagttcgaaggctttgagtatatcaacccattattgctgtccaccgaggagtcggtgtgaggccgcgtgcgtctctgtcgtggacacgcgtgattgaccctttaactgtatccttaaccaccgcatatgcatgccaggctgggcacggctccgagggcggccagggacagacgcttgcgccgagaccgcagagggaagcgtcagcgggcgctgctgggagcagaacagtccctcacacctg

SEQ ID NO: 3326 - DNA, 564 bp, Homo sapiens
gtcatgtgtaaatattgaggcccgtttgaactatccctgtgcggaaaaaaaggcctgtttttcacagggctgcctggggaggaggggggtggaaaggaaaacaggcaggggacagacggacccggcctgcgttggcctggggtgacttcacggctccactgtcagcaagcggccgtcccgtggtggatcctgtccgccctgcgaggacacctggctccatccacacctgggcctctgtctccagccgccgaggccgtgacaccatgaggatcataatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggag

SEQ ID NO: 3327 - DNA, 567 bp, Homo sapiens
gaattcccgatgcacctccttccagcacatggactgtcagagccctgcgttgtcgccagcacagcagatctgaaaggcactaggctgtggcctcgcgacggctgagaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaag

SEQ ID NO: 3328 - DNA, 788 bp, Homo sapiens
ttttttttaaaaaaaaaaacaacaaaaaaccaaaacaacaaccagcctccccagtcaggcttgtggggagccgtgggcctggggagactgggctgctgaaggtggggactgggctgctgggggaggcggctttccctctcggggggtgctggctgctggggaggctggcagcgcgcccctcccccaggtgcgaagggacctcagcagacgcagggctgctccgcacagccagcttgggccgcaggggtccttgagtgatgaagattctgtgttgatgggaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaatttacgccatgaaa

SEQ ID NO: 3329 - DNA, 706 bp, Homo sapiens
ggcggggctgctgccggcctggactcaggaccctcaccctccagcccgcaccctcgactccccaccagccagaccctctgtcctggtgtggacagcacccacatcctggctccacccttgtttcttgccctttgacctacagcctcaggacgtgcaggagggagaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaatttacgccatgaaagtggtgaagaaagagctggtgcatgatgacgag

SEQ ID NO: 3330 - DNA, 716 bp, Homo sapiens
gtccgtccctcggttccgcccccggctgcgcgtctgtccctcgactcggcccctcagctgtgcgccactttctctgtggcccacagtacctccgtctccgccgcttcacacccttctctttctttctctcttcagagagggttgttgggcaggcagagcatcccccgaggggacaagtcaggcctacggactcctggagccaggacctgccgtaggctggttagggcaggatgcgccctgtcttcgtgggtagagccacatgaggggtcacccgaccccctcagggctgaggggcacaggggccgaaagtgtggccgcccctgggggtctgcgcctcttgtggagcccaggcctggcgcccagaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggag

SEQ ID NO: 3331 - DNA, 614 bp, Homo sapiens
agaacatcgctcggtgccagacaggcaggacgcagcgggctggcctgcggggctcactgctgccccccggggccgagcacgaaagggagagttggagggcgcttcctcgccgggtgttgcggtgtgagcggggactggtgagtgtgtgctgtcttcagagagagaagagcagttttcaggaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcaga

SEQ ID NO: 3332 - DNA, 698 bp, Homo sapiens
gaggaggcagggatgtgaggggcgggggacaggacagccggccttccgttaaatatctgctcctcgcgctcgagcctccctgcctattgtcggggccggaggcgagccgacgcagcatcagctcgtcaacgggaaggaagatgcctccctgcacgcccgccgcgcacagagcataaagaatctgcgctgaggaggcaggagaagaaagccggagcggtgccgctggcctgtggcttctgcagggacaagtagtggctgtggccgggaggcgttcggcagctgtgcttcagccccggccccagcttcagctcttcgagttgctggcttctctaaggcctgtcctgaagtggcctggagactgctgagttacttctggaatctgcaccgtgaaagtgaaacctggaccatgatgtgaggctgaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgacctt

SEQ ID NO: 3333 - DNA, 563 bp, Homo sapiens
tttcgtgtgagcccacgctggccatgcacagctggcacgatcccttgcggtgtgaatacactgctggggtgggagcgccgtggccagggtcaggattcgagcggttactggcttttggtctgatggccctcggtggaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacct

SEQ ID NO: 3334 - DNA, 2610 bp, Homo sapiens
agcgcctcgtcctgggcctggccctgggcggccggctgctgactgcgactgcgcgctccgaggcctgcagagacggcccggggcacctgttaccgcaccgctcaagaccggaagcggaaatggaatcgagatagcctcgcgcgtttagctggccgccgccacctccacgccctaggccgggccgacttacggagtcgccggaagcggaagtcgctgaggggtggtgaagcggttgggaaagtgtcggtttatcttcgcgccccttgcgttcttgccgcggcttgcctgggcaggtaaagcgcgattgcgagagctcggcaaccctgccgactcagccggaaccggctcccggcccgaggggcgtggtgtcctggtgctccgactccttccgcaggctccttgggacccgcggttccgggagtcccttgctcagggtccctttcctgcagtgaggcgccgtccgccttccctgtgtccccgcagacccccatcatgggcaataccagcagtgagcgcgccgcgctggagcggcatggtggccataagacgccccggagggacagctcggggggcaccaaggacggggacaggcccaagatcctgatggacagccccgaagacgccgacctcttccactccgaggaaatcaaggcaccagagaaggaggaattcctggcctggcagcatgatctggaagtgaatgataaagctcccgcccaggctcggccaacggtgtttcgatggacggggggcggaaaggaagtttacttatctgggtccttcaacaactggagtaaacttcccctcaccagaagccacaataactttgtagccatcctggatctgccggaaggagagcatcagtacaagttctttgtggatggtcagtggacgcacgacccttccgagcccatagtaaccagccagcttggcacagttaacaacatcattcaagtgaagaaaactgactttgaagtatttgatgctttaatggtggattcccaaaagtgctccgatgtgtctgagctgtccagttctcccccaggaccctaccatcaggagccctacgtctgcaaacccgaagagcgctttcgggcaccccctattctccccccacatctcctccaggtcatcctgaacaaggacacggggatttcctgtgatccagctttgcttcctgagcccaatcacgtcatgctgaaccacctatacgcgctgtctatcaaggatggagtgatggtgctcagcgcaacccaccggtacaagaagaagtacgtcaccaccttgttatacaagcccatatgaagagctgggggcggatggtggcccaggagacagcacaccaccaggctccacacgtgcatgctttccccaagagggaatggactgtacattgctcatttcacactcttcagaagacatttcatacctgccctggtcctgcttgaaggtttgtccaggcagagcagctcctgcagcgcctcggtctgtgacagtcctcctagcacccccatggctttgagcctcggggactcatcaagtccaagaaaagagggaggggtggcagaggatctgcagccctggccccgcggtgcatgaggctgggtgcagttctaaacctacattctcgatttttcttaagccaaaaatgaatgctaactcctttgccagtaaaattctgggaaacagggactgaggccacacatcatttccagtcatctgtgtgtttttaaggccagccacttgtccctgttgaggcctggctatggaactaaatacagtgttggtcttgcctgtccttcaaaatcaacaacagattgtctctcggctccagggaggtgtcatttctatagaaattagaagctttctgatttctagatgaggttttacaattgtttcttacagtcatgtgcactaagtactctttttgtaagcagaggtggctggctctgcagccttaaggccattttttaagtcaccacgtctagaagtcacatgaactctgctcagcaataatctgttctcagaacagacttttcaacctgctgccggatttctccattcagctggatgatcctcaggactgaccagttagctggcaggttgtccagctttttattccagtcataataggtgacagtgttaaccgtgaaaacttgagaggcactctgccctcttccctataaaatcacacagcgtgattttacaaggtcccgtggcaccttgctcaggacctctgcccctagttagcaagactgcagcagttgctgttgcttattctgaaaggaatgtagaacttgacagcagccttctgagtctgggtcaggaagatgtcctttggaccaaagcagacttctttatacgcagctcagtttcccgggagtcgccacagatgtacccactagcccaggttgctgtgagtcagcggaagctcccgttatgccctttgctcctggtgggagagggaggagtgagctccctgggttccagtatttacttggtatacctgagtttgggggtacccttttttgtgacttttcaaaacagtgaattactgtcaccttgatggacaagtttcaataaaactttgtaaaaataattggacatgtg

SEQ ID NO: 3335 - DNA, 1011 bp, Homo sapiens
atcttcgcgccccttgcgttcttgccgcggcttgcctgggcaggtaaagcgcgattgcgagagctcggcaaccctgccgactcagccggaaccggctcccggcccgaggggcgtggtgtcctggtgctccgactccttccgcaggctccttgggacccgcggttccgggagtcccttgctcagggtccctttcctgcagtgaggcgccgtccgccttccctgtgtccccgcagacccccatcatgatggacagccccgaagacgccgacctcttccactccgaggaaatcaaggcaccagagaaggaggaattcctggcctggcagcatgatctggaagtgaatgataaagctcccgcccaggctcggccaacggtgtttcgatggacggggggcggaaaggaagtttacttatctgggtccttcaacaactggagtaaacttcccctcaccagaagccacaataactttgtagccatcctggatctgccggaaggagagcatcagtacaagttctttgtggatggtcagtggacgcacgacccttccgagcccatagtaaccagccagcttggcacagttaacaacatcattcaagtgaagaaaactgactttgaagtatttgatgctttaatggtggattcccaaaagtgctccgatgtgtctgagctgtccagttctcccccaggaccctaccatcaggagccctacgtctgcaaacccgaagagcgctttcgggcaccccctattctccccccacatctcctccaggtcatcctgaacaaggacacggggatttcctgtgatccagctttgcttcctgagcccaatcacgtcatgctgaaccacctatacgcgctgtctatcaaggatggagtgatggtgctcagcgcaacccaccggtacaagaagaagtacgtcaccaccttgttatacaagcccatatgaagagctgggggcggatggtggcccaggagacagcacaccaccaggctccacacgtgcatgcttt

SEQ ID NO: 3336 - DNA, 2303 bp, Homo sapiens
aagcggaaatggaatcgagatagcctcgcgcgtttagctggccgccgccacctccacgccctaggccgggccgacttacggagtcgccggaagcggaagtcgctgaggggtggtgaagcggttgggaaagtgtcggtttatcttcgcgccccttgcgttcttgccgcggcttgcctgggcagacccccatcatgggcaataccagcagtgagcgcgccgcgctggagcggcatggtggccataagacgccccggagggacagctcggggggcaccaaggacggggacaggcccaagatcctgatggacagccccgaagacgccgacctcttccactccgaggaaatcaaggcaccagagaaggaggaattcctggcctggcagcatgatctggaagtgaatgataaagctcccgcccaggctcggccaacggtgtttcgatggacggggggcggaaaggaagtttacttatctgggtccttcaacaactggagtaaacttcccctcaccagaagccacaataactttgtagccatcctggatctgccggaaggagagcatcagtacaagttctttgtggatggtcagtggacgcacgacccttccgagcccatagtaaccagccagcttggcacagttaacaacatcattcaagtgaagaaaactgactttgaagtatttgatgctttaatggtggattcccaaaagtgctccgatgtgtctgagctgtccagttctcccccaggaccctaccatcaggagccctacgtctgcaaacccgaagagcgctttcgggcaccccctattctccccccacatctcctccaggtcatcctgaacaaggacacggggatttcctgtgatccagctttgcttcctgagcccaatcacgtcatgctgaaccacctatacgcgctgtctatcaaggatggagtgatggtgctcagcgcaacccaccggtacaagaagaagtacgtcaccaccttgttatacaagcccatatgaagagctgggggcggatggtggcccaggagacagcacaccaccaggctccacacgtgcatgctttccccaagagggaatggactgtacattgctcatttcacactcttcagaagacatttcatacctgccctggtcctgcttgaaggtttgtccaggcagagcagctcctgcagcgcctcggtctgtgacagtcctcctagcacccccatggctttgagcctcggggactcatcaagtccaagaaaagagggaggggtggcagaggatctgcagccctggccccgcggtgcatgaggctgggtgcagttctaaacctacattctcgatttttcttaagccaaaaatgaatgctaactcctttgccagtaaaattctgggaaacagggactgaggccacacatcatttccagtcatctgtgtgtttttaaggccagccacttgtccctgttgaggcctggctatggaactaaatacagtgttggtcttgcctgtccttcaaaatcaacaacagattgtctctcggctccagggaggtgtcatttctatagaaattagaagctttctgatttctagatgaggttttacaattgtttcttacagtcatgtgcactaagtactctttttgtaagcagaggtggctggctctgcagccttaaggccattttttaagtcaccacgtctagaagtcacatgaactctgctcagcaataatctgttctcagaacagacttttcaacctgctgccggatttctccattcagctggatgatcctcaggactgaccagttagctggcaggttgtccagctttttattccagtcataataggtgacagtgttaaccgtgaaaacttgagaggcactctgccctcttccctataaaatcacacagcgtgattttacaaggtcccgtggcaccttgctcaggacctctgcccctagttagcaagactgcagcagttgctgttgcttattctgaaaggaatgtagaacttgacagcagccttctgagtctgggtcaggaagatgtcctttggaccaaagcagacttctttatacgcagctcagtttcccgggagtcgccacagatgtacccactagcccaggttgctgtgagtcagcggaagctcccgttatgccctttgctcctggtgggagagggaggagtgagctccctgggttccagtatttacttggtatacctgagtttgggggtacccttttttgtgacttttcaaaacagtgaattactgtcaccttgatggacaagtttcaataaaactttgtaaaaataattgga

SEQ ID NO: 3337 - DNA, 13506 bp, Homo sapiens
ggggcatttccgggtccgggccgagcgggcgcacgcgcgggagcgggactcggcggcatggcgggctccggagccggtgtgcgttgctccctgctgcggctgcaggagaccttgtccgctgcggaccgctgcggtgctgccctggccggtcatcaactgatccgcggcctggggcaggaatgcgtcctgagcagcagccccgcggtgctggcattacagacatctttagttttttccagagatttcggtttgcttgtatttgtccggaagtcactcaacagtattgaatttcgtgaatgtagagaagaaatcctaaagtttttatgtattttcttagaaaaaatgggccagaagatcgcaccttactctgttgaaattaagaacacttgtaccagtgtttatacaaaagatagagctgctaaatgtaaaattccagccctggaccttcttattaagttacttcagacttttagaagttctagactcatggatgaatttaaaattggagaattatttagtaaattctatggagaacttgcattgaaaaaaaaaataccagatacagttttagaaaaagtatatgagctcctaggattattgggtgaagttcatcctagtgagatgataaataatgcagaaaacctgttccgcgcttttctgggtgaacttaagacccagatgacatcagcagtaagagagcccaaactacctgttctggcaggatgtctgaaggggttgtcctcacttctgtgcaacttcactaagtccatggaagaagatccccagacttcaagggagatttttaattttgtactaaaggcaattcgtcctcagattgatctgaagagatatgctgtgccctcagctggcttgcgcctatttgccctgcatgcatctcagtttagcacctgccttctggacaactacgtgtctctatttgaagtcttgttaaagtggtgtgcccacacaaatgtagaattgaaaaaagctgcactttcagccctggaatcctttctgaaacaggtttctaatatggtggcgaaaaatgcagaaatgcataaaaataaactgcagtactttatggagcagttttatggaatcatcagaaatgtggattcgaacaacaaggagttatctattgctatccgtggatatggactttttgcaggaccgtgcaaggttataaacgcaaaagatgttgacttcatgtacgttgagctcattcagcgctgcaagcagatgttcctcacccagacagacactggtgacgaccgtgtttatcagatgccaagcttcctccagtctgttgcaagcgtcttgctgtaccttgacacagttcctgaggtgtatactccagttctggagcacctcgtggtgatgcagatagacagtttcccacagtacagtccaaaaatgcagctggtgtgttgcagagccatagtgaaggtgttcctagctttggcagcaaaagggccagttctcaggaattgcattagtactgtggtgcatcagggtttaatcagaatatgttctaaaccagtggtccttccaaagggccctgagtctgaatctgaagaccaccgtgcttcaggggaagtcagaactggcaaatggaaggtgcccacatacaaagactacgtggatctcttcagacatctcctgagctctgaccagatgatggattctattttagcagatgaagcatttttctctgtgaattcctccagtgaaagtctgaatcatttactttatgatgaatttgtaaaatccgttttgaagattgttgagaaattggatcttacacttgaaatacagactgttggggaacaagagaatggagatgaggcgcctggtgtttggatgatcccaacttcagatccagcggctaacttgcatccagctaaacctaaagatttttcggctttcattaacctggtggaattttgcagagagattctccctgagaaacaagcagaattttttgaaccatgggtgtactcattttcatatgaattaattttgcaatctacaaggttgcccctcatcagtggtttctacaaattgctttctattacagtaagaaatgccaagaaaataaaatatttcgagggagttagtccaaagagtctgaaacactctcctgaagacccagaaaagtattcttgctttgctttatttgtgaaatttggcaaagaggtggcagttaaaatgaagcagtacaaagatgaacttttggcctcttgtttgacctttcttctgtccttgccacacaacatcattgaactcgatgttagagcctacgttcctgcactgcagatggctttcaaactgggcctgagctatacccccttggcagaagtaggcctgaatgctctagaagaatggtcaatttatattgacagacatgtaatgcagccttattacaaagacattctcccctgcctggatggatacctgaagacttcagccttgtcagatgagaccaagaataactgggaagtgtcagctctttctcgggctgcccagaaaggatttaataaagtggtgttaaagcatctgaagaagacaaagaacctttcatcaaacgaagcaatatccttagaagaaataagaattagagtagtacaaatgcttggatctctaggaggacaaataaacaaaaatcttctgacagtcacgtcctcagatgagatgatgaagagctatgtggcctgggacagagagaagcggctgagctttgcagtgccctttagagagatgaaacctgtcattttcctggatgtgttcctgcctcgagtcacagaattagcgctcacagccagtgacagacaaactaaagttgcagcctgtgaacttttacatagcatggttatgtttatgttgggcaaagccacgcagatgccagaagggggacagggagccccacccatgtaccagctctataagcggacgtttcctgtgctgcttcgacttgcgtgtgatgttgatcaggtgacaaggcaactgtatgagccactagttatgcagctgattcactggttcactaacaacaagaaatttgaaagtcaggatactgttgccttactagaagctatattggatggaattgtggaccctgttgacagtactttaagagatttttgtggtcggtgtattcgagaattccttaaatggtccattaagcaaataacaccacagcagcaggagaagagtccagtaaacaccaaatcgcttttcaagcgactttatagccttgcgcttcaccccaatgctttcaagaggctgggagcatcacttgcctttaataatatctacagggaattcagggaagaagagtctctggtggaacagtttgtgtttgaagccttggtgatatacatggagagtctggccttagcacatgcagatgagaagtccttaggtacaattcaacagtgttgtgatgccattgatcacctatgccgcatcattgaaaagaagcatgtttctttaaataaagcaaagaaacgacgtttgccgcgaggatttccaccttccgcatcattgtgtttattggatctggtcaagtggcttttagctcattgtgggaggccccagacagaatgtcgacacaaatccattgaactcttttataaattcgttcctttattgccaggcaacagatcccctaatttgtggctgaaagatgttctcaaggaagaaggtgtctcttttctcatcaacacctttgaggggggtggctgtggccagccctcgggcatcctggcccagcccaccctcttgtaccgggggccattcagcctgcaggccacgctatgctggctggacctgctcctggccgcgttggagtgctacaacacgttcattggcgagagaactgtaggagcgctccaggtcctaggtactgaagcccagtcttcacttttgaaagcagtggctttcttcttagaaagcattgccatgcatgacattatagcagcagaaaagtgctttggcactggggcagcaggtaacagaacaagcccacaagagggagaaaggtacaactacagcaaatgcaccgttgtggtccggattatggagtttaccacgactctgctaaacacctccccggaaggatggaagctcctgaagaaggacttgtgtaatacacacctgatgagagtcctggtgcagacgctgtgtgagcccgcaagcataggtttcaacatcggagacgtccaggttatggctcatcttcctgatgtttgtgtgaatctgatgaaagctctaaagatgtccccatacaaagatatcctagagacccatctgagagagaaaataacagcacagagcattgaggagctttgtgccgtcaacttgtatggccctgacgcgcaagtggacaggagcaggctggctgctgttgtgtctgcctgtaaacagcttcacagagctgggcttctgcataatatattaccgtctcagtccacagatttgcatcattctgttggcacagaacttctttccctggtttataaaggcattgcccctggagatgagagacagtgtctgccttctctagacctcagttgtaagcagctggccagcggacttctggagttagcctttgcttttggaggactgtgtgagcgccttgtgagtcttctcctgaacccagcggtgctgtccacggcgtccttgggcagctcacagggcagcgtcatccacttctcccatggggagtatttctatagcttgttctcagaaacgatcaacacggaattattgaaaaatctggatcttgctgtattggagctcatgcagtcttcagtggataataccaaaatggtgagtgccgttttgaacggcatgttagaccagagcttcagggagcgagcaaaccagaaacaccaaggactgaaacttgcgactacaattctgcaacactggaagaagtgtgattcatggtgggccaaagattcccctctcgaaactaaaatggcagtgctggccttactggcaaaaattttacagattgattcatctgtatcttttaatacaagtcatggttcattccctgaagtctttacaacatatattagtctacttgctgacacaaagctggatctacatttaaagggccaagctgtcactcttcttccattcttcaccagcctcactggaggcagtctggaggaacttagacgtgttctggagcagctcatcgttgctcacttccccatgcagtccagggaatttcctccaggaactccgcggttcaataattatgtggactgcatgaaaaagtttctagatgcattggaattatctcaaagccctatgttgttggaattgatgacagaagttctttgtcgggaacagcagcatgtcatggaagaattatttcaatccagtttcaggaggattgccagaaggggttcatgtgtcacacaagtaggccttctggaaagcgtgtatgaaatgttcaggaaggatgacccccgcctaagtttcacacgccagtcctttgtggaccgctccctcctcactctgctgtggcactgtagcctggatgctttgagagaattcttcagcacaattgtggtggatgccattgatgtgttgaagtccaggtttacaaagctaaatgaatctacctttgatactcaaatcaccaagaagatgggctactataagattctagacgtgatgtattctcgccttcccaaagatgatgttcatgctaaggaatcaaaaattaatcaagttttccatggctcgtgtattacagaaggaaatgaacttacaaagacattgattaaattgtgctacgatgcatttacagagaacatggcaggagagaatcagctgctggagaggagaagactttaccattgtgcagcatacaactgcgccatatctgtcatctgctgtgtcttcaatgagttaaaattttaccaaggttttctgtttagtgaaaaaccagaaaagaacttgcttatttttgaaaatctgatcgacctgaagcgccgctataattttcctgtagaagttgaggttcctatggaaagaaagaaaaagtacattgaaattaggaaagaagccagagaagcagcaaatggggattcagatggtccttcctatatgtcttccctgtcatatttggcagacagtaccctgagtgaggaaatgagtcaatttgatttctcaaccggagttcagagctattcatacagctcccaagaccctagacctgccactggtcgttttcggagacgggagcagcgggaccccacggtgcatgatgatgtgctggagctggagatggacgagctcaatcggcatgagtgcatggcgcccctgacggccctggtcaagcacatgcacagaagcctgggcccgcctcaaggagaagaggattcagtgccaagagatcttccttcttggatgaaattcctccatggcaaactgggaaatccaatagtaccattaaatatccgtctcttcttagccaagcttgttattaatacagaagaggtctttcgcccttacgcgaagcactggcttagccccttgctgcagctggctgcttctgaaaacaatggaggagaaggaattcactacatggtggttgagatagtggccactattctttcatggacaggcttggccactccaacaggggtccctaaagatgaagtgttagcaaatcgattgcttaatttcctaatgaaacatgtctttcatccaaaaagagctgtgtttagacacaaccttgaaattataaagacccttgtcgagtgctggaaggattgtttatccatcccttataggttaatatttgaaaagttttccggtaaagatcctaattctaaagacaactcagtagggattcaattgctaggcatcgtgatggccaatgacctgcctccctatgacccacagtgtggcatccagagtagcgaatacttccaggctttggtgaataatatgtcctttgtaagatataaagaagtgtatgccgctgcagcagaagttctaggacttatacttcgatatgttatggagagaaaaaacatactggaggagtctctgtgtgaactggttgcgaaacaattgaagcaacatcagaatactatggaggacaagtttattgtgtgcttgaacaaagtgaccaagagcttccctcctcttgcagacaggttcatgaatgctgtgttctttctgctgccaaaatttcatggagtgttgaaaacactctgtctggaggtggtactttgtcgtgtggagggaatgacagagctgtacttccagttaaagagcaaggacttcgttcaagtcatgagacatagagatgatgaaagacaaaaagtatgtttggacataatttataagatgatgccaaagttaaaaccagtagaactccgagaacttctgaaccccgttgtggaattcgtttcccatccttctacaacatgtagggaacaaatgtataatattctcatgtggattcatgataattacagagatccagaaagtgagacagataatgactcccaggaaatatttaagttggcaaaagatgtgctgattcaaggattgatcgatgagaaccctggacttcaattaattattcgaaatttctggagccatgaaactaggttaccttcaaataccttggaccggttgctggcactaaattccttatattctcctaagatagaagtgcactttttaagtttagcaacaaattttctgctcgaaatgaccagcatgagcccagattatccaaaccccatgttcgagcatcctctgtcagaatgcgaatttcaggaatataccattgattctgattggcgtttccgaagtactgttctcactccgatgtttgtggagacccaggcctcccagggcactctccagacccgtacccaggaagggtccctctcagctcgctggccagtggcagggcagataagggccacccagcagcagcatgacttcacactgacacagactgcagatggaagaagctcatttgattggctgaccgggagcagcactgacccgctggtcgaccacaccagtccctcatctgactccttgctgtttgcccacaagaggagtgaaaggttacagagagcacccttgaagtcagtggggcctgattttgggaaaaaaaggctgggccttccaggggacgaggtggataacaaagtgaaaggtgcggccggccggacggacctactacgactgcgcagacggtttatgagggaccaggagaagctcagtttgatgtatgccagaaaaggcgttgctgagcaaaaacgagagaaggaaatcaagagtgagttaaaaatgaagcaggatgcccaggtcgttctgtacagaagctaccggcacggagaccttcctgacattcagatcaagcacagcagcctcatcaccccgttacaggccgtggcccagagggacccaataattgcaaaacagctctttagcagcttgttttctggaattttgaaagagatggataaatttaagacactgtctgaaaaaaacaacatcactcaaaagttgcttcaagacttcaatcgttttcttaataccaccttctctttctttccaccctttgtctcttgtattcaggacattagctgtcagcacgcagccctgctgagcctcgacccagcggctgttagcgctggttgcctggccagcctacagcagcccgtgggcatccgcctgctagaggaggctctgctccgcctgctgcctgctgagctgcctgccaagcgagtccgtgggaaggcccgcctccctcctgatgtcctcagatgggtggagcttgctaagctgtatagatcaattggagaatacgacgtcctccgtgggatttttaccagtgagataggaacaaagcaaatcactcagagtgcattattagcagaagccagaagtgattattctgaagctgctaagcagtatgatgaggctctcaataaacaagactgggtagatggtgagcccacagaagccgagaaggatttttgggaacttgcatcccttgactgttacaaccaccttgctgagtggaaatcacttgaatactgttctacagccagtatagacagtgagaaccccccagacctaaataaaatctggagtgaaccattttatcaggaaacatatctaccttacatgatccgcagcaagctgaagctgctgctccagggagaggctgaccagtccctgctgacatttattgacaaagctatgcacggggagctccagaaggcgattctagagcttcattacagtcaagagctgagtctgctttacctcctgcaagatgatgttgacagagccaaatattacattcaaaatggcattcagagttttatgcagaattattctagtattgatgtcctcttacaccaaagtagactcaccaaattgcagtctgtacaggctttaacagaaattcaggagttcatcagctttataagcaaacaaggcaatttatcatctcaagttccccttaagagacttctgaacacctggacaaacagatatccagatgctaaaatggacccaatgaacatctgggatgacatcatcacaaatcgatgtttctttctcagcaaaatagaggagaagcttacccctcttccagaagataatagtatgaatgtggatcaagatggagaccccagtgacaggatggaagtgcaagagcaggaagaagatatcagctccctgatcaggagttgcaagttttccatgaaaatgaagatgatagacagtgcccggaagcagaacaatttctcacttgctatgaaactactgaaggagctgcataaagagtcaaaaaccagagacgattggctggtgagctgggtgcagagctactgccgcctgagccactgccggagccggtcccagggctgctctgagcaggtgctcactgtgctgaaaacagtctctttgttggatgagaacaacgtgtcaagctacttaagcaaaaatattctggctttccgtgaccagaacattctcttgggtacaacttacaggatcatagcgaatgctctcagcagtgagccagcctgccttgctgaaatcgaggaggacaaggctagaagaatcttagagctttctggatccagttcagaggattcagagaaggtgatcgcgggtctgtaccagagagcattccagcacctctctgaggctgtgcaggcggctgaggaggaggcccagcctccctcctggagctgtgggcctgcagctggggtgattgatgcttacatgacgctggcagatttctgtgaccaacagctgcgcaaggaggaagagaatgcatcagttattgattctgcagaactgcaggcgtatccagcacttgtggtggagaaaatgttgaaagctttaaaattaaattccaatgaagccagattgaagtttcctagattacttcagattatagaacggtatccagaggagactttgagcctcatgacaaaagagatctcttccgttccctgctggcagttcatcagctggatcagccacatggtggccttactggacaaagaccaagccgttgctgttcagcactctgtggaagaaatcactgataactacccgcaggctattgtttatcccttcatcataagcagcgaaagctattccttcaaggatacttctactggtcataagaataaggagtttgtggcaaggattaaaagtaagttggatcaaggaggagtgattcaagattttattaatgccttagatcagctctctaatcctgaactgctctttaaggattggagcaatgatgtaagagctgaactagcaaaaacccctgtaaataaaaaaaacattgaaaaaatgtatgaaagaatgtatgcagccttgggtgacccaaaggctccaggcctgggggcctttagaaggaagtttattcagacttttggaaaagaatttgataaacattttgggaaaggaggttctaaactactgagaatgaagctcagtgacttcaacgacattaccaacatgctacttttaaaaatgaacaaagactcaaagccccctgggaatctgaaagaatgttcaccctggatgagcgacttcaaagtggagttcctgagaaatgagctggagattcccggtcagtatgacggtaggggaaagccattgccagagtaccacgtgcgaatcgccgggtttgatgagcgggtgacagtcatggcgtctctgcgaaggcccaagcgcatcatcatccgtggccatgacgagagggaacaccctttcctggtgaagggtggcgaggacctgcggcaggaccagcgcgtggagcagctcttccaggtcatgaatgggatcctggcccaagactccgcctgcagccagagggccctgcagctgaggacctatagcgttgtgcccatgacctccaggttaggattaattgagtggcttgaaaatactgttaccttgaaggaccttcttttgaacaccatgtcccaagaggagaaggcggcttacctgagtgatcccagggcaccgccgtgtgaatataaagattggctgacaaaaatgtcaggaaaacatgatgttggagcttacatgctaatgtataagggcgctaatcgtactgaaacagtcacgtcttttagaaaacgagaaagtaaagtgcctgctgatctcttaaagcgggccttcgtgaggatgagtacaagccctgaggctttcctggcgctccgctcccacttcgccagctctcacgctctgatatgcatcagccactggatcctcgggattggagacagacatctgaacaactttatggtggccatggagactggcggcgtgatcgggatcgactttgggcatgcgtttggatccgctacacagtttctgccagtccctgagttgatgccttttcggctaactcgccagtttatcaatctgatgttaccaatgaaagaaacgggccttatgtacagcatcatggtacacgcactccgggccttccgctcagaccctggcctgctcaccaacaccatggatgtgtttgtcaaggagccctcctttgattggaaaaattttgaacagaaaatgctgaaaaaaggagggtcatggattcaagaaataaatgttgctgaaaaaaattggtacccccgacagaaaatatgttacgctaagagaaagttagcaggtgccaatccagcagtcattacttgtgatgagctactcctgggtcatgagaaggcccctgccttcagagactatgtggctgtggcacgaggaagcaaagatcacaacattcgtgcccaagaaccagagagtgggctttcagaagagactcaagtgaagtgcctgatggaccaggcaacagaccccaacatccttggcagaacctgggaaggatgggagccctggatgtgaggtctgtgggagtctgcagatagaaagcattacattgtttaaagaatctactatactttggttggcagcattccatgagctgattttcctgaaacactaaagagaaatgtcttttgtgctacagtttcgtagcatgagtttaaatcaagattatgatgagtaaatgtgtatgggttaaatcaaagataaggttatagtaacatcaaagattaggtgaggtttatagaaagatagatatccaggcttaccaaagtattaagtcaagaatataatatgtgatcagctttcaaagcatttacaagtgctgcaagttagtgaaacagctgtctccgtaaatggaggaaatgtggggaagccttggaatgcccttctggttctggcacattggaaagcacactcagaaggcttcatcaccaagattttgggagagtaaagctaagtatagttgatgtaacattgtagaagcagcataggaacaataagaacaataggtaaagctataattatggcttatatttagaaatgactgcatttgatattttaggatatttttctaggttttttcctttcattttattctcttctagttttgacattttatgatagatttgctctctagaaggaaacgtctttatttaggagggcaaaaattttggtcatagcattcacttttgctattccaatctacaactggaagatacataaaagtgctttgcattgaatttgggataacttcaaaaatcccatggttgttgttagggatagtactaagcatttcagttccaggagaataaaagaaattcctatttgaaatgaattcctcatttggaggaaaaaaagcatgcattctagcacaacaagatgaaattatggaatacaaaagtggctccttcccatgtgcagtccctgtccccccccgccagtcctccacacccaaactgtttctgattggcttttagctttttgttgtttttttttttccttctaacacttgtatttggaggctcttctgtgattttgagaagtatactcttgagtgtttaataaagtttttttccaaaagta

SEQ ID NO: 3338 - DNA, 13413 bp, Homo sapiens
ggggcatttccgggtccgggccgagcgggcgcacgcgcgggagcgggactcggcggcatggcgggctccggagccggtgtgcgttgctccctgctgcggctgcaggagaccttgtccgctgcggaccgctgcggtgctgccctggccggtcatcaactgatccgcggcctggggcaggaatgcgtcctgagcagcagccccgcggtgctggcattacagacatctttagttttttccagagatttcggtttgcttgtatttgtccggaagtcactcaacagtattgaatttcgtgaatgtagagaagaaatcctaaagtttttatgtattttcttagaaaaaatgggccagaagatcgcaccttactctgttgaaattaagaacacttgtaccagtgtttatacaaaagatagagctgctaaatgtaaaattccagccctggaccttcttattaagttacttcagacttttagaagttctagactcatggatgaatttaaaattggagaattatttagtaaattctatggagaacttgcattgaaaaaaaaaataccagatacagttttagaaaaagtatatgagctcctaggattattgggtgaagttcatcctagtgagatgataaataatgcagaaaacctgttccgcgcttttctgggtgaacttaagacccagatgacatcagcagtaagagagcccaaactacctgttctggcaggatgtctgaaggggttgtcctcacttctgtgcaacttcactaagtccatggaagaagatccccagacttcaagggagatttttaattttgtactaaaggcaattcgtcctcagattgatctgaagagatatgctgtgccctcagctggcttgcgcctatttgccctgcatgcatctcagtttagcacctgccttctggacaactacgtgtctctatttgaagtcttgttaaagtggtgtgcccacacaaatgtagaattgaaaaaagctgcactttcagccctggaatcctttctgaaacaggtttctaatatggtggcgaaaaatgcagaaatgcataaaaataaactgcagtactttatggagcagttttatggaatcatcagaaatgtggattcgaacaacaaggagttatctattgctatccgtggatatggactttttgcaggaccgtgcaaggttataaacgcaaaagatgttgacttcatgtacgttgagctcattcagcgctgcaagcagatgttcctcacccagacagacactggtgacgaccgtgtttatcagatgccaagcttcctccagtctgttgcaagcgtcttgctgtaccttgacacagttcctgaggtgtatactccagttctggagcacctcgtggtgatgcagatagacagtttcccacagtacagtccaaaaatgcagctggtgtgttgcagagccatagtgaaggtgttcctagctttggcagcaaaagggccagttctcaggaattgcattagtactgtggtgcatcagggtttaatcagaatatgttctaaaccagtggtccttccaaagggccctgagtctgaatctgaagaccaccgtgcttcaggggaagtcagaactggcaaatggaaggtgcccacatacaaagactacgtggatctcttcagacatctcctgagctctgaccagatgatggattctattttagcagatgaagcatttttctctgtgaattcctccagtgaaagtctgaatcatttactttatgatgaatttgtaaaatccgttttgaagattgttgagaaattggatcttacacttgaaatacagactgttggggaacaagagaatggagatgaggcgcctggtgtttggatgatcccaacttcagatccagcggctaacttgcatccagctaaacctaaagatttttcggctttcattaacctggtggaattttgcagagagattctccctgagaaacaagcagaattttttgaaccatgggtgtactcattttcatatgaattaattttgcaatctacaaggttgcccctcatcagtggtttctacaaattgctttctattacagtaagaaatgccaagaaaataaaatatttcgagggagttagtccaaagagtctgaaacactctcctgaagacccagaaaagtattcttgctttgctttatttgtgaaatttggcaaagaggtggcagttaaaatgaagcagtacaaagatgaacttttggcctcttgtttgacctttcttctgtccttgccacacaacatcattgaactcgatgttagagcctacgttcctgcactgcagatggctttcaaactgggcctgagctatacccccttggcagaagtaggcctgaatgctctagaagaatggtcaatttatattgacagacatgtaatgcagccttattacaaagacattctcccctgcctggatggatacctgaagacttcagccttgtcagatgagaccaagaataactgggaagtgtcagctctttctcgggctgcccagaaaggatttaataaagtggtgttaaagcatctgaagaagacaaagaacctttcatcaaacgaagcaatatccttagaagaaataagaattagagtagtacaaatgcttggatctctaggaggacaaataaacaaaaatcttctgacagtcacgtcctcagatgagatgatgaagagctatgtggcctgggacagagagaagcggctgagctttgcagtgccctttagagagatgaaacctgtcattttcctggatgtgttcctgcctcgagtcacagaattagcgctcacagccagtgacagacaaactaaagttgcagcctgtgaacttttacatagcatggttatgtttatgttgggcaaagccacgcagatgccagaagggggacagggagccccacccatgtaccagctctataagcggacgtttcctgtgctgcttcgacttgcgtgtgatgttgatcaggtgacaaggcaactgtatgagccactagttatgcagctgattcactggttcactaacaacaagaaatttgaaagtcaggatactgttgccttactagaagctatattggatggaattgtggaccctgttgacagtactttaagagatttttgtggtcggtgtattcgagaattccttaaatggtccattaagcaaataacaccacagcagcaggagaagagtccagtaaacaccaaatcgcttttcaagcgactttatagccttgcgcttcaccccaatgctttcaagaggctgggagcatcacttgcctttaataatatctacagggaattcagggaagaagagtctctggtggaacagtttgtgtttgaagccttggtgatatacatggagagtctggccttagcacatgcagatgagaagtccttaggtacaattcaacagtgttgtgatgccattgatcacctatgccgcatcattgaaaagaagcatgtttctttaaataaagcaaagaaacgacgtttgccgcgaggatttccaccttccgcatcattgtgtttattggatctggtcaagtggcttttagctcattgtgggaggccccagacagaatgtcgacacaaatccattgaactcttttataaattcgttcctttattgccaggcaacagatcccctaatttgtggctgaaagatgttctcaaggaagaaggtgtctcttttctcatcaacacctttgaggggggtggctgtggccagccctcgggcatcctggcccagcccaccctcttgtaccgggggccattcagcctgcaggccacgctatgctggctggacctgctcctggccgcgttggagtgctacaacacgttcattggcgagagaactgtaggagcgctccaggtcctaggtactgaagcccagtcttcacttttgaaagcagtggctttcttcttagaaagcattgccatgcatgacattatagcagcagaaaagtgctttggcactggggcagcaggtaacagaacaagcccacaagagggagaaaggtacaactacagcaaatgcaccgttgtggtccggattatggagtttaccacgactctgctaaacacctccccggaaggatggaagctcctgaagaaggacttgtgtaatacacacctgatgagagtcctggtgcagacgctgtgtgagcccgcaagcataggtttcaacatcggagacgtccaggttatggctcatcttcctgatgtttgtgtgaatctgatgaaagctctaaagatgtccccatacaaagatatcctagagacccatctgagagagaaaataacagcacagagcattgaggagctttgtgccgtcaacttgtatggccctgacgcgcaagtggacaggagcaggctggctgctgttgtgtctgcctgtaaacagcttcacagagctgggcttctgcataatatattaccgtctcagtccacagatttgcatcattctgttggcacagaacttctttccctggtttataaaggcattgcccctggagatgagagacagtgtctgccttctctagacctcagttgtaagcagctggccagcggacttctggagttagcctttgcttttggaggactgtgtgagcgccttgtgagtcttctcctgaacccagcggtgctgtccacggcgtccttgggcagctcacagggcagcgtcatccacttctcccatggggagtatttctatagcttgttctcagaaacgatcaacacggaattattgaaaaatctggatcttgctgtattggagctcatgcagtcttcagtggataataccaaaatggtgagtgccgttttgaacggcatgttagaccagagcttcagggagcgagcaaaccagaaacaccaaggactgaaacttgcgactacaattctgcaacactggaagaagtgtgattcatggtgggccaaagattcccctctcgaaactaaaatggcagtgctggccttactggcaaaaattttacagattgattcatctgtatcttttaatacaagtcatggttcattccctgaagtctttacaacatatattagtctacttgctgacacaaagctggatctacatttaaagggccaagctgtcactcttcttccattcttcaccagcctcactggaggcagtctggaggaacttagacgtgttctggagcagctcatcgttgctcacttccccatgcagtccagggaatttcctccaggaactccgcggttcaataattatgtggactgcatgaaaaagtttctagatgcattggaattatctcaaagccctatgttgttggaattgatgacagaagttctttgtcgggaacagcagcatgtcatggaagaattatttcaatccagtttcaggaggattgccagaaggggttcatgtgtcacacaagtaggccttctggaaagcgtgtatgaaatgttcaggaaggatgacccccgcctaagtttcacacgccagtcctttgtggaccgctccctcctcactctgctgtggcactgtagcctggatgctttgagagaattcttcagcacaattgtggtggatgccattgatgtgttgaagtccaggtttacaaagctaaatgaatctacctttgatactcaaatcaccaagaagatgggctactataagattctagacgtgatgtattctcgccttcccaaagatgatgttcatgctaaggaatcaaaaattaatcaagttttccatggctcgtgtattacagaaggaaatgaacttacaaagacattgattaaattgtgctacgatgcatttacagagaacatggcaggagagaatcagctgctggagaggagaagactttaccattgtgcagcatacaactgcgccatatctgtcatctgctgtgtcttcaatgagttaaaattttaccaaggttttctgtttagtgaaaaaccagaaaagaacttgcttatttttgaaaatctgatcgacctgaagcgccgctataattttcctgtagaagttgaggttcctatggaaagaaagaaaaagtacattgaaattaggaaagaagccagagaagcagcaaatggggattcagatggtccttcctatatgtcttccctgtcatatttggcagacagtaccctgagtgaggaaatgagtcaatttgatttctcaaccggagttcagagctattcatacagctcccaagaccctagacctgccactggtcgttttcggagacgggagcagcgggaccccacggtgcatgatgatgtgctggagctggagatggacgagctcaatcggcatgagtgcatggcgcccctgacggccctggtcaagcacatgcacagaagcctgggcccgcctcaaggagaagaggattcagtgccaagagatcttccttcttggatgaaattcctccatggcaaactgggaaatccaatagtaccattaaatatccgtctcttcttagccaagcttgttattaatacagaagaggtctttcgcccttacgcgaagcactggcttagccccttgctgcagctggctgcttctgaaaacaatggaggagaaggaattcactacatggtggttgagatagtggccactattctttcatggacaggcttggccactccaacaggggtccctaaagatgaagtgttagcaaatcgattgcttaatttcctaatgaaacatgtctttcatccaaaaagagctgtgtttagacacaaccttgaaattataaagacccttgtcgagtgctggaaggattgtttatccatcccttataggttaatatttgaaaagttttccggtaaagatcctaattctaaagacaactcagtagggattcaattgctaggcatcgtgatggccaatgacctgcctccctatgacccacagtgtggcatccagagtagcgaatacttccaggctttggtgaataatatgtcctttgtaagatataaagaagtgtatgccgctgcagcagaagttctaggacttatacttcgatatgttatggagagaaaaaacatactggaggagtctctgtgtgaactggttgcgaaacaattgaagcaacatcagaatactatggaggacaagtttattgtgtgcttgaacaaagtgaccaagagcttccctcctcttgcagacaggttcatgaatgctgtgttctttctgctgccaaaatttcatggagtgttgaaaacactctgtctggaggtggtactttgtcgtgtggagggaatgacagagctgtacttccagttaaagagcaaggacttcgttcaagtcatgagacatagagatgatgaaagacaaaaagtatgtttggacataatttataagatgatgccaaagttaaaaccagtagaactccgagaacttctgaaccccgttgtggaattcgtttcccatccttctacaacatgtagggaacaaatgtataatattctcatgtggattcatgataattacagagatccagaaagtgagacagataatgactcccaggaaatatttaagttggcaaaagatgtgctgattcaaggattgatcgatgagaaccctggacttcaattaattattcgaaatttctggagccatgaaactaggttaccttcaaataccttggaccggttgctggcactaaattccttatattctcctaagatagaagtgcactttttaagtttagcaacaaattttctgctcgaaatgaccagcatgagcccagattatccaaaccccatgttcgagcatcctctgtcagaatgcgaatttcaggaatataccattgattctgattggcgtttccgaagtactgttctcactccgatgtttgtggagacccaggcctcccagggcactctccagacccgtacccaggaagggtccctctcagctcgctggccagtggcagggcagataagggccacccagcagcagcatgacttcacactgacacagactgcagatggaagaagctcatttgattggctgaccgggagcagcactgacccgctggtcgaccacaccagtccctcatctgactccttgctgtttgcccacaagaggagtgaaaggttacagagagcacccttgaagtcagtggggcctgattttgggaaaaaaaggctgggccttccaggggacgaggtggataacaaagtgaaaggtgcggccggccggacggacctactacgactgcgcagacggtttatgagggaccaggagaagctcagtttgatgtatgccagaaaaggcgttgctgagcaaaaacgagagaaggaaatcaagagtgagttaaaaatgaagcaggatgcccaggtcgttctgtacagaagctaccggcacggagaccttcctgacattcagatcaagcacagcagcctcatcaccccgttacaggccgtggcccagagggacccaataattgcaaaacagctctttagcagcttgttttctggaattttgaaagagatggataaatttaagacactgtctgaaaaaaacaacatcactcaaaagttgcttcaagacttcaatcgttttcttaataccaccttctctttctttccaccctttgtctcttgtattcaggacattagctgtcagcacgcagccctgctgagcctcgacccagcggctgttagcgctggttgcctggccagcctacagcagcccgtgggcatccgcctgctagaggaggctctgctccgcctgctgcctgctgagctgcctgccaagcgagtccgtgggaaggcccgcctccctcctgatgtcctcagatgggtggagcttgctaagctgtatagatcaattggagaatacgacgtcctccgtgggatttttaccagtgagataggaacaaagcaaatcactcagagtgcattattagcagaagccagaagtgattattctgaagctgctaagcagtatgatgaggctctcaataaacaagactgggtagatggtgagcccacagaagccgagaaggatttttgggaacttgcatcccttgactgttacaaccaccttgctgagtggaaatcacttgaatactgttctacagccagtatagacagtgagaaccccccagacctaaataaaatctggagtgaaccattttatcaggaaacatatctaccttacatgatccgcagcaagctgaagctgctgctccagggagaggctgaccagtccctgctgacatttattgacaaagctatgcacggggagctccagaaggcgattctagagcttcattacagtcaagagctgagtctgctttacctcctgcaagatgatgttgacagagccaaatattacattcaaaatggcattcagagttttatgcagaattattctagtattgatgtcctcttacaccaaagtagactcaccaaattgcagtctgtacaggctttaacagaaattcaggagttcatcagctttataagcaaacaaggcaatttatcatctcaagttccccttaagagacttctgaacacctggacaaacagatatccagatgctaaaatggacccaatgaacatctgggatgacatcatcacaaatcgatgtttctttctcagcaaaatagaggagaagcttacccctcttccagaagataatagtatgaatgtggatcaagatggagaccccagtgacaggatggaagtgcaagagcaggaagaagatatcagctccctgatcaggagttgcaagttttccatgaaaatgaagatgatagacagtgcccggaagcagaacaatttctcacttgctatgaaactactgaaggagctgcataaagagtcaaaaaccagagacgattggctggtgagctgggtgcagagctactgccgcctgagccactgccggagccggtcccagggctgctctgagcaggtgctcactgtgctgaaaacagtctctttgttggatgagaacaacgtgtcaagctacttaagcaaaaatattctggctttccgtgaccagaacattctcttgggtacaacttacaggatcatagcgaatgctctcagcagtgagccagcctgccttgctgaaatcgaggaggacaaggctagaagaatcttagagctttctggatccagttcagaggattcagagaaggtgatcgcgggtctgtaccagagagcattccagcacctctctgaggctgtgcaggcggctgaggaggaggcccagcctccctcctggagctgtgggcctgcagctggggtgattgatgcttacatgacgctggcagatttctgtgaccaacagctgcgcaaggaggaagagaatgcatcagttattgattctgcagaactgcaggcgtatccagcacttgtggtggagaaaatgttgaaagctttaaaattaaattccaatgaagccagattgaagtttcctagattacttcagattatagaacggtatccagaggagactttgagcctcatgacaaaagagatctcttccgttccctgctggcagttcatcagctggatcagccacatggtggccttactggacaaagaccaagccgttgctgttcagcactctgtggaagaaatcactgataactacccgcaggctattgtttatcccttcatcataagcagcgaaagctattccttcaaggatacttctactggtcataagaataaggagtttgtggcaaggattaaaagtaagttggatcaaggaggagtgattcaagattttattaatgccttagatcagctctctaatcctgaactgctctttaaggattggagcaatgatgtaagagctgaactagcaaaaacccctgtaaataaaaaaaacattgaaaaaatgtatgaaagaatgtatgcagccttgggtgacccaaaggctccaggcctgggggcctttagaaggaagtttattcagacttttggaaaagaatttgataaacattttgggaaaggaggttctaaactactgagaatgaagctcagtgacttcaacgacattaccaacatgctacttttaaaaatgaacaaagactcaaagccccctgggaatctgaaagaatgttcaccctggatgagcgacttcaaagtggagttcctgagaaatgagctggagattcccggtcagtatgacggtaggggaaagccattgccagagtaccacgtgcgaatcgccgggtttgatgagcgggtgacagtcatggcgtctctgcgaaggcccaagcgcatcatcatccgtggccatgacgagagggaacaccctttcctggtgaagggtggcgaggacctgcggcaggaccagcgcgtggagcagctcttccaggtcatgaatgggatcctggcccaagactccgcctgcagccagagggccctgcagctgaggacctatagcgttgtgcccatgacctccagtgatcccagggcaccgccgtgtgaatataaagattggctgacaaaaatgtcaggaaaacatgatgttggagcttacatgctaatgtataagggcgctaatcgtactgaaacagtcacgtcttttagaaaacgagaaagtaaagtgcctgctgatctcttaaagcgggccttcgtgaggatgagtacaagccctgaggctttcctggcgctccgctcccacttcgccagctctcacgctctgatatgcatcagccactggatcctcgggattggagacagacatctgaacaactttatggtggccatggagactggcggcgtgatcgggatcgactttgggcatgcgtttggatccgctacacagtttctgccagtccctgagttgatgccttttcggctaactcgccagtttatcaatctgatgttaccaatgaaagaaacgggccttatgtacagcatcatggtacacgcactccgggccttccgctcagaccctggcctgctcaccaacaccatggatgtgtttgtcaaggagccctcctttgattggaaaaattttgaacagaaaatgctgaaaaaaggagggtcatggattcaagaaataaatgttgctgaaaaaaattggtacccccgacagaaaatatgttacgctaagagaaagttagcaggtgccaatccagcagtcattacttgtgatgagctactcctgggtcatgagaaggcccctgccttcagagactatgtggctgtggcacgaggaagcaaagatcacaacattcgtgcccaagaaccagagagtgggctttcagaagagactcaagtgaagtgcctgatggaccaggcaacagaccccaacatccttggcagaacctgggaaggatgggagccctggatgtgaggtctgtgggagtctgcagatagaaagcattacattgtttaaagaatctactatactttggttggcagcattccatgagctgattttcctgaaacactaaagagaaatgtcttttgtgctacagtttcgtagcatgagtttaaatcaagattatgatgagtaaatgtgtatgggttaaatcaaagataaggttatagtaacatcaaagattaggtgaggtttatagaaagatagatatccaggcttaccaaagtattaagtcaagaatataatatgtgatcagctttcaaagcatttacaagtgctgcaagttagtgaaacagctgtctccgtaaatggaggaaatgtggggaagccttggaatgcccttctggttctggcacattggaaagcacactcagaaggcttcatcaccaagattttgggagagtaaagctaagtatagttgatgtaacattgtagaagcagcataggaacaataagaacaataggtaaagctataattatggcttatatttagaaatgactgcatttgatattttaggatatttttctaggttttttcctttcattttattctcttctagttttgacattttatgatagatttgctctctagaaggaaacgtctttatttaggagggcaaaaattttggtcatagcattcacttttgctattccaatctacaactggaagatacataaaagtgctttgcattgaatttgggataacttcaaaaatcccatggttgttgttagggatagtactaagcatttcagttccaggagaataaaagaaattcctatttgaaatgaattcctcatttggaggaaaaaaagcatgcattctagcacaacaagatgaaattatggaatacaaaagtggctccttcccatgtgcagtccctgtccccccccgccagtcctccacacccaaactgtttctgattggcttttagctttttgttgtttttttttttccttctaacacttgtatttggaggctcttctgtgattttgagaagtatactcttgagtgtttaataaagtttttttccaaaagta

SEQ ID NO: 3339 - DNA, 710 bp, Homo sapiens
gcctcaagccgacgcagcggcctactctcgcactgcagacggggaaactgaggcctgaggcggccggggtggggcagacctcccggcgagcccgagcccccgcccccggctagccccgccctggcccgtaagaagcacccggggcgcgaggcgaaggcgcacagcgcggggccaggctgggtccagcagcgcgatggcagctcagcggctgggcaagcgcgtgctgagcaagctgcagtctccatcgcgggcccgcgggccagggggcagtcccggggggctgcagaagcggcacgcgcgcgtcaccgtcaagtatgaccggcgggagctgcagcggcggctggacgtggagaagtggatcgacgggcgcctggaggagctgtaccgcggcatggaggcagacatgcccgatgagatcaacattgatgaattgttggagttagagagtgaagaggagagaagccggaaaatccagggactcctgaagtcatgtgggaaacctgtcgaggacttcatccaggagctgctggcaaagcttcaaggcctccacaggcagcccggcctccgccagccaagcccctcccacgacggcagcctcagccccctccaggaccgggcccggactgctcacccctgaccctcttgcactctccctgccccccggacgccgcccagcttgcttgtgtataagttgtatttaatggttctgt

SEQ ID NO: 3340 - DNA, 696 bp, Homo sapiens
gcagggacccgcccgggactctgggtccccgcccatacctcaacttcgcacgactgcgtgcctcaagccgacgcagcggcctactctcgcactgcagacggggaaactgaggcctgaggcggccggggtggggcagacctcccggcgagcccgagcccccgcccccggctagccccgccctggcccgtaagaagcacccggggcgcgaggcgaaggcgcacagcgcggggccaggctgggtccagcagcgcgatggcagctcagcggctgggcaagcgcgtgctgagcaagctgcagtctccatcgcgggcccgcgggccagggggcagtcccggggggctgcagaagcggcacgcgcgcgtcaccgtcaagtatgaccggcgggagctgcagcggcggctggacgtggagaagtggatcgacgggcgcctggaggagctgtaccgcggcatgggactcctgaagtcatgtgggaaacctgtcgaggacttcatccaggagctgctggcaaagcttcaaggcctccacaggcagcccggcctccgccagccaagcccctcccacgacggcagcctcagccccctccaggaccgggcccggactgctcacccctgaccctcttgcactctccctgccccccggacgccgcccagcttgcttgtgtataagttgtatttaatggttctgtaacaataa

SEQ ID NO: 3341 - DNA, 2382 bp, Homo sapiens
ataaaagcctagtggccattgtgttcgttgctcttatcggttcccatcccagttgttgatcttatgcaagacgctgcacgaccccgcgcccgcttgtcgccacggcacttgaggcagccggagatactctgagttactcggagcccgacgcctgagggtgagatgaacgcgctggcctccctaaccgtccggacctgtgatcgcttctggcagaccgaaccggcgctcctgcccccggggtgacgcgcagctcccagccgcccagacacatggccccaggccaagcaccccatcaggctaccccgtggagggatgcccaccctttcttcctcctgtccccagtgatgggcctcctcagccgcgcctggagccgcctgaggggcctgggacctctagagccctggctggtggaagcagtaaaaggagcagctctggtagaagctggcctggagggagaagctaggactcctctggcaatcccccataccccttggggcagacgccctgaagaggaggctgaagacagtggaggccctggagaggacagagaaacactggggctgaaaaccagcagttcccttcctgaagcctggggacttttggatgatgatgatggcatgtatggtgagcgagaggcaaccagtgtccctagagggcagggaagtcaatttgcagatggccagcgtgctcccctgtctcccagccttctgataaggacactgcaaggttctgataagaacccaggggaggagaaagccgaggaagagggagttgctgaagaggagggagttaacaagttctcttatccaccatcacaccgggagtgttgtccagccgtggaggaggaggacgatgaagaagctgtaaagaaagaagctcacagaacctctacttctgccttgtctccaggatccaagcccagcacttgggtgtcttgcccaggggaggaagagaatcaagccacggaggataaaagaacagaaagaagtaaaggagccaggaagacctccgtgtccccccgatcttcaggctccgaccccaggtcctgggagtatcgttcaggagaggcgtccgaggagaaggaggaaaaggcacacaaagaaactgggaaaggagaagctgccccagggccgcaatcctcagccccagcccagaggccccagctcaagtcctggtggtgccaacccagtgatgaagaggagggtgaggtcaaggctttgggggcagctgagaaggatggagaagctgagtgtcctccctgcatccccccaccaagtgccttcctgaaggcctgggtgtattggccaggagaggacacagaggaagaggaagatgaggaagaagatgaggacagtgactctggatcagatgaggaagagggagaagctgaggcttcctcttccactcctgctacaggtgtcttcttgaagtcctgggtctatcagccaggagaggacacagaggaggaggaagatgaggacagtgatacaggatcagccgaggatgaaagagaagctgagacttctgcttccacaccccctgcaagtgctttcttgaaggcctgggtgtatcggccaggagaggacacggaggaggaggaagatgaggatgtggatagtgaggataaggaagatgattcagaagcagccttgggagaagctgagtcagacccacatccctcccacccggaccagagggcccacttcaggggctggggatatcgacctggaaaagagacagaggaagaggaagctgctgaggactggggagaagctgagccctgccccttccgagtggccatctatgtacctggagagaagccaccgcctccctgggctcctcctaggctgcccctccgactgcaaaggcggctcaagcgcccagaaacccctactcatgatccggaccctgagactcccctaaaggccagaaaggtgcgcttctccgagaaggtcactgtccatttcctggctgtctgggcagggccggcccaggccgcccgccagggcccctgggagcagcttgctcgggatcgcagccgcttcgcacgccgcatcacccaggcccaggaggagctgagcccctgcctcacccctgctgcccgggccagagcctgggcacgcctcaggaacccacctttagcccccatccctgccctcacccagaccttgccttcctcctctgtcccttcgtccccagtccagaccacgcccttgagccaagctgtggccacaccttcccgctcgtctgctgctgcagcggctgccctggacctcagtgggaggcgtggctgagaccaactggtttgcctataatttattaactatttattttttctaagtgtgggtttatataaggaataaagccttttgatttgtagcg

SEQ ID NO: 3342 - DNA, 1667 bp, Homo sapiens
gctcttatcggttcccatcccagttgttgatcttatgaaagccgaggaagagggagttgctgaagaggagggagttaacaagttctcttatccaccatcacaccgggagtgttgtccagccgtggaggaggaggacgatgaagaagctgtaaagaaagaagctcacagaacctctacttctgccttgtctccaggatccaagcccagcacttgggtgtcttgcccaggggaggaagagaatcaagccacggaggataaaagaacagaaagaagtaaaggagccaggaagacctccgtgtccccccgatcttcaggctccgaccccaggtcctgggagtatcgttcaggagaggcgtccgaggagaaggaggaaaaggcacacaaagaaactgggaaaggagaagctgccccagggccgcaatcctcagccccagcccagaggccccagctcaagtcctggtggtgccaacccagtgatgaagaggagggtgaggtcaaggctttgggggcagctgagaaggatggagaagctgagtgtcctccctgcatccccccaccaagtgccttcctgaaggcctgggtgtattggccaggagaggacacagaggaagaggaagatgaggaagaagatgaggacagtgactctggatcagatgaggaagagggagaagctgaggcttcctcttccactcctgctacaggtgtcttcttgaagtcctgggtctatcagccaggagaggacacagaggaggaggaagatgaggacagtgatacaggatcagccgaggatgaaagagaagctgagacttctgcttccacaccccctgcaagtgctttcttgaaggcctgggtgtatcggccaggagaggacacggaggaggaggaagatgaggatgtggatagtgaggataaggaagatgattcagaagcagccttgggagaagctgagtcagacccacatccctcccacccggaccagagggcccacttcaggggctggggatatcgacctggaaaagagacagaggaagaggaagctgctgaggactggggagaagctgagccctgccccttccgagtggccatctatgtacctggagagaagccaccgcctccctgggctcctcctaggctgcccctccgactgcaaaggcggctcaagcgcccagaaacccctactcatgatccggaccctgagactcccctaaaggccagaaaggtgcgcttctccgagaaggtcactgtccatttcctggctgtctgggcagggccggcccaggccgcccgccagggcccctgggagcagcttgctcgggatcgcagccgcttcgcacgccgcatcacccaggcccaggaggagctgagcccctgcctcacccctgctgcccgggccagagcctgggcacgcctcaggaacccacctttagcccccatccctgccctcacccagaccttgccttcctcctctgtcccttcgtccccagtccagaccacgcccttgagccaagctgtggccacaccttcccgctcgtctgctgctgcagcggctgccctggacctcagtgggaggcgtggctgagaccaactggtttgcctataatttattaactatttattttttctaagtgtgggtttatataaggaataaagccttttgatttgtagcg

SEQ ID NO: 3343 - DNA, 2266 bp, Homo sapiens
gctcttatcggttcccatcccagttgttgatcttatgcaagacgctgcacgaccccgcgcccgcttgtcgccacggcacttgaggcagccggagatactctgagttactcggagcccgacgcctgagggtgagatgaacgcgctggcctccctaaccgtccggacctgtgatcgcttctggcagaccgaaccggcgctcctgcccccggggtgacgcgcagctcccagccgcccagacacatggccccaggccaagcaccccatcaggctaccccgtggagggatgccctggctggtggaagcagtaaaaggagcagctctggtagaagctggcctggagggagaagctaggactcctctggcaatcccccataccccttggggcagacgccctgaagaggaggctgaagacagtggaggccctggagaggacagagaaacactggggctgaaaaccagcagttcccttcctgaagcctggggacttttggatgatgatgatggcatgtatggtgagcgagaggcaaccagtgtccctagagggcagggaagtcaatttgcagatggccagcgtgctcccctgtctcccagccttctgataaggacactgcaaggttctgataagaacccaggggaggagaaagccgaggaagagggagttgctgaagaggagggagttaacaagttctcttatccaccatcacaccgggagtgttgtccagccgtggaggaggaggacgatgaagaagctgtaaagaaagaagctcacagaacctctacttctgccttgtctccaggatccaagcccagcacttgggtgtcttgcccaggggaggaagagaatcaagccacggaggataaaagaacagaaagaagtaaaggagccaggaagacctccgtgtccccccgatcttcaggctccgaccccaggtcctgggagtatcgttcaggagaggcgtccgaggagaaggaggaaaaggcacacaaagaaactgggaaaggagaagctgccccagggccgcaatcctcagccccagcccagaggccccagctcaagtcctggtggtgccaacccagtgatgaagaggagggtgaggtcaaggctttgggggcagctgagaaggatggagaagctgagtgtcctccctgcatccccccaccaagtgccttcctgaaggcctgggtgtattggccaggagaggacacagaggaagaggaagatgaggaagaagatgaggacagtgactctggatcagatgaggaagagggagaagctgaggcttcctcttccactcctgctacaggtgtcttcttgaagtcctgggtctatcagccaggagaggacacagaggaggaggaagatgaggacagtgatacaggatcagccgaggatgaaagagaagctgagacttctgcttccacaccccctgcaagtgctttcttgaaggcctgggtgtatcggccaggagaggacacggaggaggaggaagatgaggatgtggatagtgaggataaggaagatgattcagaagcagccttgggagaagctgagtcagacccacatccctcccacccggaccagagggcccacttcaggggctggggatatcgacctggaaaagagacagaggaagaggaagctgctgaggactggggagaagctgagccctgccccttccgagtggccatctatgtacctggagagaagccaccgcctccctgggctcctcctaggctgcccctccgactgcaaaggcggctcaagcgcccagaaacccctactcatgatccggaccctgagactcccctaaaggccagaaaggtgcgcttctccgagaaggtcactgtccatttcctggctgtctgggcagggccggcccaggccgcccgccagggcccctgggagcagcttgctcgggatcgcagccgcttcgcacgccgcatcacccaggcccaggaggagctgagcccctgcctcacccctgctgcccgggccagagcctgggcacgcctcaggaacccacctttagcccccatccctgccctcacccagaccttgccttcctcctctgtcccttcgtccccagtccagaccacgcccttgagccaagctgtggccacaccttcccgctcgtctgctgctgcagcggctgccctggacctcagtgggaggcgtggctgagaccaactggtttgcctataatttattaactatttattttttctaagtgtgggtttatataaggaataaagccttttgatttgt

SEQ ID NO: 3344 - DNA, 1953 bp, Homo sapiens
aaagaacatggcgggcgcatcagagctcgggaccggcccaggagcagcgggtggagatggagatgattcgctatacccgatcgcggttttaatcgacgagctccgcaatgaagacgtgcagctccgactcaacagtattaagaagttatcaacaattgccctagcacttggagtagaaaggacccgaagtgaattgttgccatttcttacagatacaatttatgatgaagatgaggtactattagctcttgctgagcagctgggaaatttcactggcctagtgggaggtcctgactttgcccactgtctgctgcctcctttggaaaatctggcaactgtggaagagactgttgttcgtgacaaggctgtggagtccctgagacagatctcccaggagcatactcctgttgctctggaagcttattttgtacctctggtgaaacgcttagcaagtggggattggttcacctctcgcacatctgcatgtggtttgttcagcgtttgctatcccagggcatcaaatgctgttaaagcagaaatcagacagcaattccgttccttgtgctcagatgacacaccaatggtacgacgtgctgctgcttccaaattgggtgaatttgcaaaagttttggaattagacagtgtgaaaagtgaaattgttccactgttcactagtctagcttcagatgaacaggattcagtgcgcctccttgctgtggaagcttgtgtcagtattgcccagttattgtctcaggatgaccttgagactttggtgatgcctacacttcgacaagcagcagaagataaatcttggcgcgttcgctatatggtggctgacagattttcagagctccagaaagccatgggtcctaaaatcaccctaaatgacctcatccccgcctttcagaacctacttaaagactgtgaagctgaagtccgggcagctgctgcccacaaagtaaaagaacttggtgagaacttgcccattgaagatagagagaccataattatgaatcaaattctgccttatataaagtgtcctgacgttcgtttgaatatcatctccaatttggattgtgtaaatgaagtgattggaatccgtcagctctctcagtctctccttcctgccatagtggagctggcagaagatgccaaatggagggtccgcctggccatcattgagtatatgccgctgctggcaggccagctgggtgtggaattctttgatgaaaagctgaattctttatgtatggcttggctcgtggaccatgtatacgccatccgagaagctgccaccaacaacctcatgaaactagttcagaagtttggtacagagtgggcccaaaatactattgttcccaaagtgttagtaatggcaaatgatcctaattacttgcatagaatgaccactttattctgcattaatgcactgtctgaggcctgtggtcaggaaataactactaagcaaatgctgcccatcgtattaaaaatggcaggagaccaagtagcaaatgttcgcttcaatgtggccaaatctctacaaaagattggaccaattctagataccaatgctttacagggagaagtgaagccagtactacagaagttaggtcaagatgaagacatggatgtcaaatactttgcacaggaagctataagtgttcttgcattggcataatgaggagcaggagggaaaaggcctttactagattcttgtcacaaatttctagtcaatgtgttcttaactgggtggagaaagaatggaaaaccttcaagatctcatccaagcaaatggcaacaacttagaagaaatcatttagtgacttaattctttctaaagatgaaatgggattgttttttactcgtcttccttgttaaatcattatttaagccgttcttattgaccaattcctgacacttgattgtctcctaatgctttatccatcaccacct

SEQ ID NO: 3345 - DNA, 3281 bp, Homo sapiens
ccccccacgtttcagcacagcgctggccgcagtctgacaggaaagggacggagccaagatggcggcggccgacggcgacgactcgctgtaccccatcgcggtgctcatagacgaactccgcaatgaggacgttcagcttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtatatgccatccgcgaggcagccaccagcaacctgaagaagctagtggaaaagtttgggaaggagtgggcccatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacagcaccttgcagagtgaagtcaagcccatcctagagaagctgacccaggaccaggatgtggacgtcaaatactttgcccaggaggctctgactgttctgtctctcgcctgatgctggaagaggagcaaacactggcctctggtgtccaccctccaacccccacaagtccctctttggggagacactggggggcctttggctgtcactccctgtgcatggtctgaccccaggccccttcccccagcacggttcctcctctccccagcctgggaagatgtctcactgtccacctcccaacgggctaggggagcacggggttggacaggacagtgaccttgggaggaaggggctactccgcccacgtcagggagagatgtgagcatcccgggtcactggatcctgctgctgtaatgggaacccctcccccatttacttctccacctcccgtcctccccatcattggtttttttttgtgtgtcaactgtgccgtttttattttattccttttattttcccccttttcacagagaaataaaggtctagaagtagttggtcctctggccttagtcatcagcttggaggagggggcaccaccccagagccacaacatctgcgcttttctctggagaagatcttgttacaggacccattatacccctatgtcccgaaagaatactctggggatccccccaggagtgctgctggcctttggggtagagggtccatgaggtgctctgggtggtgtcctgtagtgcagttcagattcatagatgtcggccgagtatttggggggttaagagcaggtgccttggaaccagactgcctgggtccaaattgtggctccttcagttaatagacgtgtgactaggagtagcttgttaagtctttatgagctcagttttgtattgtgtaaaatgagagttacagtaatacctagattgcagggtgggtggcgaggaccaagtgaattagtacctggaaagtgtgtaacagtttcaacatgagaagtacacaacatgagaagcagagttagctgtacattgccagagaaccccctgtgggccatttcctgtgttcttgaagaagacttgggcttggaccctgtccccaggaggtctcagagtaatcaggacggtactagggagagaactgtggcaagatagatcagttatctcggtatctattctccccttcctaatgtagaagctctgatttttaactgggcagatgactacatggattcaaggtattttcctagtgtctcttgaaattaggtgtggtattgtgaccaaattctagccaaaaagatgttgaacagaagtggtatatgcagcttctaggaagtgttcttaagggggaaggcgtcatcccccacctttcctccttcctgcactctggaatgtggaccagatggctggagtaggagctgccacctggggccagaaaatgatcttaggcgtgaaggtcaagtaaggcaggacaagagagaaggagcctgcctccccgaggctgtgaagagccatgccagtactgtcacctgggagaattaaactggtcaagtgcc

SEQ ID NO: 3346 - DNA, 1896 bp, Homo sapiens
cttctcccagcattgccccccccacgtttcagcacagcgctggccgcagtctgacaggaaagggacggagccaagatggcggcggccgacggcgacgactcgctgtaccccatcgcggtgctcatagacgaactccgcaatgaggacgttcagcttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtatatgccatccgcgaggcagccaccagcaacctgaagaagctagtggaaaagtttgggaaggagtgggcccatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacagcaccttgcagagtgaagtcaagcccatcctagagaagctgacccaggaccaggatgtggacgtcaaatactttgcccaggaggctctgactgttctgtctctcgcctgatgctggaagaggagcaaacactggcctctggtgtccaccctccaacccccacaagtccctctttggggagacactgggggg

SEQ ID NO: 3347 - DNA, 948 bp, Homo sapiens
cagcgctggccgcagtctgacaggaaagggacggagccaagatggcggcggccgacggcgacgactcgctgtaccccatcgcggtgctcatagacgaactccgcaatgaggacgttcagcttcgcctcaacagcaacctgaagaagctagtggaaaagtttgggaaggagtgggcccatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacagcaccttgcagagtgaagtcaagcccatcctagagaagctgacccaggaccaggatgtggacgtcaaatactttgcccaggaggctctgactgttctgtctctcgcctgatgctggaagaggagcaaacactggcctctggtgtccaccctccaacccccacaagtccctctttggggagacactggggggcctttggctgtcactccctgtgcatggtctgaccccaggccccttcccccagcacggttcctcctctccccagcctgggaagatgtctcactgtccacctcccaacgggctaggggagcacggggttggacaggacagtgaccttgggaggaaggggctactccgcccacgtcagggagagatgtgagcatcccgggtcactggatcctgctgctgtaatgggaacccctcccccatttacttctccacctcccgtcctccccatcattggtttttttttgtgtgtcaactgtgccgtttttattttattccttttattttcccccttttcacagagaaataaaggtctagaagt

SEQ ID NO: 3348 - DNA, 1944 bp, Homo sapiens
aggaaagggacggagccaagatggcggcggccgacggcgacgactcgctgtaccccatcgcggtgctcatagacgaactccgcaatgaggacgttcagcttcgcctcaacagcatcaagaagctgtccaccatcgccttggcccttggggttgaaaggacccgaagtgagcttctgcctttccttacagccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtatatgccatccgcgaggcagccaccagcaacctgaagaagctagtggaaaagtttgggaaggagtgggcccatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacagcaccttgcagagtgaagtcaagcccatcctagagaagctgacccaggaccaggatgtggacgtcaaatactttgcccaggaggctctgactgttctgtctctcgcctgatgctggaagaggagcaaacactggcctctggtgtccaccctccaacccccacaagtccctctttggggagacactggggggcctttggctgtcactccctgtgcatggtctgaccccaggccccttcccccagcacggttcctcctctccccagcctgggaagatgtctcactgtccacctcccaacgggctaggggagcacggggttggacaggacagtgaccttgggaggaaggggctactccgcccacgtca

SEQ ID NO: 3349 - DNA, 2082 bp, Homo sapiens
agcagcaggaggagaaagaacatggcgggcgcatcagagctcgggaccggcccaggagcagcgggtggagatggagatgattcgctatacccgatcgcggttttaatcgacgagctccgcaatgaagacgtgcagctccgactcaacagtattaagaagttatcaacaattgccctagcacttggagtagaaaggacccgaagtgaattgttgccatttcttacagatacaatttatgatgaagatgaggtactattagctcttgctgagcagctgggaaatttcactggcctagtgggaggtcctgactttgcccactgtctgctgcctcctttggaaaatctggcaactgtggaagagactgttgttcgtgacaaggctgtggagtccctgagacagatctcccaggagcatactcctgttgctctggaagcttattttgtacctctggtgaaacgcttagcaagtggggattggttcacctctcgcacatctgcatgtggtttgttcagcgtttgctatcccagggcatcaaatgctgttaaagcagaaatcagacagcaattccgttccttgtgctcagatgacacaccaatggtacgacgtgctgctgcttccaaattgggtgaatttgcaaaagttttggaattagacagtgtgaaaagtgaaattgttccactgttcactagtctagcttcagatgaacaggattcagtgcgcctccttgctgtggaagcttgtgtcagtattgcccagttattgtctcaggatgaccttgagactttggtgatgcctacacttcgacaagcagcagaagataaatcttggcgcgttcgctatatggtggctgacagattttcagagctccagaaagccatgggtcctaaaatcaccctaaatgacctcatccccgcctttcagaacctacttaaagactgtgaagctgaagtccgggcagctgctgcccacaaagtaaaagaacttggtgagaacttgcccattgaagatagagagaccataattatgaatcaaattctgccttatataaaggaattagtatccgataccaatcaacatgtcaaatcggctctagcttctgtaattatgggattgtctactattttgggcaaagaaaataccattgaacatcttctacctcttttcttagctcagttaaaggatgagtgtcctgacgttcgtttgaatatcatctccaatttggattgtgtaaatgaagtgattggaatccgtcagctctctcagtctctccttcctgccatagtggagctggcagaagatgccaaatggagggtccgcctggccatcattgagtatatgccgctgctggcaggccagctgggtgtggaattctttgatgaaaagctgaattctttatgtatggcttggctcgtggaccatgtatacgccatccgagaagctgccaccaacaacctcatgaaactagttcagaagtttggtacagagtgggcccaaaatactattgttcccaaagtgttagtaatggcaaatgatcctaattacttgcatagaatgaccactttattctgcattaatgcactgtctgaggcctgtggtcaggaaataactactaagcaaatgctgcccatcgtattaaaaatggcaggagaccaagtagcaaatgttcgcttcaatgtggccaaatctctacaaaagattggaccaattctagataccaatgctttacagggagaagtgaagccagtactacagaagttaggtcaagatgaagacatggatgtcaaatactttgcacaggaagctataagtgtggtggcacaaaggctgaggaagctagaatttcctgtgaaggacagtggagaacccagtgtccctcgggctgacaagaaccacttcccaagacccacagtgcctggagaggacatggggaagggaccagtgtatcagttgcgtggagatactagagacacacttgcccagctgggaattgcagagctagtgcatttctcccaaagcacagactaataccccagatttaaaaaaagaacataaaaaataaagtaccacacatattgcactttt

SEQ ID NO: 3350 - DNA, 1525 bp, Homo sapiens
agcagcaggaggagaaagaacatggcgggcgcatcagagctcgggaccggcccaggagcagcgggtggagatggagatgattcgctatacccgatcgcggttttaatcgacgagctccgcaatgaagacgtgcagctccgactcaacagtattaagaagttatcaacaattgccctagcacttggagtagaaaggacccgaagtgaattgttgccatttcttacagatacaatttatgatgaagatgaggtactattagctcttgctgagcagctgggaaatttcactggcctagtgggaggtcctgactttgcccactgtctgctggattcagtgcgcctccttgctgtggaagcttgtgtcagtattgcccagttattgtctcaggatgaccttgagactttggtgatgcctacacttcgacaagcagcagaagataaatcttggcgcgttcgctatatggtggctgacagattttcagagctccagaaagccatgggtcctaaaatcaccctaaatgacctcatccccgcctttcagaacctacttaaagactgtgaagctgaagtccgggcagctgctgcccacaaagtaaaagaacttggtgagaacttgcccattgaagatagagagaccataattatgaatcaaattctgccttatataaaggaattagtatccgataccaatcaacatgtcaaatcggctctagcttctgtaattatgggattgtctactattttgggcaaagaaaataccattgaacatcttctacctcttttcttagctcagttaaaggatgagtgtcctgacgttcgtttgaatatcatctccaatttggattgtgtaaatgaagtgattggaatccgtcagctctctcagtctctccttcctgccatagtggagctggcagaagatgccaaatggagggtccgcctggccatcattgagtatatgccgctgctggcaggccagctgggtgtggaattctttgatgaaaagctgaattctttatgtatggcttggctcgtggaccatgtatacgccatccgagaagctgccaccaacaacctcatgaaactagttcagaagtttggtacagagtgggcccaaaatactattgttcccaaagtgttagtaatggcaaatgatcctaattacttgcatagaatgaccactttattctgcattaatgcactgtctgaggcctgtggtcaggaaataactactaagcaaatgctgcccatcgtattaaaaatggcaggagaccaagtagcaaatgttcgcttcaatgtggccaaatctctacaaaagattggaccaattctagataccaatgctttacagggagaagtgaagccagtactacagaagttaggtcaagatgaagacatggatgtcaaatactttgcacaggaagctataagtgttcttgcattggcataatgaggagcaggagggaaaaggcctttactagattcttgtcacaaatttctagtcaatgtgttcttaactgggtggagaa

SEQ ID NO: 3351 - DNA, 1762 bp, Homo sapiens
ggccttcgtccctactgcctgggcgcggggcggggcctgggcgcggggcgggaggcggtgaccagcagcaggaggagaaagaacatggcgggcgcatcagagctcgggaccggcccaggagcagcgggtggagatggagatgattcgctatacccgatcgcggttttaatcgacgagctccgcaatgaagacgtgcagctccgactcaacagtattaagaagttatcaacaattgccctagcacttggagtagaaaggacccgaagtgaattgttgccatttcttacagatacaatttatgatgaagatgaggtactattagctcttgctgagcagctgggaaatttcactggcctagtgggaggtcctgactttgcccactgtctgctggattcagtgcgcctccttgctgtggaagcttgtgtcagtattgcccagttattgtctcaggatgaccttgagactttggtgatgcctacacttcgacaagcagcagaagataaatcttggcgcgttcgctatatggtggctgacagattttcagagctccagaaagccatgggtcctaaaatcaccctaaatgacctcatccccgcctttcagaacctacttaaagactgtgaagctgaagtccgggcagctgctgcccacaaagtaaaagaacttggtgagaacttgcccattgaagatagagagaccataattatgaatcaaattctgccttatataaaggaattagtatccgataccaatcaacatgtcaaatcggctctagcttctgtaattatgggattgtctactattttgggcaaagaaaataccattgaacatcttctacctcttttcttagctcagttaaaggatgagtgtcctgacgttcgtttgaatatcatctccaatttggattgtgtaaatgaagtgattggaatccgtcagctctctcagtctctccttcctgccatagtggagctggcagaagatgccaaatggagggtccgcctggccatcattgagtatatgccgctgctggcaggccagctgggtgtggaattctttgatgaaaagctgaattctttatgtatggcttggctcgtggaccatgtatacgccatccgagaagctgccaccaacaacctcatgaaactagttcagaagtttggtacagagtgggcccaaaatactattgttcccaaagtgttagtaatggcaaatgatcctaattacttgcatagaatgaccactttattctgcattaatgcactgtctgaggcctgtggtcaggaaataactactaagcaaatgctgcccatcgtaaaaaatggcaggagaccaagtagcaaatgttcgcttcaatgtggccaaatctctacaaaagattggaccaattctagataccaatgctttacagggagaagtgaagccagtactacagaagttaggtcaagatgaagacatggatgtcaaatactttgcacaggaagctataagtgtggtggcacaaaggctgaggaagctagaatttcctgtgaaggacagtggagaacccagtgtccctcgggctgacaagaaccacttcccaagacccacagtgcctggagaggacatggggaagggaccagtgtatcagttgcgtggagatactagagacacacttgcccagctgggaattgcagagctagtgcatttctcccaaagcacagactaataccccagatttaaaaaaagaacataaaaaataaagtaccacacatattgcactttt

SEQ ID NO: 3352 - DNA, 1888 bp, Homo sapiens
gaccagcagcaggaggagaaagaacatggcgggcgcatcagagctcgggaccggcccaggagcagcgggtggagatggagatgattcgctatacccgatcgcggttttaatcgacgagctccgcaatgaagacgtgcagcctcctttggaaaatctggcaactgtggaagagactgttgttcgtgacaaggctgtggagtccctgagacagatctcccaggagcatactcctgttgctctggaagcttattttgtacctctggtgaaacgcttagcaagtggggattggttcacctctcgcacatctgcatgtggtttgttcagcgtttgctatcccagggcatcaaatgctgttaaagcagaaatcagacagcaattccgttccttgtgctcagatgacacaccaatggtacgacgtgctgctgcttccaaattgggtgaatttgcaaaagttttggaattagacagtgtgaaaagtgaaattgttccactgttcactagtctagcttcagatgaacaggattcagtgcgcctccttgctgtggaagcttgtgtcagtattgcccagttattgtctcaggatgaccttgagactttggtgatgcctacacttcgacaagcagcagaagataaatcttggcgcgttcgctatatggtggctgacagattttcagagctccagaaagccatgggtcctaaaatcaccctaaatgacctcatccccgcctttcagaacctacttaaagactgtgaagctgaagtccgggcagctgctgcccacaaagtaaaagaacttggtgagaacttgcccattgaagatagagagaccataattatgaatcaaattctgccttatataaaggaattagtatccgataccaatcaacatgtcaaatcggctctagcttctgtaattatgggattgtctactattttgggcaaagaaaataccattgaacatcttctacctcttttcttagctcagttaaaggatgagtgtcctgacgttcgtttgaatatcatctccaatttggattgtgtaaatgaagtgattggaatccgtcagctctctcagtctctccttcctgccatagtggagctggcagaagatgccaaatggagggtccgcctggccatcattgagtatatgccgctgctggcaggccagctgggtgtggaattctttgatgaaaagctgaattctttatgtatggcttggctcgtggaccatgtatacgccatccgagaagctgccaccaacaacctcatgaaactagttcagaagtttggtacagagtgggcccaaaatactattgttcccaaagtgttagtaatggcaaatgatcctaattacttgcatagaatgaccactttattctgcattaatgcactgtctgaggcctgtggtcaggaaataactactaagcaaatgctgcccatcgtattaaaaatggcaggagaccaagtagcaaatgttcgcttcaatgtggccaaatctctacaaaagattggaccaattctagataccaatgctttacagggagaagtgaagccagtactacagaagttaggtcaagatgaagacatggatgtcaaatactttgcacaggaagctataagtgtggtggcacaaaggctgaggaagctagaatttcctgtgaaggacagtggagaacccagtgtccctcgggctgacaagaaccacttcccaagacccacagtgcctggagaggacatggggaagggaccagtgtatcagttgcgtggagatactagagacacacttgcccagctgggaattgcagagctagtgcatttctcccaaagcacagactaataccccagatttaaaaaaagaacataaaaaataaagtaccacacatattgc

SEQ ID NO: 3353 - DNA, 2294 bp, Homo sapiens
aaagaacatggcgggcgcatcagagctcgggaccggcccaggagcagcgggtggagatggagatgattcgctatacccgatcgcggttttaatcgacgagctccgcaatgaagacgtgcagctccgactcaacagtattaagaagttatcaacaattgccctagcacttggagtagaaaggacccgaagtgaattgttgccatttcttacagatacaatttatgatgaagatgaggtactattagctcttgctgagcagctgggaaatttcactggcctagtgggaggtcctgactttgcccactgtctgctgacaccatctgggaattgccatctgggacacgagatcttggcttttctacagaagtcgtgtctttgggttggccgcaccatatgttatcactgtgtgagctgaaagtaaccatttggtatgatgcagctaacattctggttacgtgtaccacctcccttcagtcactttaaaaggcaattccgttccttgtgctcagatgacacaccaatggtacgacgtgctgctgcttccaaattgggtgaatttgcaaaagttttggaattagacagtgtgaaaagtgaaattgttccactgttcactagtctagcttcagatgaacaggattcagtgcgcctccttgctgtggaagcttgtgtcagtattgcccagttattgtctcaggatgaccttgagactttggtgatgcctacacttcgacaagcagcagaagataaatcttggcgcgttcgctatatggtggctgacagattttcagagctccagaaagccatgggtcctaaaatcaccctaaatgacctcatccccgcctttcagaacctacttaaagactgtgaagctgaagtccgggcagctgctgcccacaaagtaaaagaacttggtgagaacttgcccattgaagatagagagaccataattatgaatcaaattctgccttatataaaggaattagtatccgataccaatcaacatgtcaaatcggctctagcttctgtaattatgggattgtctactattttgggcaaagaaaataccattgaacatcttctacctcttttcttagctcagttaaaggatgagtgtcctgacgttcgtttgaatatcatctccaatttggattgtgtaaatgaagtgattggaatccgtcagctctctcagtctctccttcctgccatagtggagctggcagaagatgccaaatggagggtccgcctggccatcattgagtatatgccgctgctggcaggccagctgggtgtggaattctttgatgaaaagctgaattctttatgtatggcttggctcgtggaccatgtatacgccatccgagaagctgccaccaacaacctcatgaaactagttcagaagtttggtacagagtgggcccaaaatactattgttcccaaagtgttagtaatggcaaatgatcctaattacttgcatagaatgaccactttattctgcattaatgcactgtctgaggcctgtggtcaggaaataactactaagcaaatgctgcccatcgtattaaaaatggcaggagaccaagtagcaaatgttcgcttcaatgtggccaaatctctacaaaagattggaccaattctagataccaatgctttacagggagaagtgaagccagtactacagaagttaggtcaagatgaagacatggatgtcaaatactttgcacaggaagctataagtgttcttgcattggcataatgaggagcaggagggaaaaggcctttactagattcttgtcacaaatttctagtcaatgtgttcttaactgggtggagaaagaatggaaaaccttcaagatctcatccaagcaaatggcaacaacttagaagaaatcatttagtgacttaattctttctaaagatgaaatgggattgttttttactcgtcttccttgttaaatcattatttaagccgttcttattgaccaattcctgacacttgattgtctcctaatgctttatccatcaccacctgggctcctgcatcctcactgtggaatcaggcaccagccacataatgttccagacaaagcctggaagggtgtggacccagacgtggagtggagtgattctcttgacgtttacatatatctctgtgtctctccatcattccaaagctaaatgtacatgtttagaataacttattttataaactcttcgggagacatgttgagatttgaccgtaatgaaagccacattttcctgaattatgatggtctgcattagtctcatgtgaaagg

SEQ ID NO: 3354 - DNA, 5587 bp, Homo sapiens
ctgggcgcggggcggggcctgggcgcggggcgggaggcggtgaccagcagcaggaggagaaagaacatggcgggcgcatcagagctcgggaccggcccaggagcagcgggtggagatggagatgattcgctatacccgatcgcggttttaatcgacgagctccgcaatgaagacgtgcagctccgactcaacagtattaagaagttatcaacaattgccctagcacttggagtagaaaggacccgaagtgaattgttgccatttcttacagatacaatttatgatgaagatgaggtactattagctcttgctgagcagctgggaaatttcactggcctagtgggaggtcctgactttgcccactgtctgctgcctcctttggaaaatctggcaactgtggaagagactgttgttcgtgacaaggctgtggagtccctgagacagatctcccaggagcatactcctgttgctctggaagcttattttgtacctctggtgaaacgcttagcaagtggggattggttcacctctcgcacatctgcatgtggtttgttcagcgtttgctatcccagggcatcaaatgctgttaaagcagaaatcagacagcaattccgttccttgtgctcagatgacacaccaatggtacgacgtgctgctgcttccaaattgggtgaatttgcaaaagttttggaattagacagtgtgaaaagtgaaattgttccactgttcactagtctagcttcagatgaacaggattcagtgcgcctccttgctgtggaagcttgtgtcagtattgcccagttattgtctcaggatgaccttgagactttggtgatgcctacacttcgacaagcagcagaagataaatcttggcgcgttcgctatatggtggctgacagattttcagagctccagaaagccatgggtcctaaaatcaccctaaatgacctcatccccgcctttcagaacctacttaaagactgtgaagctgaagtccgggcagctgctgcccacaaagtaaaagaacttggtgagaacttgcccattgaagatagagagaccataattatgaatcaaattctgccttatataaaggaattagtatccgataccaatcaacatgtcaaatcggctctagcttctgtaattatgggattgtctactattttgggcaaagaaaataccattgaacatcttctacctcttttcttagctcagttaaaggatgagtgtcctgacgttcgtttgaatatcatctccaatttggattgtgtaaatgaagtgattggaatccgtcagctctctcagtctctccttcctgccatagtggagctggcagaagatgccaaatggagggtccgcctggccatcattgagtatatgccgctgctggcaggccagctgggtgtggaattctttgatgaaaagctgaattctttatgtatggcttggctcgtggaccatgtatacgccatccgagaagctgccaccaacaacctcatgaaactagttcagaagtttggtacagagtgggcccaaaatactattgttcccaaagtgttagtaatggcaaatgatcctaattacttgcatagaatgaccactttattctgcattaatgcactgtctgaggcctgtggtcaggaaataactactaagcaaatgctgcccatcgtattaaaaatggcaggagaccaagtagcaaatgttcgcttcaatgtggccaaatctctacaaaagattggaccaattctagataccaatgctttacagggagaagtgaagccagtactacagaagttaggtcaagatgaagacatggatgtcaaatactttgcacaggaagctataagtgttcttgcattggcataatgaggagcaggagggaaaaggcctttactagattcttgtcacaaatttctagtcaatgtgttcttaactgggtggagaaagaatggaaaaccttcaagatctcatccaagcaaatggcaacaacttagaagaaatcatttagtgacttaattctttctaaagatgaaatgggattgttttttactcgtcttccttgttaaatcattatttaagccgttcttattgaccaattcctgacacttgattgtctcctaatgctttatccatcaccacctgggctcctgcatcctcactgtggaatcaggcaccagccacataatgttccagacaaagcctggaagggtgtggacccagacgtggagtggagtgattctcttgacgtttacatatatctctgtgtctctccatcattccaaagctaaatgtacatgtttagaataacttattttataaactcttcgggagacatgttgagatttgaccgtaatgaaagccacattttcctgaattatgatggtctgcattagtctcatgtgaaaggggaatgtggaagctcagggttaatgtagtggttgttttggtttttatttgctcaattttgtctgtactcatgtcattcagaaacctgaagtgtggctgcatcttgctgctaatgtgtgatgttgacgcctaactgaatttgaacagctcaccactgtgcctacatttaaaaatacttctctctcttttctaaaaagctttaactgtagtgcctcctaataagcagtatgtttgtttcattgtgagattgcagttctgtatttcgaatgagtctaagaaccacagggataatactgtgcagatttcctgttctttacctggctctgcttccagcagtattgacacctagtccttgctgcattgtacagtagcttttcaaactgcagttttattgctaagtttttagtatgggtgatactggagtcttatcatttgaagtgtttgcttttctacttttacagtaaaacctcattaattctgaaatttaagataatgagttaagctgaagagtttactgaagcaaattaatagtgaggaagcctatttgaactacttaaacagtattaaagccctttttaaaaagcacctatttgggatcatttgaggtcaagaattcgagatcagcctgaccaacatggtgaaaccccatctctactaaaaatacaaaaaagttagctgggcgtggtggcacacacctgtagtcccagctactcaggaggctgaggcaggagaattgcttgaacctgggaggtagaggttgcactgagccgagatcgcgccactgcactctagcctgggccatagagcgagagtccatctcaaaaaaaaacaactatttttcacataatcaaactcaccttgtctcatgacttttggttaagggggttttcccatagtttatttttctctcagtgcatcttgctatgaggtttgcttgttacccttttggtttttgaattgttgattttgttcacaacctcttttaaatctaacaagtcctgttctgtttagtgaaggcccaaagactcctctaagactttgtatatttgttacataaaaccaagttttactaaatactttaaaatttgtcctacattcgaaaaatagaaattgtaaatcagaggttatctgtctgcattttaaactgccaaattaccttatagtaagtttctattttatgactttgggccaagaattaagtattttcctaagcacaaatctttttctatattctcattttaatatcttatgctattattctgtaaacattttaattttagtttcatgagtctttattttttgttacctgcaagttatgttcttcttcattgaatttcatatttgagagacatttgtcttcatgaagcagatttgcactggaaccattgctttactctggttggaaatgccattgttttggggacagacttttaaaatgcccttgtgtctcccagtgaggagccctaagcattgacttctctaccctaaaactgtttgagagagggagagtgggccctggctttctcaagcatgggtcgggggttcagcggggcctctgtcttttgtggtgacccctcaggggtttcattgtttccttctgacttaagcaatagagagagaatttgttttggtactcttcagaggaattgtgctttggctcataacttggccatgttctccatgaattagttctcctatttttttttttaactaccttaaacttaagggaaaagttctcctatcttgatttcactggaatataggctttaggagctctgtaaggctggtatttttgtctgttttatcttctactgtatcgccagtgcctggaacagtgtctggtgcacataataggtgctcaataaaaatgtgttcaatggatgaatttctaaaatatcctccaatgtgtgcatggaacaaataatcaaaagaaccagactgtgtcttattctcccactgacagaaagattttcctgctttcaggaaacaagctttatgtggcccttttctggtcccctggcttagactacagttctgtgtggatttgtctgattgcttcagacatgtaatgttgtttttcatccttggcagcttacatcagttgtttgtttgattagaaaaatgaagcagacacacacacacacacacacacacacacacacacacacacacaaacatataacctatgccaataaaaatgtctcagcaacagtggaattcaccttggtgtttctctctgtaatttgtgtggggtttacccctcacaggtttaagagaccaggtcttgtttctctctctgtgctaccaagaagatgtgaacctgaggatgcatcttgtttcataagaaggaaggcaggtgaatatgtggtttctaacgaggtcttgttgaaataacgggctgccctcagctcacagaaataccacagctcagccactgtgatgcagagccccaggggtctttgccagacaacttgtcctgactcaacagagacggcagcctgacctttgagctggcttgtccaggcattcaggttgcttgcgtagacttccagggaagcaagcctgtccttcctgacccggcggttaacctggtgcacttttgttcctttgttaactgttgtgttgtcactaaactgaaaggctggggcttgcccttagacgtcacattggctctgtccctgtggcgatggcagggcagggtggccaaacaggtcaggtgcttgttctgtcctcttgccttttacttaaattcctctgacttttaaaaatggtgacactcttatcgtaaagcttcttatttttctccactgcttggatatgaaactgtagagggagaggccctgttgcccagtgttctcctggtttagcagctgaggtgactgcagtctgatgtgatgtaactgtttccctttgattctccagtattcctgtttccatccagttccttactctcctctttcctcttccctcgcatgtctccctccagtcctctgtacctagaatagtctcactgtcccccgtttgcctccacgagcctgctgtttccaggaaattacataacgttcagttgggatggaaatcttccggaggacgaatagagtttaattactcattgcgtcggaaagccaagccatttctgtctccagagttgttctcttaaactgatatgagttct

SEQ ID NO: 3355 - DNA, 553 bp, Homo sapiens
acctctctagtaaccttgcttcggaccccctgaggcgtccgcccggagccttgcccttcccgggcggttgtcggggaacccgcttcccgcctgggcgccccatccgggccgtgaggtggccgcgtctcttgggcgagggagcaggagaagcgcggtgccaggccgagacggggctggagcggctgaggggcgcaggatgcccagaagccctttgaagtgcccctggatcccttcatctcggcttggaactggctcggcttgttggctccgactcaacagtattaagaagttatcaacaattgccctagcacttggagtagaaaggacccgaagtgaattgttgccatttcttacagatacaatttatgatgaagatgaggtactattagctcttgctgagcagctgggaaatttcactggcctagtgggaggtcctgactttgcccactgtctgctgcctcctttggaaaatctggcaactgtggaagagactgttgttcgtgacaaggctgtggagtccctgagacagatctcccaggagcatactcctgtt

SEQ ID NO: 3356 - DNA, 670 bp, Homo sapiens
gaacctacttaaagactgtgaagctgaagtccgggcagctgctgcccacaaagtaaaagaacttggtgagaacttgcccattgaagatagagagaccataattatgaatcaaattctgccttatataaaggaattagtatccgataccaatcaacatgtcaaatcggctctagcttctgtaattatgggattgtctactattttgggcaaagaaaataccattgaacatcttctacctcttttcttagctcagttaaaggatgagtgtcctgacgttcgtttgaatatcatctccaatttggattgtgtaaatgaagtgattggaatccgtcagctctctcagtctctccttcctgccatagtggagctggcagaagatgccaaatggagggtccgcctggccatcattgagtatatgccgctgctggcaggccagctggcactgtctgaggcctgtggtcaggaaataactactaagcaaatgctgcccatcgtattaaaaatggcaggagaccaagtagcaaatgttcgcttcaatgtggccaaatctctacaaaagattggaccaattctagataccaatgctttacagggagaagtgaagccagtactacagaagttaggtcaagatgaagacatggatgtcaaatactttgcacaggaagctata

SEQ ID NO: 3357 - DNA, 2094 bp, Homo sapiens
agcggtcgcggtcggtgccgaagcggtgttccccgccttagccgctggcgcctcccaagagagcggccggtgggccctcgtcctgtcagtggcgtcggaggccggcgctgcggtggccgcgcccttctggtgctcggacaccgctgaggagccggggccgggcacggctggctgacggctccgggcagctaaggctgcccgaggagaaggcggcggccgcggcgtaggcgcacgtccggcgggctcctggagcctggaggaggccgaggggaccatgtccgggaggcgcttccacctctccaccaccgaccgcgtcatcaaagctgtcccctttcctccaacccaacggcttactttcaaggaagtatttgagaatgggaaacctaaagttgatgttttaaaaaaccatttggtaaaggaaggacgactggaagaggaagtagccttaaagataatcaatgatggggctgccatcctgaggcaagagaagactatgatagaagtagatgctccaatcacagtatgtggtgatattcatggacaattctttgacctaatgaagttatttgaagttggaggatcacctagtaacacacgctacctctttctgggtgactatgtggacagaggctatttcagtatagagtgtgtgctgtatttatggagtttaaagattaatcatcccaaaacattgtttctgcttcggggaaatcatgaatgcaggcatcttacagactatttcaccttcaaacaggaatgtcgaatcaaatattcggaacaggtgtatgatgcctgtatggagacatttgactgtcttcctcttgctgccctcttaaaccagcagtttctctgtgtacatggaggaatgtcacctgaaattacttctttagatgacattaggaaattagacaggtttacggaacctcccgcctttggacctgtgtgtgacctgctttggtctgatccctcagaggattatggcaatgagaagaccttggagcactatacccacaacactgtccgagggtgctcttatttctacagttaccctgcagtttgtgaatttttgcagaacaataatttactatcaattatcagagcccatgaagcccaagatgctgggtatcgaatgtacaggaagagccaagccacaggctttccatcacttattacaattttctctgcccccaattacctagatgtctataacaataaagctgctgtgttgaaatatgaaaacaatgtcatgaatatcaggcagtttaactgttctccacacccctactggcttccaaactttatggatgttttcacatggtctttgccttttgttggggaaaaagtcacagagatgctggtaaatgtgctcaacatatgctctgatgacgaactgatttctgatgatgaagcagaagatcactacattccaagctatcagaaaggaagcactacagttcgtaaggagatcatcaggaataagatcagagccattgggaagatggcacgggtcttttcaattcttcggcaagaaagtgagagtgtgctgactctcaagggcctgactcccacaggcacactccctctgggcgtcctctcaggaggcaagcagactatcgagacagccacagtagaagcggtagaggcccgggaagccatcagagggttctcgcttcagcacaagatccggagttttgaagaagcgcgaggtctggaccgaattaatgagcgaatgccaccccgaaaggatagcatacacgctggtgggccaatgaaatctgtaacctcagcacactcacatgctgcgcacaggagcgaccaagggaagaaagcccattcatgacttagagtcctgccgtggctcaggtggatctaaaactcaagaacaaattctatttatttattattggaaaatgaaaagcaactcaaaacaacttcaacgtggaggtgcatttataattcagtctgcatttattctgtaaaaaggtggctgttttataaattcttttaatttatgttcaatatatataaaaagtgcatctgttttgtttttcccttttttctccataattttaagaaatgaatctgattgttgtc

SEQ ID NO: 3358 - DNA, 4519 bp, Homo sapiens
aggagcggcgcggggaggcagaggcgagcgcgggcgatcgcggcggcgggacgtctccggcggccgcggcaccagcggcggcgctctgtgtggagaagcaggggcagcggcagcagcaacagcggcagcggcagcagcagcggcagcagcggcggccgcctctccgccgccggggacgccaaggtgcggctggtggcactgacatcggcggccctgcctctcctccctcgcccccggccttccccatgtgatcggtcttaatcctggccgtgtgtgcgcgcgtggggctccattccgcggtgctgggtctccgtgccggggtgggtgctcgtgtgtgcgcttctcctccccatcccccttcccccaagaataaaagaagaaccgggaggcgtgctcagaaaataaataaataaccaccacacacgcgcagcccggagcgagtcggcggggctggcggcagcggcggaggaggagtgaaggcggcggcggcggaggagggacgcgcggaaaaggcagcaactttaaagccagctcagagcctagacctccagccgagcggtttgcagcgcggcggcggcggcggcggcggcggcgttgagtgtctggcccgccggtccggtcggggtgtgcagtcggacggacgagcagcgcgtcgctgtcctccggcagctggagatgtccgagcccaaggcaattgatcccaagttgtcgacgaccgacagggtggtgaaagctgttccatttcctccaagtcaccggcttacagcaaaagaagtgtttgataatgatggaaaacctcgtgtggatatcttaaaggcgcatcttatgaaggagggaaggctggaagagagtgttgcattgagaataataacagagggtgcatcaattcttcgacaggaaaaaaatttgctggatattgatgcgccagtcactgtttgtggggacattcatggacaattctttgatttgatgaagctctttgaagtcgggggatctcctgccaacactcgctacctcttcttaggggactatgttgacagagggtacttcagtattgaatgtgtgctgtatttgtgggccttgaaaattctctaccccaaaacactgtttttacttcgtggaaatcatgaatgtagacatctaacagagtatttcacatttaaacaagaatgtaaaataaagtattcagaacgcgtatatgatgcctgtatggatgcctttgactgccttcccctggctgccctgatgaaccaacagttcctgtgtgtgcatggtggtttgtctccagagattaacactttagatgatatcagaaaattagaccgattcaaagaaccacctgcatatggacctatgtgtgatatcctgtggtcagaccccctggaagattttggaaatgagaagactcaggaacatttcactcacaacacagtcagggggtgttcatacttctacagttacccggctgtatgtgaattcttacagcacaataacttgttatctatactccgagcccacgaagcccaagatgcagggtaccgcatgtacaggaaaagccaaacaacaggcttcccttctctaattacaattttttcagcaccaaattacttagatgtatacaataacaaagtgactgagatgctggtaaatgtcctcaacatctgctcagatgatgaactagggtcagaagaagatggatttgatggtgcaacagctgcagcccggaaagaggtgataaggaacaagatccgagcaataggcaaaatggccagagtgttctcagtgctcagagaagagagtgagagtgtgctgacgctgaaaggcttgaccccaactggcatgctccccagcggagtactttctggagggaagcaaaccctgcaaagcgctatcaaaggattttcaccacaacataagatcactagcttcgaggaagccaagggcttagaccgaattaatgagaggatgccgcctcgcagagatgccatgccctctgacgccaaccttaactccatcaacaaggctctcacctcagagactaacggcacggacagcaatggcagtaatagcagcaatattcagtgaccacttcctgttcactttttttttttttttttttttttttttttgagctgcggggcatgatggggattgctgcatatcagcagttggatgttcttgcctctgacagtagcttatttgctctgggggccaggaattggattcagtttacactatcattaaaaaagagggagagagataataaactatattttggtggggatggtgattaaacacctcttttgggtatgccttttaaaaatgcttatagagaaaaaaaattttaaaaagaaagctaatgctagtatatactgcaatgttaggggaatgaacatgttttcctactgcattggggacttctagataggttaatgaaaggccttttattctgttactggacatgaaaactttgtctaatttcttactctattgtacgtttacagtcgcagcactaaaaatggatgacatcaaacatttttaacaaaatgatgtacaaactaaggactatttattgataatgttttgctactcttgtcagacaatggctataaactgaattaggcagtcttaaaaaaaaaaaaaaacagaaaaagaaaaaaaagaacgttgcaaatttgttaaaatgccaaaaaggacagtttaattttgtacagattatgcttacctcaggtttctttagtgtgcttgaatgcccttctttccatataacacttatcttcttcttaattcggcaatggaatatcttttaagttttaaaaaaactggaataattatatctatcttttttgccgtttatatttaggggtttttgttgataaaatcaagtcttggttgtggcttgctgaattaaatatttatgagtggtgcatttttaagtatagtgaacaagacaccatattaagtacagtgataaagcatctatattctgtaaaaaaaaaaaaaatctgcctatgcatgttttttaagaaaaaaaaaatggctgtatcggcctgtatgggactgtaatgcgcttagtggtctgacatatactggaaatgtatgtatactggcgtactttatattctctaaaatgcttaatgcctttgaaattttgtaatcaaaaaaaagctttgaaaaaatctaaaggggagagtattctttaaagtttttaacataagcttgtcaatgcacatgtagatggttagcatgtttagcaaaccttgtgaaattataataagtttgtagttacatgtgaaactctaaatgcatggcaactgttaatgtcataacagtttagttattttgttctgttctgtcatgtgccacaaaatatgtacttttttcacttttttccctttgtatatcagttacgggttacaactggttcattctgaaaacaacaacaacaaaagtccattcatattttttaacaattgtataagtgcccaagtaattcactacagcctaaagccttgcctttgtaatttgacttctgacatgttggcaatcaaagcatgcacttgtaacaatgaaaaagaaaaagcattttatattactactcaataaaatgtgcatgaacttacagaattctcatccttccactgagtccgctgaagggatttatgtgcacaaccaccatgtgtcttctaggtgctggcccaccaccacacatcacaggctgatttccacaggcttcttcctaggggcctcgtgatctgaggggtggtgcctacttccactgtaagaaagaatcttggtggatttgtgtctcaaatcagataagagaagcctgtttaaagagcagatgccatcttctggcttcctcaaggagccagttaaaaaaccagagcattcctttttattgaaaaataaaattaatttgttatcaggttgtttcagttgtattggatgccctatctatctgctaaagcaaaaagtactaggctactaagtgcattttcatcacagaaaagagttgcatttgtattaacaagaaatttgtatacccacgcttcagctactatctaatcatcacccgaagatttaagatacaccaaatttcagtttgtttgtaacattgttcatctttagtgcactttgttttatataataaagtatgcctgttatattaaataataagaatatggcaattagcgatatagcatacccaaacaaagatgttctcgatacagtctggcaaagactatcccaaggttattttaatgaattcagacattttttcctgtggatatttctccatcctaaaaaaagtggcaaccaaggaaaatatttagatgcaacttactagagtgatgatgtgaaagaaatggtgattctggtatcatggtgtttattttctttcttataactgcagagaaaatatcctgactaaaaaaaattcatttttttggattcctttcttttacaaattgtgctgaggcaactatggcatagaaataaacatttgacattaaaataa

SEQ ID NO: 3359 - DNA, 3604 bp, Homo sapiens
agcagcggcggccgcctctccgccgccggggacgccaaggtgcggctggtggcactgacatcggcggccctgcctctcctccctcgcccccggccttccccatgtgatcggtcttaatcctggccgtgtgtgcgcgcgtggggctccattccgcggtgctgggtctccgtgccggggtgggtgctcgtgtgtgcgcttctcctccccatcccccttcccccaagaataaaagaagaaccgggaggcgtgctcagaaaataaataaataaccaccacacacgcgcagcccggagcgagtcggcggggctggcggcagcggcggaggaggagtgaaggcggcggcggcggaggagggacgcgcggaaaaggcagcaactttaaagccagctcagagcctagacctccagccgagcggtttgcagcgcggcggcggcggcggcggcggcggcgttgagtgtctggcccgccggtccggtcggggtgtgcagtcggacggacgagcagcgcgtcgctgtcctccggcagctggagatgtccgagcccaaggcaattgatcccaagttgtcgacgaccgacagggtggtgaaagctgttccatttcctccaagtcaccggcttacagcaaaagaagtgtttgataatgatggaaaacctcgtgtggatatcttaaaggcgcatcttatgaaggagggaaggctggaagagagtgttgcattgagaataataacagagggtgcatcaattcttcgacaggaaaaaaatttgctggatattgatgcgccagtcactgtttgtggggacattcatggacaattctttgatttgatgaagctctttgaagtcgggggatctcctgccaacactcgctacctcttcttaggggactatgttgacagagggtacttcagtattgaatgtgtgctgtatttgtgggccttgaaaattctctaccccaaaacactgtttttacttcgtggaaatcatgaatgtagacatctaacagagtatttcacatttaaacaagaatgtaaaataaagtattcagaacgcgtatatgatgcctgtatggatgcctttgactgccttcccctggctgccctgatgaaccaacagttcctgtgtgtgcatggtggtttgtctccagagattaacactttagatgatatcagaaaattagaccgattcaaagaaccacctgcatatggacctatgtgtgatatcctgtggtcagaccccctggaagattttggaaatgagaagactcaggaacatttcactcacaacacagtcagggggtgttcatacttctacagttacccggctgtatgtgaattcttacagcacaataacttgttatctatactccgagcccacgaagcccaagatgcagggtaccgcatgtacaggaaaagccaaacaacaggcttcccttctctaattacaattttttcagcaccaaattacttagatgtatacaataacaaagctgcagtattgaagtatgagaacaatgttatgaatatcaggcaattcaactgttctcctcatccatactggcttccaaatttcatggatgtttttacttggtcccttccatttgttggggaaaaagtgactgagatgctggtaaatgtcctcaacatctgctcagatgatgaactagggtcagaagaagatggatttgatggtgcaacagctgcagcccggaaagaggtgataaggaacaagatccgagcaataggcaaaatggccagagtgttctcagtgctcagagaagagagtgagagtgtgctgacgctgaaaggcttgaccccaactggcatgctccccagcggagtactttctggagggaagcaaaccctgcaaagcgctatcaaaggattttcaccacaacataagatcactagcttcgaggaagccaagggcttagaccgaattaatgagaggatgccgcctcgcagagatgccatgccctctgacgccaaccttaactccatcaacaaggctctcacctcagagactaacggcacggacagcaatggcagtaatagcagcaatattcagtgaccacttcctgttcactttttttttttttttttttttttttttttgagctgcggggcatgatggggattgctgcatatcagcagttggatgttcttgcctctgacagtagcttatttgctctgggggccaggaattggattcagtttacactatcattaaaaaagagggagagagataataaactatattttggtggggatggtgattaaacacctcttttgggtatgccttttaaaaatgcttatagagaaaaaaaattttaaaaagaaagctaatgctagtatatactgcaatgttaggggaatgaacatgttttcctactgcattggggacttctagataggttaatgaaaggccttttattctgttactggacatgaaaactttgtctaatttcttactctattgtacgtttacagtcgcagcactaaaaatggatgacatcaaacatttttaacaaaatgatgtacaaactaaggactatttattgataatgttttgctactcttgtcagacaatggctataaactgaattaggcagtcttaaaaaaaaaaaaaaacagaaaaagaaaaaaaagaacgttgcaaatttgttaaaatgccaaaaaggacagtttaattttgtacagattatgcttacctcaggtttctttagtgtgcttgaatgcccttctttccatataacacttatcttcttcttaattcggcaatggaatatcttttaagttttaaaaaaactggaataattatatctatcttttttgccgtttatatttaggggtttttgttgataaaatcaagtcttggttgtggcttgctgaattaaatatttatgagtggtgcatttttaagtatagtgaacaagacaccatattaagtacagtgataaagcatctatattctgtaaaaaaaaaaaaaatctgcctatgcatgttttttaagaaaaaaaaaatggctgtatcggcctgtatgggactgtaatgcgcttagtggtctgacatatactggaaatgtatgtatactggcgtactttatattctctaaaatgcttaatgcctttgaaattttgtaatcaaaaaaaagctttgaaaaaatctaaaggggagagtattctttaaagtttttaacataagcttgtcaatgcacatgtagatggttagcatgtttagcaaaccttgtgaaattataataagtttgtagttacatgtgaaactctaaatgcatggcaactgttaatgtcataacagtttagttattttgttctgttctgtcatgtgccacaaaatatgtacttttttcacttttttccctttgtatatcagttacgggttacaactggttcattctgaaaacaacaacaacaaaagtccattcatattttttaacaattgtataagtgcccaagtaattcactacagcctaaagccttgcctttgtaatttgacttctgacatgttggcaatcaaagcatgcacttgtaacaatgaaaaagaaaaagcattttatattactactcaataaaatgtgcatgaactta

SEQ ID NO: 3360 - DNA, 4685 bp, Homo sapiens
ggtgagtggaggagcggcgcggggaggcagaggcgagcgcgggcgatcgcggcggcgggacgtctccggcggccgcggcaccagcggcggcgctctgtgtggagaagcaggggcagcggcagcagcaacagcggcagcggcagcagcagcggcagcagcggcggccgcctctccgccgccggggacgccaaggtgcggctggtggcactgacatcggcggccctgcctctcctccctcgcccccggccttccccatgtgatcggtcttaatcctggccgtgtgtgcgcgcgtggggctccattccgcggtgctgggtctccgtgccggggtgggtgctcgtgtgtgcgcttctcctccccatcccccttcccccaagaataaaagaagaaccgggaggcgtgctcagaaaataaataaataaccaccacacacgcgcagcccggagcgagtcggcggggctggcggcagcggcggaggaggagtgaaggcggcggcggcggaggagggacgcgcggaaaaggcagcaactttaaagccagctcagagcctagacctccagccgagcggtttgcagcgcggcggcggcggcggcggcggcggcgttgagtgtctggcccgccggtccggtcggggtgtgcagtcggacggacgagcagcgcgtcgctgtcctccggcagctggagatgtccgagcccaaggcaattgatcccaagttgtcgacgaccgacagggtggtgaaagctgttccatttcctccaagtcaccggcttacagcaaaagaagtgtttgataatgatggaaaacctcgtgtggatatcttaaaggcgcatcttatgaaggagggaaggctggaagagagtgttgcattgagaataataacagagggtgcatcaattcttcgacaggaaaaaaatttgctggatattgatgcgccagtcactgtttgtggggacattcatggacaattctttgatttgatgaagctctttgaagtcgggggatctcctgccaacactcgctacctcttcttaggggactatgttgacagagggtacttcagtattgaatgtgtgctgtatttgtgggccttgaaaattctctaccccaaaacactgtttttacttcgtggaaatcatgaatgtagacatctaacagagtatttcacatttaaacaagaatgtaaaataaagtattcagaacgcgtatatgatgcctgtatggatgcctttgactgccttcccctggctgccctgatgaaccaacagttcctgtgtgtgcatggtggtttgtctccagagattaacactttagatgatatcagaaaattagaccgattcaaagaaccacctgcatatggacctatgtgtgatatcctgtggtcagaccccctggaagattttggaaatgagaagactcaggaacatttcactcacaacacagtcagggggtgttcatacttctacagttacccggctgtatgtgaattcttacagcacaataacttgttatctatactccgagcccacgaagcccaagatgcagggtaccgcatgtacaggaaaagccaaacaacaggcttcccttctctaattacaattttttcagcaccaaattacttagatgtatacaataacaaagctgcagtattgaagtatgagaacaatgttatgaatatcaggcaattcaactgttctcctcatccatactggcttccaaatttcatggatgtttttacttggtcccttccatttgttggggaaaaagtgactgagatgctggtaaatgtcctcaacatctgctcagatgatgaactagggtcagaagaagatggatttgatggtgcaacagctgcagcccggaaagaggtgataaggaacaagatccgagcaataggcaaaatggccagagtgttctcagtgctcagagaagagagtgagagtgtgctgacgctgaaaggcttgaccccaactggcatgctccccagcggagtactttctggagggaagcaaaccctgcaaagcgctactgttgaggctattgaggctgatgaagctatcaaaggattttcaccacaacataagatcactagcttcgaggaagccaagggcttagaccgaattaatgagaggatgccgcctcgcagagatgccatgccctctgacgccaaccttaactccatcaacaaggctctcacctcagagactaacggcacggacagcaatggcagtaatagcagcaatattcagtgaccacttcctgttcactttttttttttttttttttttttttttttgagctgcggggcatgatggggattgctgcatatcagcagttggatgttcttgcctctgacagtagcttatttgctctgggggccaggaattggattcagtttacactatcattaaaaaagagggagagagataataaactatattttggtggggatggtgattaaacacctcttttgggtatgccttttaaaaatgcttatagagaaaaaaaattttaaaaagaaagctaatgctagtatatactgcaatgttaggggaatgaacatgttttcctactgcattggggacttctagataggttaatgaaaggccttttattctgttactggacatgaaaactttgtctaatttcttactctattgtacgtttacagtcgcagcactaaaaatggatgacatcaaacatttttaacaaaatgatgtacaaactaaggactatttattgataatgttttgctactcttgtcagacaatggctataaactgaattaggcagtcttaaaaaaaaaaaaaaacagaaaaagaaaaaaaagaacgttgcaaatttgttaaaatgccaaaaaggacagtttaattttgtacagattatgcttacctcaggtttctttagtgtgcttgaatgcccttctttccatataacacttatcttcttcttaattcggcaatggaatatcttttaagttttaaaaaaactggaataattatatctatcttttttgccgtttatatttaggggtttttgttgataaaatcaagtcttggttgtggcttgctgaattaaatatttatgagtggtgcatttttaagtatagtgaacaagacaccatattaagtacagtgataaagcatctatattctgtaaaaaaaaaaaaaatctgcctatgcatgttttttaagaaaaaaaaaatggctgtatcggcctgtatgggactgtaatgcgcttagtggtctgacatatactggaaatgtatgtatactggcgtactttatattctctaaaatgcttaatgcctttgaaattttgtaatcaaaaaaaagctttgaaaaaatctaaaggggagagtattctttaaagtttttaacataagcttgtcaatgcacatgtagatggttagcatgtttagcaaaccttgtgaaattataataagtttgtagttacatgtgaaactctaaatgcatggcaactgttaatgtcataacagtttagttattttgttctgttctgtcatgtgccacaaaatatgtacttttttcacttttttccctttgtatatcagttacgggttacaactggttcattctgaaaacaacaacaacaaaagtccattcatattttttaacaattgtataagtgcccaagtaattcactacagcctaaagccttgcctttgtaatttgacttctgacatgttggcaatcaaagcatgcacttgtaacaatgaaaaagaaaaagcattttatattactactcaataaaatgtgcatgaacttacagaattctcatccttccactgagtccgctgaagggatttatgtgcacaaccaccatgtgtcttctaggtgctggcccaccaccacacatcacaggctgatttccacaggcttcttcctaggggcctcgtgatctgaggggtggtgcctacttccactgtaagaaagaatcttggtggatttgtgtctcaaatcagataagagaagcctgtttaaagagcagatgccatcttctggcttcctcaaggagccagttaaaaaaccagagcattcctttttattgaaaaataaaattaatttgttatcaggttgtttcagttgtattggatgccctatctatctgctaaagcaaaaagtactaggctactaagtgcattttcatcacagaaaagagttgcatttgtattaacaagaaatttgtatacccacgcttcagctactatctaatcatcacccgaagatttaagatacaccaaatttcagtttgtttgtaacattgttcatctttagtgcactttgttttatataataaagtatgcctgttatattaaataataagaatatggcaattagcgatatagcatacccaaacaaagatgttctcgatacagtctggcaaagactatcccaaggttattttaatgaattcagacattttttcctgtggatatttctccatcctaaaaaaagtggcaaccaaggaaaatatttagatgcaacttactagagtgatgatgtgaaagaaatggtgattctggtatcatggtgtttattttctttcttataactgcagagaaaatatcctgactaaaaaaaattcatttttttggattcctttcttttacaaattgtgctgaggcaactatggcatagaaataaacatttgacattaaaataag

SEQ ID NO: 3361 - DNA, 1958 bp, Homo sapiens
cagtcggacggacgagcagcgcgtcgctgtcctccggcagctggagatgtccgagcccaaggcaattgatcccaagttgtcgacgaccgacagggtggtgaaagtttgtggggacattcatggacaattctttgatttgatgaagctctttgaagtcgggggatctcctgccaacactcgctacctcttcttaggggactatgttgacagagggtacttcagtattgaatgtgtgctgtatttgtgggccttgaaaattctctaccccaaaacactgtttttacttcgtggaaatcatgaatgtagacatctaacagagtatttcacatttaaacaagaatgtaaaataaagtattcagaacgcgtatatgatgcctgtatggatgcctttgactgccttcccctggctgccctgatgaaccaacagttcctgtgtgtgcatggtggtttgtctccagagattaacactttagatgatatcagaaaattagaccgattcaaagaaccacctgcatatggacctatgtgtgatatcctgtggtcagaccccctggaagattttggaaatgagaagactcaggaacatttcactcacaacacagtcagggggtgttcatacttctacagttacccggctgtatgtgaattcttacagcacaataacttgttatctatactccgagcccacgaagcccaagatgcagggtaccgcatgtacaggaaaagccaaacaacaggcttcccttctctaattacaattttttcagcaccaaattacttagatgtatacaataacaaagctgcagtattgaagtatgagaacaatgttatgaatatcaggcaattcaactgttctcctcatccatactggcttccaaatttcatggatgtttttacttggtcccttccatttgttggggaaaaagtgactgagatgctggtaaatgtcctcaacatctgctcagatgatgaactagggtcagaagaagatggatttgatggtgcaacagctgcagcccggaaagaggtgataaggaacaagatccgagcaataggcaaaatggccagagtgttctcagtgctcagagaagagagtgagagtgtgctgacgctgaaaggcttgaccccaactggcatgctccccagcggagtactttctggagggaagcaaaccctgcaaagcgctactgttgaggctattgaggctgatgaagctatcaaaggattttcaccacaacataagatcactagcttcgaggaagccaagggcttagaccgaattaatgagaggatgccgcctcgcagagatgccatgccctctgacgccaaccttaactccatcaacaaggctctcacctcagagactaacggcacggacagcaatggcagtaatagcagcaatattcagtgaccacttcctgttcactttttttttttttttttttttttttttttgagctgcggggcatgatggggattgctgcatatcagcagttggatgttcttgcctctgacagtagcttatttgctctgggggccaggaattggattcagtttacactatcattaaaaaagagggagagagataataaactatattttggtggggatggtgattaaacacctcttttgggtatgccttttaaaaatgcttatagagaaaaaaaattttaaaaagaaagctaatgctagtatatactgcaatgttaggggaatgaacatgttttcctactgcattggggacttctagataggttaatgaaaggccttttattctgttactggacatgaaaactttgtctaatttcttactctattgtacgtttacagtcgcagcactaaaaatggatgacatcaaacatttttaacaaaatgatgtacaaactaaggactatttattgataatgttttgctactcttgtcagacaatggctataaactgaattaggcagtcttaa

SEQ ID NO: 3362 - DNA, 4007 bp, Homo sapiens
gagtggaggagcggcgcggggaggcagaggcgagcgcgggcgatcgcggcggcgggacgtctccggcggccgcggcaccagcggcggcgctctgtgtggagaagcaggggcagcggcagcagcaacagcggcagcggcagcagcagcggcagcagcggcggccgcctctccgccgccggggacgccaaggtgcggctggtggcactgacatcggcggccctgcctctcctccctcgcccccggccttccccatgtgatcggtcttaatcctggccgtgtgtgcgcgcgtggggctccattccgcggtgctgggtctccgtgccggggtgggtgctcgtgtgtgcgcttctcctccccatcccccttcccccaagaataaaagaagaaccgggaggcgtgctcagaaaataaataaataaccaccacacacgcgcagcccggagcgagtcggcggggctggcggcagcggcggaggaggagtgaaggcggcggcggcggaggagggacgcgcggaaaaggcagcaactttaaagccagctcagagcctagacctccagccgagcggtttgcagcgcggcggcggcggcggcggcggcggcgttgagtgtctggcccgccggtccggtcggggtgtgcagtcggacggacgagcagcgcgtcgctgtcctccggcagctggagatgtccgagcccaaggcaattgatcccaagttgtcgacgaccgacagggtggtgaaagctgttccatttcctccaagtcaccggcttacagcaaaagaagtgtttgataatgatggaaaacctcgtgtggatatcttaaaggcgcatcttatgaaggagggaaggctggaagagagtgttgcattgagaataataacagagggtgcatcaattcttcgacaggaaaaaaatttgctggatattgatgcgccagtcactgctgcagtattgaagtatgagaacaatgttatgaatatcaggcaattcaactgttctcctcatccatactggcttccaaatttcatggatgtttttacttggtcccttccatttgttggggaaaaagtgactgagatgctggtaaatgtcctcaacatctgctcagatgatgaactagggtcagaagaagatggatttgatggtgcaacagctgcagcccggaaagaggtgataaggaacaagatccgagcaataggcaaaatggccagagtgttctcagtgctcagagaagagagtgagagtgtgctgacgctgaaaggcttgaccccaactggcatgctccccagcggagtactttctggagggaagcaaaccctgcaaagcgctactgttgaggctattgaggctgatgaagctatcaaaggattttcaccacaacataagatcactagcttcgaggaagccaagggcttagaccgaattaatgagaggatgccgcctcgcagagatgccatgccctctgacgccaaccttaactccatcaacaaggctctcacctcagagactaacggcacggacagcaatggcagtaatagcagcaatattcagtgaccacttcctgttcactttttttttttttttttttttttttttttgagctgcggggcatgatggggattgctgcatatcagcagttggatgttcttgcctctgacagtagcttatttgctctgggggccaggaattggattcagtttacactatcattaaaaaagagggagagagataataaactatattttggtggggatggtgattaaacacctcttttgggtatgccttttaaaaatgcttatagagaaaaaaaattttaaaaagaaagctaatgctagtatatactgcaatgttaggggaatgaacatgttttcctactgcattggggacttctagataggttaatgaaaggccttttattctgttactggacatgaaaactttgtctaatttcttactctattgtacgtttacagtcgcagcactaaaaatggatgacatcaaacatttttaacaaaatgatgtacaaactaaggactatttattgataatgttttgctactcttgtcagacaatggctataaactgaattaggcagtcttaaaaaaaaaaaaaaacagaaaaagaaaaaaaagaacgttgcaaatttgttaaaatgccaaaaaggacagtttaattttgtacagattatgcttacctcaggtttctttagtgtgcttgaatgcccttctttccatataacacttatcttcttcttaattcggcaatggaatatcttttaagttttaaaaaaactggaataattatatctatcttttttgccgtttatatttaggggtttttgttgataaaatcaagtcttggttgtggcttgctgaattaaatatttatgagtggtgcatttttaagtatagtgaacaagacaccatattaagtacagtgataaagcatctatattctgtaaaaaaaaaaaaaatctgcctatgcatgttttttaagaaaaaaaaaatggctgtatcggcctgtatgggactgtaatgcgcttagtggtctgacatatactggaaatgtatgtatactggcgtactttatattctctaaaatgcttaatgcctttgaaattttgtaatcaaaaaaaagctttgaaaaaatctaaaggggagagtattctttaaagtttttaacataagcttgtcaatgcacatgtagatggttagcatgtttagcaaaccttgtgaaattataataagtttgtagttacatgtgaaactctaaatgcatggcaactgttaatgtcataacagtttagttattttgttctgttctgtcatgtgccacaaaatatgtacttttttcacttttttccctttgtatatcagttacgggttacaactggttcattctgaaaacaacaacaacaaaagtccattcatattttttaacaattgtataagtgcccaagtaattcactacagcctaaagccttgcctttgtaatttgacttctgacatgttggcaatcaaagcatgcacttgtaacaatgaaaaagaaaaagcattttatattactactcaataaaatgtgcatgaacttacagaattctcatccttccactgagtccgctgaagggatttatgtgcacaaccaccatgtgtcttctaggtgctggcccaccaccacacatcacaggctgatttccacaggcttcttcctaggggcctcgtgatctgaggggtggtgcctacttccactgtaagaaagaatcttggtggatttgtgtctcaaatcagataagagaagcctgtttaaagagcagatgccatcttctggcttcctcaaggagccagttaaaaaaccagagcattcctttttattgaaaaataaaattaatttgttatcaggttgtttcagttgtattggatgccctatctatctgctaaagcaaaaagtactaggctactaagtgcattttcatcacagaaaagagttgcatttgtattaacaagaaatttgtatacccacgcttcagctactatctaatcatcacccgaagatttaagatacaccaaatttcagtttgtttgtaacattgttcatctttagtgcactttgttttatataataaagtatgcctgttatattaaataataagaatatggcaattagcgatatagcatacccaaacaaagatgttctcgatacagtctggcaaagactatcccaaggttattttaatgaattcagacattttttcctgtggatatttctccatcctaaaaaaagtggcaaccaaggaaaatatttagatgcaacttactagagtgatgatgtgaaagaaatggtgattctggtatcatggtgtttattttctttcttataactgcagagaaaatatcctgactaaaaaaaattcatttttttggattcctttcttttacaaattgtgctgaggcaactatggcatagaaataaacatttgacattaaaataagcagttgatgtgagtattgctt

SEQ ID NO: 3363 - DNA, 1365 bp, Homo sapiens
atgtccgagcccaaggcaattgatcccaagttgtcgacgaccgacagggtggtgaaagtttgtggggacattcatggacaattctttgatttgatgaagctctttgaagtcgggggatctcctgccaacactcgctacctcttcttaggggactatgttgacagagggtacttcagtattgaatgtgtgctgtatttgtgggccttgaaaattctctaccccaaaacactgtttttacttcgtggaaatcatgaatgtagacatctaacagagtatttcacatttaaacaagaatgtaaaataaagtattcagaacgcgtatatgatgcctgtatggatgcctttgactgccttcccctggctgccctgatgaaccaacagttcctgtgtgtgcatggtggtttgtctccagagattaacactttagatgatatcagaaaattagaccgattcaaagaaccacctgcatatggacctatgtgtgatatcctgtggtcagaccccctggaagattttggaaatgagaagactcaggaacatttcactcacaacacagtcagggggtgttcatacttctacagttacccggctgtatgtgaattcttacagcacaataacttgttatctatactccgagcccacgaagcccaagatgcagggtaccgcatgtacaggaaaagccaaacaacaggcttcccttctctaattacaattttttcagcaccaaattacttagatgtatacaataacaaagctgcagtattgaagtatgagaacaatgttatgaatatcaggcaattcaactgttctcctcatccatactggcttccaaatttcatggatgtttttacttggtcccttccatttgttggggaaaaagtgactgagatgctggtaaatgtcctcaacatctgctcagatgatgaactagggtcagaagaagatggatttgatggtgcaacagctgcagcccggaaagaggtgataaggaacaagatccgagcaataggcaaaatggccagagtgttctcagtgctcagagaagagagtgagagtgtgctgacgctgaaaggcttgaccccaactggcatgctccccagcggagtactttctggagggaagcaaaccctgcaaagcgctactgttgaggctattgaggctgatgaagctatcaaaggattttcaccacaacataagatcactagcttcgaggaagccaagggcttagaccgaattaatgagaggatgccgcctcgcagagatgccatgccctctgacgccaaccttaactccatcaacaaggctctcacctcagagactaacggcacggacagcaatggcagtaatagcagcaatattcagtga

SEQ ID NO: 3364 - DNA, 569 bp, Homo sapiens
ggtgttggcggcggcggcggcggcggaggggggtaggttgtgcccgggactgtgtctgccgagctcggcggctgtgccttgctgttccatttcctccaagtcaccggcttacagcaaaagaagtgtttgataatgatggaaaacctcgtgtggatatcttaaaggcgcatcttatgaaggagggaaggctggaagagagtgttgcattgagaataataacagagggtgcatcaattcttcgacaggaaaaaaatttgctggatattgatgcgccagtcactgtttgtggggacattcatggacaattctttgatttgatgaagctctttgaagtcgggggatctcctgccaacactcgctacctcttcttaggggactatgttgacagagggtacttcagtattgaatgtgtgctgtatttgtgggccttgaaaattctctaccccaaaacactgtttttacttcgtggaaatcatgaatgtagacatctaacagagtatttcacatttaaacaagaatgtaaaataaagtattcagaacgcgtatatgatgcctgtatggatgccttt

SEQ ID NO: 3365 - DNA, 579 bp, Homo sapiens
aaaaacaaccgtacaccgcatcgcagtcgtagctcttctccgcaagctgttccatttcctccaagtcaccggcttacagcaaaagaagtgtttgataatgatggaaaacctcgtgtggatatcttaaaggcgcatcttatgaaggagggaaggctggaagagagtgttgcattgagaataataacagagggtgcatcaattcttcgacaggaaaaaaatttgctggatattgatgcgccagtcactgtttgtggggacattcatggacaattctttgatttgatgaagctctttgaagtcgggggatctcctgccaacactcgctacctcttcttaggggactatgttgacagagggtacttcagtattgaatgtgtgctgtatttgtgggccttgaaaattctctaccccaaaacactgtttttacttcgtggaaatcatgaatgtagacatctaacagagtatttcacatttaaacaagaatgtaaaataaagtattcagaacgcgtatatgatgcctgtatggatgcctttgactgccttcccctggctgccctgatgaaccaacagttcctgtgt

SEQ ID NO: 3366 - DNA, 2418 bp, Homo sapiens
agagggtccgccatgttccccggcggcgccgccgcttggctctggtagccgccgcccccgcccccaaccccgcccggcccagagcctagccgagccccgggcccagcatggccgccccggagccggcccgggctgcaccgcccccacccccgcccccgccgccccctcccggggctgaccgcgtcgtcaaagctgtccctttccccccaacacatcgcttgacatctgaagaagtatttgatttggatgggatacccagggttgatgttctgaagaaccacttggtgaaagaaggtcgagtagatgaagaaattgcgcttagaattatcaatgagggtgctgccatccttcggagagagaaaaccatgatagaagtagaagctccaatcacagtgtgtggtgacatccatggccaattttttgatctgatgaaactttttgaagtaggaggatcacctgctaatacacgatacctttttcttggcgattatgtggacagaggttattttagtatagagtgtgtcttatatttatgggttctgaagattctatacccaagcacattatttcttctgagaggcaaccatgaatgcagacaccttactgaatattttacctttaagcaggaatgtaaaattaagtattcggaaagagtctatgaagcttgtatggaagcttttgatagtttgcctcttgctgcacttttaaaccaacagtttctttgtgttcatggtggactttcaccagaaatacacacactggatgatattaggagattagatagattcaaagagccacctgcatttggaccaatgtgtgacttgttatggtccgatccttctgaagattttggaaatgaaaaatcacaggaacattttagtcacaatacagttcgaggatgttcttatttttataactatccagcagtgtgtgaatttttgcaaaacaataatttgttatcgattattagagctcatgaagctcaagatgcaggctatagaatgtacagaaaaagtcaaactacagggttcccttcattaataacaattttttcggcacctaattacttagatgtctacaataataaagctgctgtattaaagtatgaaaataatgtgatgaatattcgacagtttaactgttctccacatccttactggttgcctaattttatggatgtcttcacgtggtctttaccgtttgttggagaaaaagtgacagaaatgttggtaaatgttctgagtatttgctctgatgatgaactaatgactgaaggtgaagaccagtttgatggttcagctgcagcccggaaagaaatcataagaaacaaaattcgagcaattggcaagatggcaagagtcttctctgttctcagggaggagagtgaaagtgtgctgacactcaagggcctgactcccacagggatgttgcctagtggagtgttagctggaggacggcagaccctgcaaagtggtaatgatgttatgcaacttgctgtgcctcagatggactggggcacacctcactcttttgctaacaattcacataatgcatgcagggaattccttctgttttttagttcctgtctcagcagctgacctagacagggtactgtattagctagtgtctcattaatacctgatcagggcagaaaactgatagaatgggtattcctttcaattgaaaataatggtcagttcctcagcttttcatgaaatgatatgggagcagctcatatcataatgtctgaaatatttatttattcatctgtctaattcacccttttcttttaaaagccccagtttcagaatgtgaatcagggatattcctgttactaaaatggaaatgtaattccaagtttcttttttaattttttaaatttatgtcattgtattggactatgcttatatttaaaactacttaatttagagttaactacctgcttaggccccagaacattacttatgcccttcagttaccaaaagatttgtgcaaggttttgtaccctggtaaatgatgccaaagtttgttttctgtggtgtttgtcaaatgttctatgtataattaactgtctgtaacatgctgtttccttcctctgcagatgtagctgctttcctaaatctgtctgtctttctttaggttagctgtatgtctgtaaaagtatgttcaattaaattactccatcagacacttgtctgtcttgcaatgtagaagcagctttgtagcaccttgttttgaggtttgctgcatttgttgctgcactttgtgcattctgaacatgaatgtaacattagatattaagtcattgttataaggggttgaatttaaatcctgtaagtcaaaattgaaagggtgttattaagtgtgcctttattttgcatgaaaataaaaagaattatacgtaaagcattcctgtaa

SEQ ID NO: 3367 - DNA, 3501 bp, Homo sapiens
gggaaagagggtccgccatgttccccggcggcgccgccgcttggctctggtagccgccgcccccgcccccaaccccgcccggcccagagcctagccgagccccgggcccagcatggccgccccggagccggcccgggctgcaccgcccccacccccgcccccgccgccccctcccggggctgaccgcgtcgtcaaagctgtccctttccccccaacacatcgcttgacatctgaagaagtatttgatttggatgggatacccagggttgatgttctgaagaaccacttggtgaaagaaggtcgagtagatgaagaaattgcgcttagaattatcaatgagggtgctgccatccttcggagagagaaaaccatgatagaagtagaagctccaatcacagtgtgtggtgacatccatggccaattttttgatctgatgaaactttttgaagtaggaggatcacctgctaatacacgatacctttttcttggcgattatgtggacagaggttattttagtatagagtgtgtcttatatttatgggttctgaagattctatacccaagcacattatttcttctgagaggcaaccatgaatgcagacaccttactgaatattttacctttaagcaggaatgtaaaattaagtattcggaaagagtctatgaagcttgtatggaagcttttgatagtttgcctcttgctgcacttttaaaccaacagtttctttgtgttcatggtggactttcaccagaaatacacacactggatgatattaggagattagatagattcaaagagccacctgcatttggaccaatgtgtgacttgttatggtccgatccttctgaagattttggaaatgaaaaatcacaggaacattttagtcacaatacagttcgaggatgttcttatttttataactatccagcagtgtgtgaatttttgcaaaacaataatttgttatcgattattagagctcatgaagctcaagatgcaggctatagaatgtacagaaaaagtcaaactacagggttcccttcattaataacaattttttcggcacctaattacttagatgtctacaataataaagctgctgtattaaagtatgaaaataatgtgatgaatattcgacagtttaactgttctccacatccttactggttgcctaattttatggatgtcttcacgtggtctttaccgtttgttggagaaaaagtgacagaaatgttggtaaatgttctgagtatttgctctgatgatgaactaatgactgaaggtgaagaccagtttgatggttcagctgcagcccggaaagaaatcataagaaacaaaattcgagcaattggcaagatggcaagagtcttctctgttctcagggaggagagtgaaagtgtgctgacactcaagggcctgactcccacagggatgttgcctagtggagtgttagctggaggacggcagaccctgcaaagtgccacagttgaggctattgaggctgaaaaagcaatacgaggattctctccaccacatagaatctgcagttttgaagaggcaaagggtttggataggatcaatgagagaatgccacctcggaaagatgctgtacagcaagatggtttcaattctctgaacaccgcacatgccactgagaaccacgggacgggcaaccatactgcccagtgacccactacttcccagggactctcacatctcgggccccaaatggacagatcacccgaggagctggaggggtcggccaagctgactgtaaatttcacagtctctctgaagaaaccattgtgcttctgagaccctagcccccttcctggatggaggcttgagggccctgggacatgtgctatctgataagattgggtcatcgctgccaaggtggagagcagtgagcaaggggcttggggcaatttccagtggagggcatccacacctccattttatgcttgtggttcacacatttaagtttacaaatcagatttcttttccccttcagtagaattagattttgtttttcaatcatgatttcaaatgcaatcctaagagctaatgtggacttttctttttccatgaaatgtctttaaaggatgaattagcatggtcttaaaatacatttctgaggttactagctgtattttgaattgtgagcaaaatgccgagaaacccagttggcatttatacaaaatgttgacctcaggtctatagttcttaaatgtggctaattctgtaacatagtcttggtattttttaattatgaatgcatatcctatttccaggcaggctctcttacttgaacacaaatccaaaaactaatttagagtcttttttgcccagatcttttaagacttacaccccagagatttaagaagaaaacctctaaatttcaaaattatgaagaattacagaattactcatttaaggtactttaaaagaagtttgtacattgtcaaagtaaattttaattcaaatcatgtctgtaaaacttgacgtattttgtgtatgcatgttttcattttgcaaatatttaatatatagacctatgatgtacaggtacgacatgtataggttacctagatgttatgagaaattttagtttattgtgagtactcaagttgcttagagagccaccagggtgatttgctgctggctttctatcatttttatgttttaatgcaaaggaaattttaaaatgttctggaagtgtttttgattaagcaatgcagcctagaagcaatggttctgttcaatcattcagatgttagtggaagcataaaagtcaagactgcatgttgaaacctttcttttgatagttactgaactgcttggttaaactaaatggaaccatgtgctaatttttcacaattattgacctgtattgattgccactgtagtttggtatttccctttactttggtggcctgcttccctcatgccctggaatacaactcagagctccaggcagcggaaccatctattgttttgtttgccagaaagtgcaccctgtatggtctcctgtctaagttggaaatattatgcatgtgcaggactattcgagtattttataaacagtagcacacaataaattccatgcatgggccgctgctcctatctctgtgttgggttttatttggaagatgcaatctgatttgtccttttgatgcaaatcagaaaatcctgttactagagctgggatgtcctccggagattatctcgtggatagttcatggtaatttgattaattaaattctttataaattttgccttaaaaaaaacttttgttatatacttgttttacatgagcattagtaactgagcactagaggactttgaatgcctactgtaggcctcctaagtctaatatttaagatcactgtttattgtcttttaattgaaagaaaatatgttattgtctagaattttgttatagtggtattgggaatttactgggtgttctaacaataagaaaaatattagtgataattgca

SEQ ID NO: 3368 - DNA, 1680 bp, Homo sapiens
atgccggtcttagcccctctgtagggaaagagggtccgccatgttccccggcggcgccgccgcttggctctggtagccgccgcccccgcccccaaccccgcccggcccagagcctagccgagccccgggcccagcatggccgccccggagccggcccgggctgcaccgcccccacccccgcccccgccgccccctcccggggctgaccgcgtcgtcaaagctgtccctttccccccaacacatcgcttgacatctgaagaagtatttgatttggatgggatacccagggttgatgttctgaagaaccacttggtgaaagaaggtcgagtagatgaagaaattgcgcttagaattatcaatgagggtgctgccatccttcggagagagaaaaccatgatagaagtagaagctccaatcacagtgtgtggtgacatccatggccaattttttgatctgatgaaactttttgaagtaggaggatcacctgctaatacacgatacctttttcttggcgattatgtggacagaggttattttagtatagagcatgttctaggcactgaagacatatcgattaatcctcacaataatattaatgagtgtgtcttatatttatgggttctgaagattctatacccaagcacattatttcttctgagaggcaaccatgaatgcagacaccttactgaatattttacctttaagcaggaatgtaaaattaagtattcggaaagagtctatgaagcttgtatggaagcttttgatagtttgcctcttgctgcacttttaaaccaacagtttctttgtgttcatggtggactttcaccagaaatacacacactggatgatattaggagattagatagattcaaagagccacctgcatttggaccaatgtgtgacttgttatggtccgatccttctgaagattttggaaatgaaaaatcacaggaacattttagtcacaatacagttcgaggatgttcttatttttataactatccagcagtgtgtgaatttttgcaaaacaataatttgttatcgattattagagctcatgaagctcaagatgcaggctatagaatgtacagaaaaagtcaaactacagggttcccttcattaataacaattttttcggcacctaattacttagatgtctacaataataaagctgctgtattaaagtatgaaaataatgtgatgaatattcgacagtttaactgttctccacatccttactggttgcctaattttatggatgtcttcacgtggtctttaccgtttgttggagaaaaagtgacagaaatgttggtaaatgttctgagtatttgctctgatgatgaactaatgactgaaggtgaagaccagtttgatggttcagctgcagcccggaaagaaatcataagaaacaaaattcgagcaattggcaagatggcaagagtcttctctgttctcagggaggagagtgaaagtgtgctgacactcaagggcctgactcccacagggatgttgcctagtggagtgttagctggaggacggcagaccctgcaaagtggtaatgatgttatgcaacttgctgtgcctcagatggactggggcacacctcactcttttgctaacaattcacataatgcatgcagggaattccttctgttttttagttcctgtctcagcagctga

SEQ ID NO: 3369 - DNA, 3173 bp, Homo sapiens
atgccggtcttagcccctctgtagggaaagagggtccgccatgttccccggcggcgccgccgcttggctctggtagccgccgcccccgcccccaaccccgcccggcccagagcctagccgagccccgggcccagcatggccgccccggagccggcccgggctgcaccgcccccacccccgcccccgccgccccctcccggggctgaccgcgtcgtcaaagctgtccctttccccccaacacatcgcttgacatctgaagaagtatttgatttggatgggatacccagggttgatgttctgaagaaccacttggtgaaagaaggtcgagtagatgaagaaattgcgcttagaattatcaatgagggtgctgccatccttcggagagagaaaaccatgatagaagtagaagctccaatcacagtgtgtggtgacatccatggccaattttttgatctgatgaaactttttgaagtaggaggatcacctgctaatacacgatacctttttcttggcgattatgtggacagaggttattttagtatagagtgtgtcttatatttatgggttctgaagattctatacccaagcacattatttcttctgagaggcaaccatgaatgcagacaccttactgaatattttacctttaagcaggaatgtaaaattaagtattcggaaagagtctatgaagcttgtatggaagcttttgatagtttgcctcttgctgcacttttaaaccaacagtttctttgtgttcatggtggactttcaccagaaatacacacactggatgatattaggagattagatagattcaaagagccacctgcatttggaccaatgtgtgacttgttatggtccgatccttctgaagattttggaaatgaaaaatcacaggaacattttagtcacaatacagttcgaggatgttcttatttttataactatccagcagtgtgtgaatttttgcaaaacaataatttgttatcgattattagagctcatgaagctcaagatgcaggctatagaatgtacagaaaaagtcaaactacagggttcccttcattaataacaattttttcggcacctaattacttagatgtctacaataataaagctgctgtattaaagtatgaaaataatgtgatgaatattcgacagtttaactgttctccacatccttactggttgcctaattttatggatgtcttcacgtggtctttaccgtttgttggagaaaaagtgacagaaatgttggtaaatgttctgagtatttgctctgatgatgaactaatgactgaaggtgaagaccagtttgatgaacggctcatatatggcaataaaaaaggttcagctgcagcccggaaagaaatcataagaaacaaaattcgagcaattggcaagatggcaagagtcttctctgttctcagggaggagagtgaaagtgtgctgacactcaagggcctgactcccacagggatgttgcctagtggagtgttagctggaggacggcagaccctgcaaagtgccacagttgaggctattgaggctgaaaaagcaatacgaggattctctccaccacatagaatctgcagttttgaagaggcaaagggtttggataggatcaatgagagaatgccacctcggaaagatgctgtacagcaagatggtttcaattctctgaacaccgcacatgccactgagaaccacgggacgggcaaccatactgcccagtgacccactacttcccagggactctcacatctcgggccccaaatggacagatcacccgaggagctggaggggtcggccaagctgactgtaaatttcacagtctctctgaagaaaccattgtgcttctgagaccctagcccccttcctggatggaggcttgagggccctgggacatgtgctatctgataagattgggtcatcgctgccaaggtggagagcagtgagcaaggggcttggggcaatttccagtggagggcatccacacctccattttatgcttgtggttcacacatttaagtttacaaatcagatttcttttccccttcagtagaattagattttgtttttcaatcatgatttcaaatgcaatcctaagagctaatgtggacttttctttttccatgaaatgtctttaaaggatgaattagcatggtcttaaaatacatttctgaggttactagctgtattttgaattgtgagcaaaatgccgagaaacccagttggcatttatacaaaatgttgacctcaggtctatagttcttaaatgtggctaattctgtaacatagtcttggtattttttaattatgaatgcatatcctatttccaggcaggctctcttacttgaacacaaatccaaaaactaatttagagtcttttttgcccagatcttttaagacttacaccccagagatttaagaagaaaacctctaaatttcaaaattatgaagaattacagaattactcatttaaggtactttaaaagaagtttgtacattgtcaaagtaaattttaattcaaatcatgtctgtaaaacttgacgtattttgtgtatgcatgttttcattttgcaaatatttaatatatagacctatgatgtacaggtacgacatgtataggttacctagatgttatgagaaattttagtttattgtgagtactcaagttgcttagagagccaccagggtgatttgctgctggctttctatcatttttatgttttaatgcaaaggaaattttaaaatgttctggaagtgtttttgattaagcaatgcagcctagaagcaatggttctgttcaatcattcagatgttagtggaagcataaaagtcaagactgcatgttgaaacctttcttttgatagttactgaactgcttggttaaactaaatggaaccatgtgctaatttttcacaattattgacctgtattgattgccactgtagtttggtatttccctttactttggtggcctgcttccctcatgccctggaatacaactcagagctccaggcagcggaaccatctattgttttgtttgccagaaagtgcaccctgtatggtctcctgtctaagttggaaatattatgcatgtgcaggactattcgagtattttataaacagtagcacacaataaattccatgcatgggccgctgctcct

SEQ ID NO: 3370 - DNA, 3119 bp, Homo sapiens
atgccggtcttagcccctctgtagggaaagagggtccgccatgttccccggcggcgccgccgcttggctctggtagccgccgcccccgcccccaaccccgcccggcccagagcctagccgagccccgggcccagcatggccgccccggagccggcccgggctgcaccgcccccacccccgcccccgccgccccctcccggggctgaccgcgtcgtcaaagctgtccctttccccccaacacatcgcttgacatctgaagaagtatttgatttggatgggatacccagggttgatgttctgaagaaccacttggtgaaagaaggtcgagtagatgaagaaattgcgcttagaattatcaatgagggtgctgccatccttcggagagagaaaaccatgatagaagtagaagctccaatcacagtgtgtggtgacatccatggccaattttttgatctgatgaaactttttgaagtaggaggatcacctgctaatacacgatacctttttcttggcgattatgtggacagaggttattttagtatagagtgtgtcttatatttatgggttctgaagattctatacccaagcacattatttcttctgagaggcaaccatgaatgcagacaccttactgaatattttacctttaagcaggaatgtaaaattaagtattcggaaagagtctatgaagcttgtatggaagcttttgatagtttgcctcttgctgcacttttaaaccaacagtttctttgtgttcatggtggactttcaccagaaatacacacactggatgatattaggagattagatagattcaaagagccacctgcatttggaccaatgtgtgacttgttatggtccgatccttctgaagattttggaaatgaaaaatcacaggaacattttagtcacaatacagttcgaggatgttcttatttttataactatccagcagtgtgtgaatttttgcaaaacaataatttgttatcgattattagagctcatgaagctcaagatgcaggctatagaatgtacagaaaaagtcaaactacagggttcccttcattaataacaattttttcggcacctaattacttagatgtctacaataataaagctgctgtattaaagtatgaaaataatgtgatgaatattcgacagtttaactgttctccacatccttactggttgcctaattttatggatgtcttcacgtggtctttaccgtttgttggagaaaaagtgacagaaatgttggtaaatgttctgagtatttgctctgatgatgaactaatgactgaaggtgaagaccagtttgatgtaggttcagctgcagcccggaaagaaatcataagaaacaaaattcgagcaattggcaagatggcaagagtcttctctgttctcagggaggagagtgaaagtgtgctgacactcaagggcctgactcccacagggatgttgcctagtggagtgttagctggaggacggcagaccctgcaaagtgcaatacgaggattctctccaccacatagaatctgcagttttgaagaggcaaagggtttggataggatcaatgagagaatgccacctcggaaagatgctgtacagcaagatggtttcaattctctgaacaccgcacatgccactgagaaccacgggacgggcaaccatactgcccagtgacccactacttcccagggactctcacatctcgggccccaaatggacagatcacccgaggagctggaggggtcggccaagctgactgtaaatttcacagtctctctgaagaaaccattgtgcttctgagaccctagcccccttcctggatggaggcttgagggccctgggacatgtgctatctgataagattgggtcatcgctgccaaggtggagagcagtgagcaaggggcttggggcaatttccagtggagggcatccacacctccattttatgcttgtggttcacacatttaagtttacaaatcagatttcttttccccttcagtagaattagattttgtttttcaatcatgatttcaaatgcaatcctaagagctaatgtggacttttctttttccatgaaatgtctttaaaggatgaattagcatggtcttaaaatacatttctgaggttactagctgtattttgaattgtgagcaaaatgccgagaaacccagttggcatttatacaaaatgttgacctcaggtctatagttcttaaatgtggctaattctgtaacatagtcttggtattttttaattatgaatgcatatcctatttccaggcaggctctcttacttgaacacaaatccaaaaactaatttagagtcttttttgcccagatcttttaagacttacaccccagagatttaagaagaaaacctctaaatttcaaaattatgaagaattacagaattactcatttaaggtactttaaaagaagtttgtacattgtcaaagtaaattttaattcaaatcatgtctgtaaaacttgacgtattttgtgtatgcatgttttcattttgcaaatatttaatatatagacctatgatgtacaggtacgacatgtataggttacctagatgttatgagaaattttagtttattgtgagtactcaagttgcttagagagccaccagggtgatttgctgctggctttctatcatttttatgttttaatgcaaaggaaattttaaaatgttctggaagtgtttttgattaagcaatgcagcctagaagcaatggttctgttcaatcattcagatgttagtggaagcataaaagtcaagactgcatgttgaaacctttcttttgatagttactgaactgcttggttaaactaaatggaaccatgtgctaatttttcacaattattgacctgtattgattgccactgtagtttggtatttccctttactttggtggcctgcttccctcatgccctggaatacaactcagagctccaggcagcggaaccatctattgttttgtttgccagaaagtgcaccctgtatggtctcctgtctaagttggaaatattatgcatgtgcaggactattcgagtattttataaacagtagcacacaataaattccatgcatgggccgctgctcct

SEQ ID NO: 3371 - DNA, 3149 bp, Homo sapiens
atgccggtcttagcccctctgtagggaaagagggtccgccatgttccccggcggcgccgccgcttggctctggtagccgccgcccccgcccccaaccccgcccggcccagagcctagccgagccccgggcccagcatggccgccccggagccggcccgggctgcaccgcccccacccccgcccccgccgccccctcccggggctgaccgcgtcgtcaaagctgtccctttccccccaacacatcgcttgacatctgaagaagtatttgatttggatgggatacccagggttgatgttctgaagaaccacttggtgaaagaaggtcgagtagatgaagaaattgcgcttagaattatcaatgagggtgctgccatccttcggagagagaaaaccatgatagaagtagaagctccaatcacagtgtgtggtgacatccatggccaattttttgatctgatgaaactttttgaagtaggaggatcacctgctaatacacgatacctttttcttggcgattatgtggacagaggttattttagtatagagtgtgtcttatatttatgggttctgaagattctatacccaagcacattatttcttctgagaggcaaccatgaatgcagacaccttactgaatattttacctttaagcaggaatgtaaaattaagtattcggaaagagtctatgaagcttgtatggaagcttttgatagtttgcctcttgctgcacttttaaaccaacagtttctttgtgttcatggtggactttcaccagaaatacacacactggatgatattaggagattagatagattcaaagagccacctgcatttggaccaatgtgtgacttgttatggtccgatccttctgaagattttggaaatgaaaaatcacaggaacattttagtcacaatacagttcgaggatgttcttatttttataactatccagcagtgtgtgaatttttgcaaaacaataatttgttatcgattattagagctcatgaagctcaagatgcaggctatagaatgtacagaaaaagtcaaactacagggttcccttcattaataacaattttttcggcacctaattacttagatgtctacaataataaagctgctgtattaaagtatgaaaataatgtgatgaatattcgacagtttaactgttctccacatccttactggttgcctaattttatggatgtcttcacgtggtctttaccgtttgttggagaaaaagtgacagaaatgttggtaaatgttctgagtatttgctctgatgatgaactaatgactgaaggtgaagaccagtttgatgtaggttcagctgcagcccggaaagaaatcataagaaacaaaattcgagcaattggcaagatggcaagagtcttctctgttctcagggaggagagtgaaagtgtgctgacactcaagggcctgactcccacagggatgttgcctagtggagtgttagctggaggacggcagaccctgcaaagtgccacagttgaggctattgaggctgaaaaagcaatacgaggattctctccaccacatagaatctgcagttttgaagaggcaaagggtttggataggatcaatgagagaatgccacctcggaaagatgctgtacagcaagatggtttcaattctctgaacaccgcacatgccactgagaaccacgggacgggcaaccatactgcccagtgacccactacttcccagggactctcacatctcgggccccaaatggacagatcacccgaggagctggaggggtcggccaagctgactgtaaatttcacagtctctctgaagaaaccattgtgcttctgagaccctagcccccttcctggatggaggcttgagggccctgggacatgtgctatctgataagattgggtcatcgctgccaaggtggagagcagtgagcaaggggcttggggcaatttccagtggagggcatccacacctccattttatgcttgtggttcacacatttaagtttacaaatcagatttcttttccccttcagtagaattagattttgtttttcaatcatgatttcaaatgcaatcctaagagctaatgtggacttttctttttccatgaaatgtctttaaaggatgaattagcatggtcttaaaatacatttctgaggttactagctgtattttgaattgtgagcaaaatgccgagaaacccagttggcatttatacaaaatgttgacctcaggtctatagttcttaaatgtggctaattctgtaacatagtcttggtattttttaattatgaatgcatatcctatttccaggcaggctctcttacttgaacacaaatccaaaaactaatttagagtcttttttgcccagatcttttaagacttacaccccagagatttaagaagaaaacctctaaatttcaaaattatgaagaattacagaattactcatttaaggtactttaaaagaagtttgtacattgtcaaagtaaattttaattcaaatcatgtctgtaaaacttgacgtattttgtgtatgcatgttttcattttgcaaatatttaatatatagacctatgatgtacaggtacgacatgtataggttacctagatgttatgagaaattttagtttattgtgagtactcaagttgcttagagagccaccagggtgatttgctgctggctttctatcatttttatgttttaatgcaaaggaaattttaaaatgttctggaagtgtttttgattaagcaatgcagcctagaagcaatggttctgttcaatcattcagatgttagtggaagcataaaagtcaagactgcatgttgaaacctttcttttgatagttactgaactgcttggttaaactaaatggaaccatgtgctaatttttcacaattattgacctgtattgattgccactgtagtttggtatttccctttactttggtggcctgcttccctcatgccctggaatacaactcagagctccaggcagcggaaccatctattgttttgtttgccagaaagtgcaccctgtatggtctcctgtctaagttggaaatattatgcatgtgcaggactattcgagtattttataaacagtagcacacaataaattccatgcatgggccgctgctcct

SEQ ID NO: 3372 - DNA, 605 bp, Homo sapiens
catccttactggttgcctaattttatggatgtcttcacgtggtctttaccgtttgttggagaaaaagtgacagaaatgttggtaaatgttctgagtatttgctctgatgatgaactaatgactgaaggtgaagaccagtttgatgaacggctcatatatggcaataaaaaaggttcagctgcagcccggaaagaaatcataagaaacaaaattcgagcaattggcaagatggcaagagtcttctctgttctcagggaggagagtgaaagtgtgctgacactcaagggcctgactcccacagggatgttgcctagtggagtgttagctggaggacggcagaccctgcaaagtgccacagttgaggctattgaggctgaaaaagcaatacgaggattctctccaccacatagaatctgcagttttgaagaggcaaagggtttggataggatcaatgagagaatgccacctcggaaagatgctgtacagcaagatggtttcaattctctgaacaccgcacatgccactgagaaccacgggacgggcaaccatactgcccagtgacccactacttcccagggactctcacatctcgggccccaaatgga

SEQ ID NO: 3373 - DNA, 1509 bp, Homo sapiens
aatgtaatatgggaaggatggaggggccaggaagataagtgacagaaatgttggtaaatgttctgagtatttgctctgatgatgaactaatgactgaaggtgaagaccagtttgatggttcagctgcagcccggaaagaaatcataagaaacaaaattcgagcaattggcaagatggcaagagtcttctctgttctcagggaggagagtgaaagtgtgctgacactcaagggcctgactcccacagggatgttgcctagtggagtgttagctggaggacggcagaccctgcaaagtgccacagttgaggctattgaggctgaaaaagcaatacgaggattctctccaccacatagaatctgcagttttgaagaggcaaagggtttggataggatcaatgagagaatgccacctcggaaagatgctgtacagcaagatggtttcaattctctgaacaccgcacatgccactgagaaccacgggacgggcaaccatactgcccagtgacccactacttcccagggactctcacatctcgggccccaaatggacagatcacccgaggagctggaggggtcggccaagctgactgtaaatttcacagtctctctgaagaaaccattgtgcttctgagaccctagcccccttcctggatggaggcttgagggccctgggacatgtgctatctgataagattgggtcatcgctgccaaggtggagagcagtgagcaaggggcttggggcaatttccagtggagggcatccacacctccattttatgcttgtggttcacacatttaagtttacaaatcagatttcttttccccttcagtagaattagattttgtttttcaatcatgatttcaaatgcaatcctaagagctaatgtggacttttctttttccatgaaatgtctttaaaggatgaattagcatggtcttaaaatacatttctgaggttactagctgtattttgaattgtgagcaaaatgccgagaaacccagttggcatttatacaaaatgttgacctcaggtctatagttcttaaatgtggctaattctgtaacatagtcttggtattttttaattatgaatgcatatcctatttccaggcaggctctcttacttgaacacaaatccaaaaactaatttagagtcttttttgcccagatcttttaagacttacaccccagagatttaagaagaaaacctctaaatttcaaaattatgaagaattacagaattactcatttaaggtactttaaaagaagtttgtacattgtcaaagtaaattttaattcaaatcatgtctgtaaaacttgacgtattttgtgtatgcatgttttcattttgcaaatatttaatatatagacctatgatgtacaggtacgacatgtataggttacctagatgttatgagaaattttagtttattgtgagtactcaagttgcttagagagccaccagggtgatttgctgctggctttctatcatttttatgttttaatgc

SEQ ID NO: 3374 - DNA, 2118 bp, Homo sapiens
aaccccgcccggcccagagcctagccgagccccgggcccagcatggccgccccggagccggcccgggctgcaccgcccccacccccgcccccgccgccccctcccggggctgaccgcgtcgtcaaaggctggtctccaatttctggcctcaagtgatcctcctgccccagcctacgaagtagtcgtgattacagacatgcttcactactcccagcattaaattatatttattgtacttcatttaagctgtccctttccccccaacacatcgcttgacatctgaagaagtatttgatttggatgggatacccagggttgatgttctgaagaaccacttggtgaaagaaggtcgagtagatgaagaaattgcgcttagaattatcaatgagggtgctgccatccttcggagagagaaaaccatgatagaagtagaagctccaatcacagtgtgtggtgacatccatggccaattttttgatctgatgaaactttttgaagtaggaggatcacctgctaatacacgatacctttttcttggcgattatgtggacagaggttattttagtatagagtgtgtcttatatttatgggttctgaagattctatacccaagcacattatttcttctgagaggcaaccatgaatgcagacaccttactgaatattttacctttaagcaggaatgtaaaattaagtattcggaaagagtctatgaagcttgtatggaagcttttgatagtttgcctcttgctgcacttttaaaccaacagtttctttgtgttcatggtggactttcaccagaaatacacacactggatgatattaggagattagatagattcaaagagccacctgcatttggaccaatgtgtgacttgttatggtccgatccttctgaagattttggaaatgaaaaatcacaggaacattttagtcacaatacagttcgaggatgttcttatttttataactatccagcagtgtgtgaatttttgcaaaacaataatttgttatcgattattagagctcatgaagctcaagatgcaggctatagaatgtacagaaaaagtcaaactacagggttcccttcattaataacaattttttcggcacctaattacttagatgtctacaataataaagctgctgtattaaagtatgaaaataatgtgatgaatattcgacagtttaactgttctccacatccttactggttgcctaattttatggatgtcttcacgtggtctttaccgtttgttggagaaaaagtgacagaaatgttggtaaatgttctgagtatttgctctgatgatgaactaatgactgaaggtgaagaccagtttgatgtaggttcagctgcagcccggaaagaaatcataagaaacaaaattcgagcaattggcaagatggcaagagtcttctctgttctcagggaggagagtgaaagtgtgctgacactcaagggcctgactcccacagggatgttgcctagtggagtgttagctggaggacggcagaccctgcaaagtggtaatgatgttatgcaacttgctgtgcctcagatggactggggcacacctcactcttttgctaacaattcacataatgcatgcagggaattccttctgttttttagttcctgtctcagcagctgacctagacagggtactgtattagctagtgtctcattaatacctgatcagggcagaaaactgatagaatgggtattcctttcaattgaaaataatggtcagttcctcagcttttcatgaaatgatatgggagcagctcatatcataatgtctgaaatatttatttattcatctgtctaattcacccttttcttttaaaagccccagtttcagaatgtgaatcagggatattcctgttactaaaatggaaatgtaattccaagtttcttttttaattttttaaatttatgtcattgtattggactatgcttatatttaaaactacttaatttagagttaactacctgcttaggccccagaacattacttatgcccttcagttaccaaaagatttgtgcaaggttttgtaccctggtaaatgatgccaaagtttgttttctgtggtgtttgtcaaatgttctatgta

SEQ ID NO: 3375 - DNA, 2189 bp, Homo sapiens
cacgagggcccgggccgcgagcagccgcggccgtcccggtcgccacccttagcagcggtcgcggtcggtgccgaagcggtgttccccgccttagccgctggcgcctcccaagagagcggccggtgggccctcgtcctgtcagtggcgtcggaggccggcgctgcggtggccgcgcccttctggtgctcggacaccgctgaggagccggggccgggcacggctggctgacggctccgggcagctaaggctgcccgaggagaaggcggcggccgcggcgtaggcgcacgtccggcgggctcctggagcctggaggaggccgaggggaccatgtccgggaggcgcttccacctctccaccaccgaccgcgtcatcaaagctgtcccctttcctccaacccaacggcttactttcaaggaagtatttgagaatgggaaacctaaagttgatgttttaaaaaaccatttggtaaaggaaggacgactggaagaggaagtagccttaaagataatcaatgatggggctgccatcctgaggcaagagaagactatgatagaagtagatgctccaatcacagtatgtggtgatattcatggacaattctttgacctaatgaagttatttgaagttggaggatcacctagtaacacacgctacctctttctgggtgactatgtggacagaggctatttcagtatagagtgtgtgctgtatttatggagtttaaagattaatcatcccaaaacattgtttctgcttcggggaaatcatgaatgcaggcatcttacagactatttcaccttcaaacaggaatgtcgaatcaaatattcggaacaggtgtatgatgcctgtatggagacatttgactgtcttcctcttgctgccctcttaaaccagcagtttctctgtgtacatggaggaatgtcacctgaaattacttctttagatgacattaggaaattagacaggtttacggaacctcccgcctttggacctgtgtgtgacctgctttggtctgatccctcagaggattatggcaatgagaagaccttggagcactatacccacaacactgtccgagggtgctcttatttctacagttaccctgcagtttgtgaatttttgcagaacaataatttactatcaattatcagagcccatgaagcccaagatgctgggtatcgaatgtacaggaagagccaagccacaggctttccatcacttattacaattttctctgcccccaattacctagatgtctataacaataaagctgctgtgttgaaatatgaaaacaatgtcatgaatatcaggcagtttaactgttctccacacccctactggcttccaaactttatggatgttttcacatggtctttgccttttgttggggaaaaagtcacagagatgctggtaaatgtgctcaacatatgctctgatgacgaactgatttctgatgatgaagcagaaggaagcactacagttcgtaaggagatcatcaggaataagatcagagccattgggaagatggcacgggtcttttcaattcttcggcaagaaagtgagagtgtgctgactctcaagggcctgactcccacaggcacactccctctgggcgtcctctcaggaggcaagcagactatcgagacagccacagtagaagcggtagaggcccgggaagccatcagagggttctcgcttcagcacaagatccggagttttgaagaagcgcgaggtctggaccgaattaatgagcgaatgccaccccgaaaggatagcatacacgctggtgggccaatgaaatctgtaacctcagcacactcacatgctgcgcacaggagcgaccaagggaagaaagcccattcatgacttagagtcctgccgtggctcaggtggatctaaaactcaagaacaaattctatttatttattattggaaaatgaaaagcaactcaaaacaacttcaacgtggaggtgcatttataattcagtctgcatttattctgtaaaaaggtggctgttttataaattcttttaatttatgttcaatatatataaaaagtgcatctgttttgtttttcccttttttctccataattttaagaaatgaatctgattgttgtcaacacatttgtgaagtcttgtgctataaaggggaacttcccctaataaaagggccttggaaacctcaaa

SEQ ID NO: 3376 - DNA, 2132 bp, Homo sapiens
gccacccttagcagcggtcgcggtcggtgccgaagcggtgttccccgccttagccgctggcgcctcccaagagagcggccggtgggccctcgtcctgtcagtggcgtcggaggccggcgctgcggtggccgcgcccttctggtgctcggacaccgctgaggagccggggccgggcacggctggctgacggctccgggcagctaaggctgcccgaggagaaggcggcggccgcggcgtaggcgcacgtccggcgggctcctggagcctggaggaggccgaggggaccatgtccgggaggcgcttccacctctccaccaccgaccgcgtcatcaaagctgtcccctttcctccaacccaacggcttactttcaaggaagtatttgagaatgggaaacctaaagttgatgttttaaaaaaccatttggtaaaggaaggacgactggaagaggaagtagccttaaagataatcaatgatggggctgccatcctgaggcaagagaagactatgatagaagtagatgctccaatcacagtatgtggtgatattcatggacaattctttgacctaatgaagttatttgaagttggaggatcacctagtaacacacgctacctctttctgggtgactatgtggacagaggctatttcagtatagagtgtgtgctgtatttatggagtttaaagattaatcatcccaaaacattgtttctgcttcggggaaatcatgaatgcaggcatcttacagactatttcaccttcaaacaggaatgtcgaatcaaatattcggaacaggtgtatgatgcctgtatggagacatttgactgtcttcctcttgctgccctcttaaaccagcagtttctctgtgtacatggaggaatgtcacctgaaattacttctttagatgacattaggaaattagacaggtttacggaacctcccgcctttggacctgtgtgtgacctgctttggtctgatccctcagaggattatggcaatgagaagaccttggagcactatacccacaacactgtccgagggtgctcttatttctacagttaccctgcagtttgtgaatttttgcagaacaataatttactatcaattatcagagcccatgaagcccaagatgctgggtatcgaatgtacaggaagagccaagccacaggctttccatcacttattacaattttctctgcccccaattacctagatgtctataacaataaagctgctgtgttgaaatatgaaaacaatgtcatgaatatcaggcagtttaactgttctccacacccctactggcttccaaactttatggatgttttcacatggtctttgccttttgttggggaaaaagtcacagagatgctggtaaatgtgctcaacatatgctctgatgacgaactgatttctgatgatgaagcagaaggaagcactacagttcgtaaggagatcatcaggaataagatcagagccattgggaagatggcacgggtcttttcaattcttcggcaagaaagtgagagtgtgctgactctcaagggcctgactcccacaggcacactccctctgggcgtcctctcaggaggcaagcagactatcgagacagccatcagagggttctcgcttcagcacaagatccggagttttgaagaagcgcgaggtctggaccgaattaatgagcgaatgccaccccgaaaggatagcatacacgctggtgggccaatgaaatctgtaacctcagcacactcacatgctgcgcacaggagcgaccaagggaagaaagcccattcatgacttagagtcctgccgtggctcaggtggatctaaaactcaagaacaaattctatttatttattattggaaaatgaaaagcaactcaaaacaacttcaacgtggaggtgcatttataattcagtctgcatttattctgtaaaaaggtggctgttttataaattcttttaatttatgttcaatatatataaaaagtgcatctgttttgtttttcccttttttctccataattttaagaaatgaatctgattgttgtcaacacatttgtgaagtcttgtgctataaaggggaacttcccctaataaaagggccttggaaacctcaaacctgggtttctgac

SEQ ID NO: 3377 - DNA, 3023 bp, Homo sapiens
tgccttgaggttgcgggtcagcgcgagccgctgcagtgagtccgtcacggctccggcgcgagcgcgaggctgcagcccccgagtttcccggccgtcttcgccccctctccccctcctttcttcttctctgcctctcctgcctctcgccgctgctcctcccgcgctctccggctctgaatctcgaccttaatttatttccccctaccctgcccgctccctcgcgtgcccaatcgcccggccggcgcgggccccgcggcgccgcctcccctcccccacgcgcgccccctccccgccggcgacccgagggccgcagctgggccgccgccgccgtttcctgcgagccagcctgagcgcaacacttctccgagccagcgagccagcgagccgccgacccgccgagcaaaatgggaaatgaggcaagttatcctttggaaatgtgctcacactttgatgcggatgaaattaaaaggctaggaaagagatttaagaagcttgatttggacaattctggttctttgagtgtggaagagttcatgtctctgcctgagttacaacagaatcctttagtacagcgagtaatagatatattcgacacagatgggaatggagaagtagactttaaagaattcattgagggcgtctctcagttcagtgtcaaaggagataaggagcagaaattgaggtttgctttccgtatctatgacatggataaagatggctatatttccaatggggaactcttccaggtattgaagatgatggtggggaacaatctgaaagatacacagttacagcaaattgtagacaaaaccataataaatgcagataaggatggagatggaagaatatcctttgaagaattctgtgctgttgtaggtggcctagatatccacaaaaagatggtggtagatgtgtgactcttatcagagagtaccacccaacacttttgctttcttctccatctctgaagatctgctcaagacgtccagcaatgctctctgtgtatttaaatggaagtatttttctctgtgaagccacattttccaacatgagcctcatgaagccaactaagtgttattgaactgtaattctctcaataactcagtgtagcactttaaagtctgaaggacagcaacatgaaaagagcatatcaatgtggtggagaaagggaaggggttggctttttaatttatttttcttcatcttttataacaagaaagtatctatatatacatatgtaaatatttatatatagatatatgtagctttctatatatgtagtaggttggctttaatttaatatacttgattcagaaacaaaacaatagagtacaaaagtgccaagcagaacataaaacatccttacttttatttcacacagttttatatatagatagaagactgtacaatttgagccgggtgttaggccagctattttccttttcctgtgctttctcctttgagagattgacaaagcatttgttaacgtcctattatttaccttaattacatttttgtaacaaaggagtctgtaactttatttatacttatgaatatatccagggactacttctcattgctgagcagcttttaatacacctctgcttgaggagaaagtctagttcattgctactgccaagagctagttcttgtgttcatatagtaactgcacagggcttatagctgcttcattctgctactttgtaactaggagccattgcatttattaaatgtccctcagtaacgttaagtgctagttgtgattttatacataaaggccagaagctgtctgaggcaatcatgattgattgtatgtatcacttactgaagaatacctgaagtgatcatgtaactacttataagggatatccatttgtttgattacatgggtaaataatttgtcattaaacttgtgtttgaatcatgaattcccttgtttcaaaagacttgcagctaatctaaaaaactggtgatatttaatatgcatgtatgtatctaaacacccacatatatttgtggtttaagtgtgagaaatcttgctaatctatatgccacagaagagcaaaattgtatccaaatttatgccacttaaatttctttaccacgagggatagagcatgcatactggtttttttttcttgatttgcccatataattggtaatggataacttaataaatttgtgtgatataaaagtagtgtatcatgttctactgtttgatcttatcccttcccatttctgcaaaggtactgttagctggaagaaaaacattttggttagctttgtatgacagtagtctttccctttatagtttctctataaaaactggttttaaaatcagtggaaaagggcaggttgaatcaaggtgaatcaatctgaaattgagcacacctgcctgccatcgctgttccttcaactgagtgctgcacatcatgggctctgtctgtgagagaaaaatcccggtgcttggtgtccttgcatgacatggagttttgcatgtagatcaatttaaaatgtacctcttgtttacataatttgcataattttaaaagataatgttgccaaactttggaaatgttaatgttcagactgaaaatctccactacatgtaactttcttcctctggatcagtggcatggcttataatcccagccagtggtttgaactgttccagtgtcaactgccatgtgctctgcttcaagggggaactagccttttgtgaattttttgtacataagtatttgttacaaatattttagcaaatgctttctatttctcttgcttgtgcatatcttggctggcgttacagaaaaatagtgtaaacattatttccttaccggggaatgagggttttttctttttctttttttttttttttttttttagtttgtgtgtgggggtgggtaagggaggggatggtttatgttgaatgtttagtttttcttctgcatgatacgtcatgttgtgggatctttagaaaacttcatactgtatgaataagaaaataaaatatttgaaacttg

SEQ ID NO: 3378 - DNA, 3387 bp, Homo sapiens
gggcacgagccccgcccgagctcaccgcccctgctcccctctccgaccctttgagccgtggccgttgccagatgtccacaatgggaaacgaggccagttacccggcggagatgtgctcccactttgacaatgatgaaattaaaaggctgggcaggaggtttaagaagttggacttggacaaatcagggtctctgagcgtggaggagttcatgtccctgccggagctgcgccacaacccgttggtgcggcgagtgatcgacgtcttcgacaccgacggtgatggagaagtggacttcaaggaattcatcctggggacctcccagttcagcgtcaagggcgacgaggagcagaagttgaggtttgcgttcagcatttacgacatggataaagatggctacatttccaacggggagctcttccaggtgctgaagatgatggtgggcaacaacctgacggactggcagctccagcagctggtcgacaaaaccatcatcatcctggacaaggatggcgatgggaagatatcctttgaggaattcagtgctgtggtcagagacctggagatccacaagaagctggtcctcatcgtatgagcctttttcttacaagcaccacccaacaacttctgctttcttccctatctctttcaagatttgctcaagacgtccaactgtctctctgacttatctggaagtatttctttttgtgaagccatatgtcctaacaggagcttcatcaccaactcagtgctattaattctccttctctgaatgactcagggtaccctatagggggaagagcaagtcaaatgagcatagtggggaaagaaaaggaaatggcttttataaacatcttttactttgttttgattcaaagaccaaactagaactttaaaagttcaaaaataagaaagtatacatttttgctgttatttctcatcattttgtatatgggaggaaatttataatttgcatgggtgttaggtgaactgttttcatttgcttgtgttcagatatcttgccagattgttaacttcctattgtagcaacagggacaaatatatttgtctttgctgggcatctcgtaatcacttttcttaggggacagaatcccatcttttccttcggcagattgcagccccattccccacaatgcatccagaaatcgctgtgcatgtttgaggggtaggagttcatttggcctcctcctgacttgttgctccagctcctgaacagaaactagcttcagggctcttataggaaatgctaagcctggactaagtgcccagctcagccatcatcctcattagcagtgggtttccagggttggcagcccacaccagcattaatttcaatgaaggggacctccagctaaatagggcaagcaaagtgttctcccagaaagtgctctcacctccgacactggtccctacccccaggtggagacaatgagacatttagttagttgtcctacggaggagaggcagtagagtcaggctgcagtggaatctccctaggatgccaaagtggcattatgtctgttgctcacagatgcagagactgacaattgtgtctccacagcagaggtggatgctagctacaccagctatgctgattttgaaaatcagatctgaggcctagaagagaaactgagagctctctcattccaggaagccttttccctagtggaacattcagtgcagaagtcctcacacactaacagatctccaccattgggtgagccggagcctgtggttccaggggagatccagaatgcatgtgtctcttcccacgcatttatgtcatgttggtagctttagatcagccatggtgagaaaagaacaaaagcttttagttgtttttgttttgttttggagaatttgtttaccagtaaatacatcactgcctgtaccccaaatgttaccagctccctgaggtgtcccacatactattgtgagttctcagagcatgaactgtcctcagaagagcagggctaggacttgtcccagcatctgtgcctccataccaatcctctttctcacagagaaccacttcccatataagatgcttaaggctctcaaaacagcagaacaatgaaacatactctccctacacttgcttagccaagagataccactcaggtaacttttttcaggacatggaagatctgtttcaaggagatttactgctattttatttggaagaagctggcaactggtcttgaccaaaatagaaaaaaaaaaaaaaagtccacaaatttaatcacttgtagggaacccatctatcaaggtaccctaccatatacttttgtatttaatagattacttagaaaccacaaaaataggaatccttaccccttcaattcctgttcaaccctaaaaactgtgataaacgctcccaaccctgtggtgatcagggttatgtaatgttcaaagattcagacacacctgggtttggattcagttgcaactgggttgttatcacactcacttctttttagctgtgtgagcatgaataatttacttagcctctctgtgtctttccacctaattaaagaggatccaccccagggttattttgaggattcaaaaaggcatgcaacacacctggagcacaattccactttcattcaactaattcccttcccttcccccttcttccccttctacaagatcaatatgtaaaggagacatgaggcttactggttgcttttgaacacttacttagttcttagctacacccactctaaaattaactggacattagtgtacagcccatgtccaagcccagagagaaaacaatgggaacaatttcaaggtcctcaccactccttcatttgcagaggggacaacagactttctgacctgagaactggagaatttttaaaacaaaatctctcattccagcccaacctatttaactttttgtggaggaattttacatggaggaagtgagcacatgtcatgctagccaagaggacattattgtcattaaagagaggcattatttatacaccctgcaatgtgcacattaaaatatggaaattttaaaattatgaccaagggcttgaaacatattggattacatgctcacatttaacaaagagaggaaatgtgtttcagtttctggagtggctggaatttacaagctaattgttcaataaatctactcaagatagttacctaaggctttgtggcaatgaccttgaactgagagcctgtatctggatttagcacttgaaagatctaactggatatttgggttaaaagaatcacatttattcccaaatcggaatgctttgtttttcctgtcagttaattgccagttgccaacaaatctagttctatacagtttcttgggatgatgataataaacatttattgagcaa

SEQ ID NO: 3379 - DNA, 907 bp, Homo sapiens
tccgaccctttgagccgtggccgttgccagatgtccacaatgggaaacgaggccagttacccggcggagatgtgctcccactttgacaatgatgaaattaaaaggctgggcaggaggtttaagaagttggacttggacaaatcagggtctctgagcgtggaggagttcatgtccctgccggagctgcgccacaacccgttggtgcggcgagtgatcgacgtcttcgacaccgacggtgatggagaagtggacttcaaggaattcatcctggggacctcccagttcagcgtcaagggcgacgaggagcagaagttgaggtttgcgttcagcatttacgacatggataaagatggctacatttccaacggggagctcttccaggtgctgaagatgatggtgggcaacaacctgacggactggcagctccagcagctggtcctcatcgtatgagcctttttcttacaagcaccacccaacaacttctgctttcttccctatctctttcaagatttgctcaagacgtccaactgtctctctgacttatctggaagtatttctttttgtgaagccatatgtcctaacaggagcttcatcaccaactcagtgctattaattctccttctctgaatgactcagggtaccctatagggggaagagcaagtcaaatgagcatagtggggaaagaaaaggaaatggcttttataaacatcttttactttgttttgattcaaagaccaaactagaactttaaaagttcaaaaataagaaagtatacatttttgctgttatttctcatcattttgtatatgggaggaaatttataatttgcatgggtgttaggtgaactgttttcatttgcttgtgttcagatatcttgccagattgttaacttcctattgtagcaaca

SEQ ID NO: 3380 - DNA, 3163 bp, Homo sapiens
agtgcgcaggcgcaactgcctggctctgctcgctccggcgctccggcccagctctcgcggacaagtccagacatcgcgcgcccccccttctccgggtccgccccctcccccttctcggcgtcgtcgaagataaacaatagttggccggcgagcgcctagtgtgtctcccgccgccggattcggcgggctgcgtgggaccggcgggatcccggccagccggccatggcggggctgtactcgctgggagtgagcgtcttctccgaccagggcgggaggaagtacatggaggacgttactcaaatcgttgtggagcccgaaccgacggctgaagaaaagccctcgccgcggcggtcgctgtctcagccgttgcctccgcggccgtcgccggccgcccttcccggcggcgaagtctcggggaaaggcccagcggtggcagcccgagaggctcgcgaccctctcccggacgccggggcctcgccggcacctagccgctgctgccgccgccgttcctccgtggcctttttcgccgtgtgcgacgggcacggcgggcgggaggcggcacagtttgcccgggagcacttgtggggtttcatcaagaagcagaagggtttcacctcgtccgagccggctaaggtttgcgctgccatccgcaaaggctttctcgcttgtcaccttgccatgtggaagaaactggcggaatggccaaagactatgacgggtcttcctagcacatcagggacaactgccagtgtggtcatcattcggggcatgaagatgtatgtagctcacgtaggtgactcaggggtggttcttggaattcaggatgacccgaaggatgactttgtcagagctgtggaggtgacacaggaccataagccagaacttcccaaggaaagagaacgaatcgaaggacttggtgggagtgtaatgaacaagtctggggtgaatcgtgtagtttggaaacgacctcgactcactcacaatggacctgttagaaggagcacagttattgaccagattccttttctggcagtagcaagagcacttggtgatttgtggagctatgatttcttcagtggtgaatttgtggtgtcacctgaaccagacacaagtgtccacactcttgaccctcagaagcacaagtatattatattggggagtgatggactttggaatatgattccaccacaagatgccatctcaatgtgccaggaccaagaggagaaaaaatacctgatgggtgagcatggacaatcttgtgccaaaatgcttgtgaatcgagcattgggccgctggaggcagcgtatgctccgagcagataacactagtgccatagtaatctgcatctctccagaagtggacaatcagggaaactttaccaatgaagatgagttatacctgaacctgactgacagcccttcctataatagtcaagaaacctgtgtgatgactccttccccatgttctacaccaccagtcaagtcactggaggaggatccatggccaagggtgaattctaaggaccatatacctgccctggttcgtagcaatgccttctcagagaattttttagaggtttcagctgagatagctcgagagaatgtccaaggtgtagtcataccctcaaaagatccagaaccacttgaagaaaattgcgctaaagccctgactttaaggatacatgattctttgaataatagccttccaattggccttgtgcctactaattcaacaaacactgtcatggaccaaaaaaatttgaagatgtcaactcctggccaaatgaaagcccaagaaattgaaagaacccctccaacaaactttaaaaggacattagaagagtccaattctggccccctgatgaagaagcatagacgaaatggcttaagtcgaagtagtggtgctcagcctgcaagtctccccacaacctcacagcgaaagaactctgttaaactcaccatgcgacgcagacttaggggccagaagaaaattggaaatcctttacttcatcaacacaggaaaactgtttgtgtttgctgaaatgcatctgggaaatgaggtttttccaaacttaggatataagagggctttttaaatttggtgccgatgttgaactttttttaaggggagaaaattaaaagaaatatacagtttgactttttggaattcagcagttttatcctggccttgtacttgcttgtattgtaaatgtggattttgtagatgttagggtataagttgctgtaaaatttgtgtaaatttgtatccacacaaattcagtctctgaatacacagtattcagagtctctgatacacagtaattgtgacaatagggctaaatgtttaaagaaatcaaaagaatctattagattttagaaaaacatttaaactttttaaaatacttattaaaaaatttgtataagccacttgtcttgaaaactgtgcaactttttaaagtaaattattaagcagactggaaaagtgatgtattttcatagtgacctgtgtttcacttaatgtttcttagagccaagtgtcttttaaacattattttttatttctgatttcataattcagaactaaatttttcatagaagtgttgagccatgctacagttagtcttgtcccaattaaaatactatgcagtatctcttacatcagtagcatttttctaaaaccttagtcatcagatatgcttactaaatcttcagcatagaaggaagtgtgtttgcctaaaacaatctaaaacaattcccttctttttcatcccagaccaatggcattattaggtcttaaagtagttactcccttctcgtgtttgcttaaaatatgtgaagttttccttgctatttcaataacagatggtgctgctaattcccaacatttcttaaattattttatatcatacagttttcattgattatatgggtatatattcatctaataaatcagtgaactgttcctcatgttgctgaatttgtagttgttggtttattttaatggtatgtacaagttgagtatcccttatccaaaatgcttgggaccagaagtgtttcagattttttaaaattttggaatatttgctttatactgagcttttgagtgttcccaatctgaaattcaaaatgctctaatgagcatttcctttgagcatcatgcctgc

SEQ ID NO: 3381 - DNA, 2996 bp, Homo sapiens
cgcgcccccccttctccgggtccgccccctcccccttctcggcgtcgtcgaagataaacaatagttggccggcgagcgcctagtgtgtctcccgccgccggattcggcgggctgcgtgggaccggcgggatcccggccagccggccatggcggggctgtactcgctgggagtgagcgtcttctccgaccagggcgggaggaagtacatggaggacgttactcaaatcgttgtggagcccgaaccgacggctgaagaaaagccctcgccgcggcggtcgctgtctcagccgttgcctccgcggccgtcgccggccgcccttcccggcggcgaagtctcggggaaaggcccagcggtggcagcccgagaggctcgcgaccctctcccggacgccggggcctcgccggcacctagccgctgctgccgccgccgttcctccgtggcctttttcgccgtgtgcgacgggcacggcgggcgggaggcggcacagtttgcccgggagcacttgtggggtttcatcaagaagcagaagggtttcacctcgtccgagccggctaaggtttgcgctgccatccgcaaaggctttctcgcttgtcaccttgccatgtggaagaaactggcggaatggccaaagactatgacgggtcttcctagcacatcagggacaactgccagtgtggtcatcattcggggcatgaagatgtatgtagctcacgtaggtgactcaggggtggttcttggaattcaggatgacccgaaggatgactttgtcagagctgtggaggtgacacaggaccataagccagaacttcccaaggaaagagaacgaatcgaaggacttggtgggagtgtaatgaacaagtctggggtgaatcgtgtagtttggaaacgacctcgactcactcacaatggacctgttagaaggagcacagttattgaccagattccttttctggcagtagcaagagcacttggtgatttgtggagctatgatttcttcagtggtgaatttgtggtgtcacctgaaccagacacaagtgtccacactcttgaccctcagaagcacaagtatattatattggggagtgatggactttggaatatgattccaccacaagatgccatctcaatgtgccaggaccaagaggagaaaaaatacctgatgggtgagcatggacaatcttgtgccaaaatgcttgtgaatcgagcattgggccgctggaggcagcgtatgctccgagcagataacactagtgccatagtaatctgcatctctccagaagtggacaatcagggaaactttaccaatgaagatgagttatacctgaacctgactgacagcccttcctataatagtcaagaaacctgtgtgatgactccttccccatgttctacaccaccagtcaaggattttggatttgaactcgattcaagaaagtgatgtaacttattatcagagagccatctttacatcaatactaatctgaatgccagccatgtgtacagcactaataaaaagtcactggaggaggatccatggccaagggtgaattctaaggaccatatacctgccctggttcgtagcaatgccttctcagagaattttttagaggtttcagctgagatagctcgagagaatgtccaaggtgtagtcataccctcaaaagatccagaaccacttgaagaaaattgcgctaaagccctgactttaaggatacatgattctttgaataatagccttccaattggccttgtgcctactaattcaacaaacactgtcatggaccaaaaaaatttgaagatgtcaactcctggccaaatgaaagcccaagaaattgaaagaacccctccaacaaactttaaaaggacattagaagagtccaattctggccccctgatgaagaagcatagacgaaatggcttaagtcgaagtagtggtgctcagcctgcaagtctccccacaacctcacagcgaaagaactctgttaaactcaccatgcgacgcagacttaggggccagaagaaaattggaaatcctttacttcatcaacacaggaaaactgtttgtgtttgctgaaatgcatctgggaaatgaggtttttccaaacttaggatataagagggctttttaaatttggtgccgatgttgaactttttttaaggggagaaaattaaaagaaatatacagtttgactttttggaattcagcagttttatcctggccttgtacttgcttgtattgtaaatgtggattttgtagatgttagggtataagttgctgtaaaatttgtgtaaatttgtatccacacaaattcagtctctgaatacacagtattcagagtctctgatacacagtaattgtgacaatagggctaaatgtttaaagaaatcaaaagaatctattagattttagaaaaacatttaaactttttaaaatacttattaaaaaatttgtataagccacttgtcttgaaaactgtgcaactttttaaagtaaattattaagcagactggaaaagtgatgtattttcatagtgacctgtgtttcacttaatgtttcttagagccaagtgtcttttaaacattattttttatttctgatttcataattcagaactaaatttttcatagaagtgttgagccatgctacagttagtcttgtcccaattaaaatactatgcagtatctcttacatcagtagcatttttctaaaaccttagtcatcagatatgcttactaaatcttcagcatagaaggaagtgtgtttgcctaaaacaatctaaaacaattcccttctttttcatcccagaccaatggcattattaggtcttaaagtagttactcccttctcgtgtttgcttaaaatatgtgaagttttccttgctatttcaataacagatggtgctgctaattcccaacatttcttaaattattttatatcatacagttttcattgattatatgggtatatattcatctaataaatcagtgaactgtt

SEQ ID NO: 3382 - DNA, 1751 bp, Homo sapiens
gtgcgcaggcgcaactgcctggctctgctcgctccggcgctccggcccagctctcgcggacaagtccagacatcgcgcgcccccccttctccgggtccgccccctcccccttctcggcgtcgtcgaagataaacaatagttggccggcgagcgcctagtgtgtctcccgccgccggattcggcgggctgcgtgggaccggcgggatcccggccagccggccatggcggggctgtactcgctgggagtgagcgtcttctccgaccagggcgggaggcggcacagtttgcccgggagcacttgtggggtttcatcaagaagcagaagggtttcacctcgtccgagccggctaaggtttgcgctgccatccgcaaaggctttctcgcttgtcaccttgccatgtggaagaaactggcggaatggccaaagactatgacgggtcttcctagcacatcagggacaactgccagtgtggtcatcattcggggcatgaagatgtatgtagctcacgtaggtgactcaggggtggttcttggaattcaggatgacccgaaggatgactttgtcagagctgtggaggtgacacaggaccataagccagaacttcccaaggaaagagaacgaatcgaaggacttggtgggagtgtaatgaacaagtctggggtgaatcgtgtagtttggaaacgacctcgactcactcacaatggacctgttagaaggagcacagttattgaccagattccttttctggcagtagcaagagcacttggtgatttgtggagctatgatttcttcagtggtgaatttgtggtgtcacctgaaccagacacaagtgtccacactcttgaccctcagaagcacaagtatattatattggggagtgatggactttggaatatgattccaccacaagatgccatctcaatgtgccaggaccaagaggagaaaaaatacctgatgggtgagcatggacaatcttgtgccaaaatgcttgtgaatcgagcattgggccgctggaggcagcgtatgctccgagcagataacactagtgccatagtaatctgcatctctccagaagtggacaatcagggaaactttaccaatgaagatgagttatacctgaacctgactgacagcccttcctataatagtcaagaaacctgtgtgatgactccttccccatgttctacaccaccagtcaaggattttggatttgaactcgattcaagaaagtgatgtaacttattatcagagagccatctttacatcaatactaatctgaatgccagccatgtgtacagcactaataaaaagtcactggaggaggatccatggccaagggtgaattctaaggaccatatacctgccctggttcgtagcaatgccttctcagagaattttttagaggtttcagctgagatagctcgagagaatgtccaaggtgtagtcataccctcaaaagatccagaaccacttgaagaaaattgcgctaaagccctgactttaaggatacatgattctttgaataatagccttccaattggccttgtgcctactaattcaacaaacactgtcatggaccaaaaaaatttgaagatgtcaactcctggccaaatgaaagcccaagaaattgaaagaacccctccaacaaactttaaaaggacattagaagagtccaattctggccccctgatgaagaagcatagacgaaatggcttaagtcgaagtagtggtgctcagcctgcaagtctcc

SEQ ID NO: 3383 - DNA, 4838 bp, Homo sapiens
ggagaagttagtaaaaccgaatctgacatcatcacctagcagttcatgcagctagcaagtggtttgttcttagggtaacagaggaggaaattgttcctcgtctgataagacaacagtggagaaaggacgcatgctgtttcttagggacacggctgacttccagatatgaccatgtatttgtggcttaaactcttggcatttggctttgcctttctggacacagaagtatttgtgacagggcaaagcccaacaccttcccccactgatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgagataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggccaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatagtttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttctccaatgcttagaatgtttttaccaggaatggatgtcgctaatcataataaaattcaaccattatttttttcttgtttataatacattgtgttatatgttcaaatatgaaatgtgtatgcacctattgaaatatgtttaatgcatttattaacatttgcaggacacttttacaggccccaattatccaatagtctaataattgtttaagatctag

SEQ ID NO: 3384 - DNA, 1098 bp, Homo sapiens
ggagaagttagtaaaaccgaatctgacatcatcacctagcagttcatgcagctagcaagtggtttgttcttagggtaacagaggaggaaattgttcctcgtctgataagacaacagtggagaaaggacgcatgctgtttcttagggacacggctgacttccagatatgaccatgtatttgtggcttaaactcttggcatttggctttgcctttctggacacagaagtatttgtgacagggcaaagcccaacaccttcccccactggtaagaattaatatttatatttttactaattttattttcttgttgcaaagtttatatatttaactacaattttctattattaacactgaaattatttttaaggataaattttataatcatgagtgattcttgacattcacttgttcttaaactttctgcttatacgttatagagtttaataactacctaaacatgttattaaatttgtatatatattttgtgtataaatagtaacttttcccaaacttgacagtaaatcacacaacaggtttctactctcttttaatattttaagactataaaaaaatgcatttaaattagataacaaaattttatagtctgaaagcaggttaacagctgtctatgtatgttatagatatgtagataacagatttgcatatgtctatatttctttaagagtatgttgcttttttcaatggtatgcaaaacctttgagactattgagatatttttaaataataattttcaaattctactgaacacttcaatagtccttataaatgtcttaatcatgagataaatttaaaacacagagatgctgcaaataaattcatacatagtacatacaaaataagagaaaaaattaaattgcagatggttaaatatcacatcacttaactgatgttactgaaaatgtattttcctgcataatcatatggttgacagtatgcattaagaaggtaagtaaaacaatgaagacaattttgatttaatatggtaatgcacaattccaactaacgtacattcaacagatcatgaaattgggttattaaaatgaatatttttgtcattaaataaaaattccgtccaaa

SEQ ID NO: 3385 - DNA, 448 bp, Homo sapiens
catggctcgaatgaaccgcccagctcctgtggaagtcacatacaagaacatgagatttcttattacacacaatccaaccaatgcgaccttaaacaaatttatagaggaacttaagaagtatggagttaccacaatagtaagagtatgtgaagcaacttatgacactactcttgtggagaaagaaggtatccatgttcttgattggccttttgatgatggtgcaccaccatccaaccagattgttgatgactggttaagtcttgtgaaaattaagtttcgtgaagaacctggttgttgtattgctgttcattgcgttgcaggccttgggagaaagcggcgtggagcttttaacagcaagcaacttctgtatttggagaagtatcgtcctaaaatgcggctgcgtttcaaagattccaacggtcatagaaacaactgttgcattcaataa

SEQ ID NO: 3386 - DNA, 3294 bp, Homo sapiens
cccccgccgccgcctgcatcgccgccaccgccgctccgccacgaccaccgccgcctcctgccctgcagccaccgccaccgcctgtgtcgccgccgcctcgggaccggctgtatgattaggccacaatcttcaatgagtaaacatattcctcaattctgtggtgttcttggtcacacatttatggagtttctgaagggcagtggagattactgccaggcacagcacgacctctatgcagacaagtgaactgtagaaactgattactgctccaccaagaagcccccataagagtggttatcctggacacagaagtgttgaattgaaatccacagagcattttacaagagttctgacctggatggggtaaacctcagtgcacttcttttctgttggcctcagtattactggattgaagaattgctgcttcttgttaggaggttcatttcacttatcattacttacaacttcatactcaaagcactgagaatttcaagtggagtatattgaagtagacttcagtttctttgcatcatttctgtattcaatttttttaattatttcataaccctattgagtgttttttaactaaattaacatggctcgaatgaaccgcccagctcctgtggaagtcacatacaagaacatgagatttcttattacacacaatccaaccaatgcgaccttaaacaaatttatagaggaacttaagaagtatggagttaccacaatagtaagagtatgtgaagcaacttatgacactactcttgtggagaaagaaggtatccatgttcttgattggccttttgatgatggtgcaccaccatccaaccagattgttgatgactggttaagtcttgtgaaaattaagtttcgtgaagaacctggttgttgtattgctgttcattgcgttgcaggccttgggagaaagcggcgtggagcttttaacagcaagcaacttctgtatttggagaagtatcgtcctaaaatgcggctgcgtttcaaagattccaacggtcatagaaacaactgttgcattcaataaaattggggtgcctaatgctactggaagtggaacttgagatagggcctaatttgttatacatattagccaacatgttggcttagtaagtctaatgaagcttccataggagtattgaaaggcagttttaccaggcctcaagctagacagatttggcaacctctgtatttgggttacagtcaacctatttggatacttggcaaaagattcttgctgtcagcatataaaatgtgcttgtcatttgtatcaattgacctttccccaaatcatgcagtattgagttatgacttgttaaatctattcccatgccagaatcttatcaatacataagaaatttaggaagattaggtgccaaaatacccagcacaatacttgtatatttttagtaccatacagaagtaaaatcccaggaactatgaacactagaccttatgtggtttattccttcaatcatttcaaacattgaaagtagggcctacatggttatttgcctgctcactttatgtttacatctcccacattcataccaatatacgtcaggtttgcttaaccattgatttttttttttttttaccaagtcttacagtgattattttacgtgtttccatgtatctcactttgtgctgtattaaaaaaacctccattttgaaaatctacgttgtacagaagcacatgtctttaatgtcttcagacaaaaaagccttacattaatttaatgtttgcactctgaggtgcaacttaacagggagggcctgagaaaagaatgggagggggctattaattatttttagcaaaatgttgcctttgtcttgtgcaaacatgtagaatatgctctttaatttagtaaaatatttttttaaaaggtagagatgctttgttattgtaatcataaacttcctgaaattcttgtaatttttttcccatacttatcagaagtgtgtttaccaacttatttttgtttgaaagtgtgattttttttttccttcccaacctctcttgcaaaaaaagaaatgggtttctgctaatgaattgagcagacatctaatattttatatgccttttgagctgtgtaacttaatatttggatacttgacaatttgttttattatgtaattgataaaatggtgatgtgtattaatgttagttcaaccatatatttatactgtctggggatgtgtggttatagttctgtgggagaaataattttgtcagtgttcaccagcttgtaaaaacttagtgcgagagctgaaacatctaaataaataatgacatgcatttatcatcattgagattggtttgcttaaaattaacttattttgtagaagacaaaatgaattgcacttcacttaatgtgtgtcctcatctttttacaaataaatgaaggattataaatgatgtcagcattttagtaaacttttagacaaaatttgttagggtcattcatgaaaactttaatactaaaagcactttccattatatactttttaaaggtctagataattttgaaccaatttattattgtgtactgaggagaaataatgtatagtagaggacagccttggtttgtaaagctcagttccactagttcatggttttgtgcaacttctgagcctcagttttctcctttgcaaattaataattacatacctttatagattttgaaattaatttaaatattagtatttggtacatgaaggcttaatgttaagtttcctttaatgatccacaataatccctttgatcacgttaatctaaatctagatgtctttgtctaattttttttgaatagcagttataaatgtaaaggactcaaagtttaagtaaaaagtgatactccaccttgtgtttcaaagaatttagttccacctcttcataccagtttaacacttaatatatttcattggattttagacagggcaaaaggaagaacaggggcctctggaggcccttggttatttaaatcttggattatttgtgatagtaatcacaaatttttggctaatttttaacctgaggttttgttttttttttaaaggaaatgcagcctagtcttgagaacataattttatataatcaattactaaatgttaaactattaccacacagcccataaaacagcatttgcgtttattgagagagaggatgtgccatcatgattaatgaaaactatcttttgagtttgaaaagaaattaatttgcagtgtttggattgtatatatggtgctaaaaataaattaatttactttataaacctt

SEQ ID NO: 3387 - DNA, 4611 bp, Homo sapiens
cgtgtattggctccttcggctgcgggccggctcggctacgcgctctgctccgagccgctcactgcatggtagagtctggtgcccccgccgccgcctgcatcgccgccaccgccgctccgccacgaccaccgccgcctcctgccctgcagccaccgccaccgcctgtgtcgccgccgcctcgggaccggctgtatgattaggccacaatcttcaatgagtaaacatattcctcaattctgtggtgttcttggtcacacatttatggagtttctgaagggcagtggagattactgccaggcacagcacgacctctatgcagacaagtgaactgtagaaactgattactgctccaccaagaagcccccataagagtggttatcctggacacagaagtgttgaattgaaatccacagagcattttacaagagttctgacctggatggggtaaacctcagtgcacttcttttctgttggcctcagtattactggattgaagaattgctgcttcttgttaggaggttcatttcacttatcattacttacaacttcatactcaaagcactgagaatttcaagtggagtatattgaagtagacttcagtttctttgcatcatttctgtattcaatttttttaattatttcataaccctattgagtgttttttaactaaattaacatggctcgaatgaaccgcccagctcctgtggaagtcacatacaagaacatgagatttcttattacacacaatccaaccaatgcgaccttaaacaaatttatagaggaacttaagaagtatggagttaccacaatagtaagagtatgtgaagcaacttatgacactactcttgtggagaaagaaggtatccatgttcttgattggccttttgatgatggtgcaccaccatccaaccagattgttgatgactggttaagtcttgtgaaaattaagtttcgtgaagaacctggttgttgtattgctgttcattgcgttgcaggccttgggagagctccagtacttgttgccctagcattaattgaaggtggaatgaaatacgaagatgcagtacaattcataagacaaaagcggcgtggagcttttaacagcaagcaacttctgtatttggagaagtatcgtcctaaaatgcggctgcgtttcaaagattccaacggtcatagaaacaactgttgcattcaataaaattggggtgcctaatgctactggaagtggaacttgagatagggcctaatttgttatacatattagccaacatgttggcttagtaagtctaatgaagcttccataggagtattgaaaggcagttttaccaggcctcaagctagacagatttggcaacctctgtatttgggttacagtcaacctatttggatacttggcaaaagattcttgctgtcagcatataaaatgtgcttgtcatttgtatcaattgacctttccccaaatcatgcagtattgagttatgacttgttaaatctattcccatgccagaatcttatcaatacataagaaatttaggaagattaggtgccaaaatacccagcacaatacttgtatatttttagtaccatacagaagtaaaatcccaggaactatgaacactagaccttatgtggtttattccttcaatcatttcaaacattgaaagtagggcctacatggttatttgcctgctcactttatgtttacatctcccacattcataccaatatacgtcaggtttgcttaaccattgatttttttttttttttaccaagtcttacagtgattattttacgtgtttccatgtatctcactttgtgctgtattaaaaaaacctccattttgaaaatctacgttgtacagaagcacatgtctttaatgtcttcagacaaaaaagccttacattaatttaatgtttgcactctgaggtgcaacttaacagggagggcctgagaaaagaatgggagggggctattaattatttttagcaaaatgttgcctttgtcttgtgcaaacatgtagaatatgctctttaatttagtaaaatatttttttaaaaggtagagatgctttgttattgtaatcataaacttcctgaaattcttgtaatttttttcccatacttatcagaagtgtgtttaccaacttatttttgtttgaaagtgtgattttttttttccttcccaacctctcttgcaaaaaaagaaatgggtttctgctaatgaattgagcagacatctaatattttatatgccttttgagctgtgtaacttaatatttggatacttgacaatttgttttattatgtaattgataaaatggtgatgtgtattaatgttagttcaaccatatatttatactgtctggggatgtgtggttatagttctgtgggagaaataattttgtcagtgttcaccagcttgtaaaaacttagtgcgagagctgaaacatctaaataaataatgacatgcatttatcatcattgagattggtttgcttaaaattaacttattttgtagaagacaaaatgaattgcacttcacttaatgtgtgtcctcatctttttacaaataaatgaaggattataaatgatgtcagcattttagtaaacttttagacaaaatttgttagggtcattcatgaaaactttaatactaaaagcactttccattatatactttttaaaggtctagataattttgaaccaatttattattgtgtactgaggagaaataatgtatagtagaggacagccttggtttgtaaagctcagttccactagttcatggttttgtgcaacttctgagcctcagttttctcctttgcaaattaataattacatacctttatagattttgaaattaatttaaatattagtatttggtacatgaaggcttaatgttaagtttcctttaatgatccacaataatccctttgatcacgttaatctaaatctagatgtctttgtctaattttttttgaatagcagttataaatgtaaaggactcaaagtttaagtaaaaagtgatactccaccttgtgtttcaaagaatttagttccacctcttcataccagtttaacacttaatatatttcattggattttagacagggcaaaaggaagaacaggggcctctggaggcccttggttatttaaatcttggattatttgtgatagtaatcacaaatttttggctaatttttaacctgaggttttgttttttttttaaaggaaatgcagcctagtcttgagaacataattttatataatcaattactaaatgttaaactattaccacacagcccataaaacagcatttgcgtttattgagagagaggatgtgccatcatgattaatgaaaactatcttttgagtttgaaaagaaattaatttgcagtgtttggattgtatatatggtgctaaaaataaattaatttactttataaaccttatctgtacattatacgatgtgatgaaatttgctttttatccaaatattttgtatcttgtaaatatggctaattataggaatgcctataatacatcttagattccttatatctaataagagttcaaagagttatgagttgaagtcttgaatgcaggaaactatctgatagtgttctaaaatttggttacttgggtttggatacccttagtgggatgatgtaaatagaggctagctacctaggcttgtctatagcaaccataatgttgatgtaagtaatgcggttactgaatcataagaaaatgccatctctttttagttgaaggaaaactctggaagtaggtgccattggtcattctgcagtgcactgcaaccattgtttcccctagtgccctcttttccctagggcattgctctcctattcccacgccttaacacagctctatacctagaagcagccagcccaggcatgcagtcacatttaatcacatcccccttctagagtgcttcaaaatgatgtagtccctcaacttggctaaagaatctcaatctcttgaaatttatttttttaatgtcatattcatctggtaaatatctactgtttgccaggcatttaagaatatggcaaagaacataaaagatggtgtcaccagattttggtcaccaatgagtacccgacccgttgccatgattaagagagaatgctttctattggagtttcaggaaatataatttgagaatactttaaagggaagtggaagtataagtgaatgatatttttcttttacatgtaaacaatgaagttatttcaaagttaagttttaaacaaaatacatgaagtagtgtctgccatacatgttaatattctacattcttgcttccttaaattaatatgtttgtgtgtatatatgtgcctcacacctgaattgaaaattaaagactggtttaaaagtggtttaaaagtgacatttaatgtttctccattacgtttggggtaaccagcctaagtggaatcttggaaggaaagtaagggaaaaacttgtatttgccttcaatgaattaaaccagtgatatgtgttaacgtatgaatgaaaggattgatggtgattttataattatatatattgccgcagtaaccagttaataaattgatagctaccattt

SEQ ID NO: 3388 - DNA, 3529 bp, Homo sapiens
gtgatgcgtagttccggctgccggttgacatgaagaagcagcagcggctagggcggcggtagctgcaggggtcggggattgcagcgggcctcggggctaagagcgcgacgcggcctagagcggcagacggcgcagtgggccgagaaggaggcgcagcagccgccctggcccgtcatggagatggaaaaggagttcgagcagatcgacaagtccgggagctgggcggccatttaccaggatatccgacatgaagccagtgacttcccatgtagagtggccaagcttcctaagaacaaaaaccgaaataggtacagagacgtcagtccctttgaccatagtcggattaaactacatcaagaagataatgactatatcaacgctagtttgataaaaatggaagaagcccaaaggagttacattcttacccagggccctttgcctaacacatgcggtcacttttgggagatggtgtgggagcagaaaagcaggggtgtcgtcatgctcaacagagtgatggagaaaggttcgttaaaatgcgcacaatactggccacaaaaagaagaaaaagagatgatctttgaagacacaaatttgaaattaacattgatctctgaagatatcaagtcatattatacagtgcgacagctagaattggaaaaccttacaacccaagaaactcgagagatcttacatttccactataccacatggcctgactttggagtccctgaatcaccagcctcattcttgaactttcttttcaaagtccgagagtcagggtcactcagcccggagcacgggcccgttgtggtgcactgcagtgcaggcatcggcaggtctggaaccttctgtctggctgatacctgcctcttgctgatggacaagaggaaagacccttcttccgttgatatcaagaaagtgctgttagaaatgaggaagtttcggatggggctgatccagacagccgaccagctgcgcttctcctacctggctgtgatcgaaggtgccaaattcatcatgggggactcttccgtgcaggatcagtggaaggagctttcccacgaggacctggagcccccacccgagcatatccccccacctccccggccacccaaacgaatcctggagccacacaatgggaaatgcagggagttcttcccaaatcaccagtgggtgaaggaagagacccaggaggataaagactgccccatcaaggaagaaaaaggaagccccttaaatgccgcaccctacggcatcgaaagcatgagtcaagacactgaagttagaagtcgggtcgtggggggaagtcttcgaggtgcccaggctgcctccccagccaaaggggagccgtcactgcccgagaaggacgaggaccatgcactgagttactggaagcccttcctggtcaacatgtgcgtggctacggtcctcacggccggcgcttacctctgctacaggttcctgttcaacagcaacacatagcctgaccctcctccactccacctccacccactgtccgcctctgcccgcagagcccacgcccgactagcaggcatgccgcggtaggtaagggccgccggaccgcgtagagagccgggccccggacggacgttggttctgcactaaaacccatcttccccggatgtgtgtctcacccctcatccttttactttttgccccttccactttgagtaccaaatccacaagccattttttgaggagagtgaaagagagtaccatgctggcggcgcagagggaaggggcctacacccgtcttggggctcgccccacccagggctccctcctggagcatcccaggcgggcggcacgccaacagccccccccttgaatctgcagggagcaactctccactccatatttatttaaacaattttttccccaaaggcatccatagtgcactagcattttcttgaaccaataatgtattaaaattttttgatgtcagccttgcatcaagggctttatcaaaaagtacaataataaatcctcaggtagtactgggaatggaaggctttgccatgggcctgctgcgtcagaccagtactgggaaggaggacggttgtaagcagttgttatttagtgatattgtgggtaacgtgagaagatagaacaatgctataatatataatgaacacgtgggtatttaataagaaacatgatgtgagattactttgtcccgcttattctcctccctgttatctgctagatctagttctcaatcactgctcccccgtgtgtattagaatgcatgtaaggtcttcttgtgtcctgatgaaaaatatgtgcttgaaatgagaaactttgatctctgcttactaatgtgccccatgtccaagtccaacctgcctgtgcatgacctgatcattacatggctgtggttcctaagcctgttgctgaagtcattgtcgctcagcaatagggtgcagttttccaggaataggcatttgcctaattcctggcatgacactctagtgacttcctggtgaggcccagcctgtcctggtacagcagggtcttgctgtaactcagacattccaagggtatgggaagccatattcacacctcacgctctggacatgatttagggaagcagggacaccccccgccccccacctttgggatcagcctccgccattccaagtcaacactcttcttgagcagaccgtgatttggaagagaggcacctgctggaaaccacacttcttgaaacagcctgggtgacggtcctttaggcagcctgccgccgtctctgtcccggttcaccttgccgagagaggcgcgtctgccccaccctcaaaccctgtggggcctgatggtgctcacgactcttcctgcaaagggaactgaagacctccacattaagtggctttttaacatgaaaaacacggcagctgtagctcccgagctactctcttgccagcattttcacattttgcctttctcgtggtagaagccagtacagagaaattctgtggtgggaacattcgaggtgtcaccctgcagagctatggtgaggtgtggataaggcttaggtgccaggctgtaagcattctgagctgggcttgttgtttttaagtcctgtatatgtatgtagtagtttgggtgtgtatatatagtagcatttcaaaatggacgtactggtttaacctcctatccttggagagcagctggctctccaccttgttacacattatgttagagaggtagcgagctgctctgctatatgccttaagccaatatttactcatcaggtcattattttttacaatggccatggaataaaccatttttacaaaaataaaaacaaaaaaagcaaggtgttttggtataataccttttcaggtgtgtgtggatacgtggctgcatgaccgggtgggtgggggggagtgtctcagggtcttctgtgacctcacagaactgtcagactgtacagttttccaacttgccatattcatgatgggtttgcattttagctgcaacaataaaatttttttctaaagaacatgaa

SEQ ID NO: 3389 - DNA, 1632 bp, Homo sapiens
atgaagaagcagcagcggctagggcggcggtagctgcaggggtcggggattgcagcgggcctcggggctaagagcgcgacgcggcctagagcggcagacggcgcagtgggccgagaaggaggcgcagcagccgccctggcccgtcatggagatggaaaaggagttcgagcagatcgacaagtccgggagctgggcggccatttaccagttgaccatagtcggattaaactacatcaagaagataatgactatatcaacgctagtttgataaaaatggaagaagcccaaaggagttacattcttacccagggccctttgcctaacacatgcggtcacttttgggagatggtgtgggagcagaaaagcaggggtgtcgtcatgctcaacagagtgatggagaaaggttcgttaaaatgcgcacaatactggccacaaaaagaagaaaaagagatgatctttgaagacacaaatttgaaattaacattgatctctgaagatatcaagtcatattatacagtgcgacagctagaattggaaaaccttacaacccaagaaactcgagagatcttacatttccactataccacatggcctgactttggagtccctgaatcaccagcctcattcttgaactttcttttcaaagtccgagagtcagggtcactcagcccggagcacgggcccgttgtggtgcactgcagtgcaggcatcggcaggtctggaaccttctgtctggctgatacctgcctcttgctgatggacaagaggaaagacccttcttccgttgatatcaagaaagtgctgttagaaatgaggaagtttcggatggggctgatccagacagccgaccagctgcgcttctcctacctggctgtgatcgaaggtgccaaattcatcatgggggactcttccgtgcaggatcagtggaaggagctttcccacgaggacctggagcccccacccgagcatatccccccacctccccggccacccaaacgaatcctggagccacacaatgggaaatgcagggagttcttcccaaatcaccagtgggtgaaggaagagacccaggaggataaagactgccccatcaaggaagaaaaaggaagccccttaaatgccgcaccctacggcatcgaaagcatgagtcaagacactgaagttagaagtcgggtcgtggggggaagtcttcgaggtgcccaggctgcctccccagccaaaggggagccgtcactgcccgagaaggacgaggaccatgcactgagttactggaagcccttcctggtcaacatgtgcgtggctacggtcctcacggccggcgcttacctctgctacaggttcctgttcaacagcaacacatagcctgaccctcctccactccacctccacccactgtccgcctctgcccgcagagcccacgcccgactagcaggcatgccgcggtaggtaagggccgccggaccgcgtagagagccgggccccggacggacgttggttctgcactaaaacccatcttccccggatgtgtgtctcacccctcatccttttactttttgccccttccactttgagtaccaaatccacaagccattttttgaggagagtgaaagagagtaccatgctggcggcgca

SEQ ID NO: 3390 - DNA, 6101 bp, Homo sapiens
ggaggagcgagccgggccggggggcagctgcacagtctccgggatccccaggcctggaggggggtctgtgcgcggccggctggctctgccccgcgtccggtcccgagcgggcctccctcgggccagcccgatgtgaccgagcccagcggagcctgagcaaggagcgggtccgtcgcggagccggagggcgggaggaacatgacatcgcggagatggtttcacccaaatatcactggtgtggaggcagaaaacctactgttgacaagaggagttgatggcagttttttggcaaggcctagtaaaagtaaccctggagacttcacactttccgttagaagaaatggagctgtcacccacatcaagattcagaacactggtgattactatgacctgtatggaggggagaaatttgccactttggctgagttggtccagtattacatggaacatcacgggcaattaaaagagaagaatggagatgtcattgagcttaaatatcctctgaactgtgcagatcctacctctgaaaggtggtttcatggacatctctctgggaaagaagcagagaaattattaactgaaaaaggaaaacatggtagttttcttgtacgagagagccagagccaccctggagattttgttctttctgtgcgcactggtgatgacaaaggggagagcaatgacggcaagtctaaagtgacccatgttatgattcgctgtcaggaactgaaatacgacgttggtggaggagaacggtttgattctttgacagatcttgtggaacattataagaagaatcctatggtggaaacattgggtacagtactacaactcaagcagccccttaacacgactcgtataaatgctgctgaaatagaaagcagagttcgagaactaagcaaattagctgagaccacagataaagtcaaacaaggcttttgggaagaatttgagacactacaacaacaggagtgcaaacttctctacagccgaaaagagggtcaaaggcaagaaaacaaaaacaaaaatagatataaaaacatcctgccctttgatcataccagggttgtcctacacgatggtgatcccaatgagcctgtttcagattacatcaatgcaaatatcatcatgcctgaatttgaaaccaagtgcaacaattcaaagcccaaaaagagttacattgccacacaaggctgcctgcaaaacacggtgaatgacttttggcggatggtgttccaagaaaactcccgagtgattgtcatgacaacgaaagaagtggagagaggaaagagtaaatgtgtcaaatactggcctgatgagtatgctctaaaagaatatggcgtcatgcgtgttaggaacgtcaaagaaagcgccgctcatgactatacgctaagagaacttaaactttcaaaggttggacaagggaatacggagagaacggtctggcaataccactttcggacctggccggaccacggcgtgcccagcgaccctgggggcgtgctggacttcctggaggaggtgcaccataagcaggagagcatcatggatgcagggccggtcgtggtgcactgcagtgctggaattggccggacagggacgttcattgtgattgatattcttattgacatcatcagagagaaaggtgttgactgcgatattgacgttcccaaaaccatccagatggtgcggtctcagaggtcagggatggtccagacagaagcacagtaccgatttatctatatggcggtccagcattatattgaaacactacagcgcaggattgaagaagagcagaaaagcaagaggaaagggcacgaatatacaaatattaagtattctctagcggaccagacgagtggagatcagagccctctcccgccttgtactccaacgccaccctgtgcagaaatgagagaagacagtgctagagtctatgaaaacgtgggcctgatgcaacagcagaaaagtttcagatgagaaaacctgccaaaacttcagcacagaaatagatgtggactttcaccctctccctaaaaagatcaagaacagacgcaagaaagtttatgtgaagacagaatttggatttggaaggcttgcaatgtggttgactaccttttgataagcaaaatttgaaaccatttaaagaccactgtattttaactcaacaatacctgcttcccaattactcatttcctcagataagaagaaatcatctctacaatgtagacaacattatattttatagaatttgtttgaaattgaggaagcagttaaattgtgcgctgtattttgcagattatggggattcaaattctagtaataggcttttttatttttatttttatacccttaaccagtttaattttttttttcctcattgttggggatgatgagaagaaatgatttgggaaaattaagtaacaacgacctagaaaagtgagaacaatctcatttaccatcatgtatccagtagtggataattcattttgatggcttctatttttggccaaatgagaattaagccagtgcctgagactgtcagaagttgacctttgcactggcattaaagagtcatagaaaaagaatcatggatatttatgaattaaggtaagaggtgtggcttttttttttttcttttttccagccgttgaccaattatagttcggctgttgactgagaagtttgtggtgggaaaacgtttgccatattttctttgcatttgaataattgtcttgtacttagaaaaaaggcgtctatgaatgaccagtgtttttggtcgccaaatgttgctgacaaacttatcccaaaactttagtggcttaaaaaaacctgcccccaactgttagtcaatctgagctgggctcagctgggctgttcttctgccagcctgcaggtggccactcatgtggtcagcaggtcggcggagagactgggatggctgggcttctctctctgcctgcagtcctgagtctctccttcttcgtgtagtctctttcagtggcctggctggcagggtagctagacctctcacatgcagctcagagctcccaagagctcaaaagcagaaatggccaggccttctgaaaacttaagtccagaattgtcacagtgtcccttctacttccctctattgatgatgatgatgatgatgatgatgatgatgatgatgatgatgatggttttttctaatcagaagaaagctggggtatgccctctacttactaaacaagtcacaagcccagctcagattcaagaaaagggtgtgaagtagaggtgcagttaagtggggggccactagtctaacagacggtcacaaccagtgccatggaaaaccaaggatattagcaaaagcagaagttgctagtgaccttgggaagccgaagctgcttacagtagctgggacaagctgaaagtcagactaagaaataaagagagggccttcaagaagcttcctgaatgatttctgctagccctgagcctatttttggaaccagcacttggggaaactgatcttgtgaggatggatgtgtttagggacacagggcttttgagagcagcaccaccccactggggcatccccagacttgggaaacgtgactctttcttaatgccactgggttttagtcaggccacagtgagaaggaacagccctaacaggcctccagccaggttgaatgagctcatttttgttgtagccaaccagtaagatttgctaatgttctacattaagtgccttctccaaagacatccctctttgcctcatatgttgaatcatccagtgcggatatttcaatgaaaatatcattggttgacttttgtgatggtaataatgctatggcatctttgccatgaagttgtggcctccttggattcttctgactttggcttctgaaaggaaggcctagatccagccctggtggtagttcctttctgaggtctctcagtcccttgagactttggggtagtttggctgccattctcactgacaaaatgtatatcagcccccacctccaccccccaatattccttgaactttgaattgcttcagaacacaggtgtggcctgaaggtattcccttattagggaagtgtcactgctgtcttctagtcaaacttgtaaagaaaaagattccagttcagtatttgcagcaagaagcttgaatgctgttctttttatcgcattgttacatcgactcattctccattttgctttggttttgtcttgacttgacttgactttgggggtaaagtctttcaccagcacacaagagtttgattgtacaaatatatcttctgcattaacatctctgcctgttgcttaagatcagttgcttttatactcagaatggaaatacctgatcttggctagttttgttataagatattgatttcatttagatttccctccacgaggtcagcaaactatcatgttcttatgtaaacttaggccaaggccagagttatcatagtccctaggttgctacggcttatcatgtgcttggtaaaaggtgatcgcaggttctcagacgagtttactttacatgagatggaatcaggcagagaggctgggatgatggagaaagctcgaggtgaagttttaaaaaaaaagttgtggaaaggaaagttccaaagaggtggtttctgaggaagtcagagcgcccagggccagagcagtcagtaatgggtgaatgaggttgtttggaaagtcggtgtgacagacacatggatgccatctacttctaggttgctggtgggtattaaatatgcacaatattccatagctcactgaggattttaaaattataagcataggattttatattttggggtgaaagaattatctggcacattaggtattggagtttaaaaaaaaagccaaatttcacagtcttaataactttttttaaaaaaaactaaaaggcgcttcatgtccagtgtgtggcccttctgaaacttatggtcatctctcccactgaaaccaaggtcttttcaaatgtggctaaatggggatgaggagacacgggtaggactttcttggtgtgtgtgcattctttaaagagccaagttgcttcggggaaacagccaggaaaatggtcaagattatttttagaggttattttattggggattttaagaactaataacatcttgagttatttttaattcagggggatgtggaaaggtttgcaattgtcaagtgttttgttgtagcttagtatccataagggaaacttagactatagacataactacaaagccagtgcagcttttgttttctgtatgttgttgggggatcaactttcacacatagcaagcacatggcctccctgatgtcaggatgcctttgttaggatctgtatttgcccttaattttgttgaaatcttttttccttcttcctcttgaaaagttccaaaatatagtttattgtatctttcatcactaaaaatttgttcctttttcactatgggcagttcacacaaggcaaaaactattgaacagttggttttagtgtgttgtataactttgctgtatatcaaactaattttgacaagttttcatcctaagcctcaaatcatgtaattaataatttgcctgtttatttatgacctaattgtgattcttttattaataaaagctaatgggaaaaggatccctgattaagctgatgactagacctacaattaattttcctgcagtatatgaagtattgtaccagagtattaaaagatatgtaatattttattgataaatctatcctttaaaaggaatacgttttaggatgtcatcattttgatgtgaatcatgtaaatgttgataatatgctgtttattatacatttagtgtttcaagagattcacttaattgcctttttgcccacgtatattatgtagtctatttgcaactgttcttaaaaaaatgacattaaaagaatagtttatgtagagaaacattagtggatgttaattgtctccccacctatatttatgggtgttagcgcaactgctttgctagttgcaaagctgtattatcagagtaaaagtgtatttgtaaactgtatgggaactaaaaattaggaataaaaccattttcttatatga

SEQ ID NO: 3391 - DNA, 801 bp, Homo sapiens
ccccaggcctggaggggggtctgtgcgcggccggctggctctgccccgcgtccggtcccgagcgggcctccctcgggccagcccgatgtgaccgagcccagcggagcctgagcaaggagcgggtccgtcgcggagccggagggcgggaggaacatgacatcgcggagatggtttcacccaaatatcactggtgtggaggcagaaaacctactgttgacaagaggagttgatggcagttttttggcaaggcctagtaaaagtaaccctggagacttcacactttccgttagaagaaatggagctgtcacccacatcaagattcagaacactggtgattactatgacctgtatggaggggagaaatttgccactttggctgagttggtccagtattacatggaacatcacgggcaattaaaagagaagaatggagatgtcattgagcttaaatatcctctgaactgtgcagatcctacctctgaaaggtggtttcatggacatctctctgggaaagaagcagagaaattattaactgaaaaaggaaaacatggtagttttcttgtacgagagagccagagccaccctggagattttgttctttctgtgcgcactggtgatgacaaaggggagagcaatgacggcaagtctaaagtgacccatgttatgattcgctgtcaggaactgaaatacgacgttggtggaggagaacggtttgattctttgacagatcttgtggaacattataagaagaatcctatggtggaaacattgggtacagtactacaactcaagcagccattg

SEQ ID NO: 3392 - DNA, 1876 bp, Homo sapiens
gcggaggaggagcgagccgggccggggggcagctgcacagtctccgggatccccaggcctggaggggggtctgtgcgcggccggctggctctgccccgcgtccggtcccgagcgggcctccctcgggccagcccgatgtgaccgagcccagcggagcctgagcaaggagcgggtccgtcgcggagccggagggcgggaggaacatgacatcgcggagatggtttcacccaaatatcactggtgtggaggcagaaaacctactgttgacaagaggagttgatggcagttttttggcaaggcctagtaaaagtaaccctggagacttcacactttccgttagaagaaatggagctgtcacccacatcaagattcagaacactggtgattactatgacctgtatggaggggagaaatttgccactttggctgagttggtccagtattacatggaacatcacgggcaattaaaagagaagaatggagatgtcattgagcttaaatatcctctgaactgtgcagatcctacctctgaaaggtggtttcatggacatctctctgggaaagaagcagagaaattattaactgaaaaaggaaaacatggtagttttcttgtacgagagagccagagccaccctggagattttgttctttctgtgcgcactggtgatgacaaaggggagagcaatgacggcaagtctaaagtgacccatgttatgattcgctgtcaggaactgaaatacgacgttggtggaggagaacggtttgattctttgacagatcttgtggaacattataagaagaatcctatggtggaaacattgggtacagtactacaactcaagcagccccttaacacgactcgtataaatgctgctgaaatagaaagcagagttcgagaactaagcaaattagctgagaccacagataaagtcaaacaaggcttttgggaagaatttgagacactacaacaacaggagtgcaaacttctctacagccgaaaagagggtcaaaggcaagaaaacaaaaacaaaaatagatataaaaacatcctgccctttgatcataccagggttgtcctacacgatggtgatcccaatgagcctgtttcagattacatcaatgcaaatatcatcatgcctgaatttgaaaccaagtgcaacaattcaaagcccaaaaagagttacattgccacacaaggctgcctgcaaaacacggtgaatgacttttggcggatggtgttccaagaaaactcccgagtgattgtcatgacaacgaaagaagtggagagaggaaagagtaaatgtgtcaaatactggcctgatgagtatgctctaaaagaatatggcgtcatgcgtgttaggaacgtcaaagaaagcgccgctcatgactatacgctaagagaacttaaactttcaaaggttggacaagggaatacggagagaacggtctggcaataccactttcggacctggccggaccacggcgtgcccagcgaccctgggggcgtgctggacttcctggaggaggtgcaccataagcaggagagcatcatggatgcagggccggtcgtggtgcactgcaggtgacagctcctgctgcccctctaggccacagcctgtccctgtctcctagcgcccagggcttgcttttacctacccactcctagctctttaactgtaggaagaatttaatatctgtttgaggcatagagcaactgcattgagggacattttgatcccaaggcatatttctcctagaccctacagcactgccattggccatggccatggcaacatgctcagttaaaacagcaaagactaagtcagcattatctctgagtccaccagaagttgtgcattaaacaacttcatcctgg

SEQ ID NO: 3393 - DNA, 5444 bp, Homo sapiens
ggagaagttagtaaaaccgaatctgacatcatcacctagcagttcatgcagctagcaagtggtttgttcttagggtaacagaggaggaaattgttcctcgtctgataagacaacagtggagaaaggacgcatgctgtttcttagggacacggctgacttccagatatgaccatgtatttgtggcttaaactcttggcatttggctttgcctttctggacacagaagtatttgtgacagggcaaagcccaacaccttcccccactggccatctgcaagctgaggagcaaggaagccaatccaagtcaccaaacctcaaaagtagggaagctgacagttcagccttcagttggtggccaaaggcccgagagcccctcacaaaccactggagattgactacagcaaagatgcccagtgttccactttcaagtgaccccttacctactcacaccactgcattctcacccgcaagcacctttgaaagagaaaatgacttctcagagaccacaacttctcttagtccagacaatacttccacccaagtatccccggactctttggataatgctagtgcttttaataccacaggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcagatgtcccaggagagaggagtacagccagcacctttcctacagacccagtttccccattgacaaccaccctcagccttgcacaccacagctctgctgccttacctgcacgcacctccaacaccaccatcacagcgaacacctcagatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgagataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggccaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatagtttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttctccaatgcttagaatgtttttaccaggaatggatgtcgctaatcataataaaattcaaccattatttttttcttgtttataatacattgtgttatatgttcaaatatgaaatgtgtatgcacctattgaaatatgtttaatgcatttattaacatttgcaggacacttttacaggccccaattatccaatagtctaataattgtttaagatctag

SEQ ID NO: 3394 - DNA, 4626 bp, Homo sapiens
agaggaggaaattgttcctcgtctgataagacaacagtggagaaaggacgcatgctgtttcttagggacacggctgacttccagatatgaccatgtatttgtggcttaaactcttggcatttggctttgcctttctggacacagaagtatttgtgacagggcaaagcccaacaccttcccccactgatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgagataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggccaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatagtttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttctccaatgcttagaatgtttttaccaggaatggatgtcgctaatcataataaaattcaaccattatttttttcttgtttataa

SEQ ID NO: 3395 - DNA, 5177 bp, Homo sapiens
ggagaagttagtaaaaccgaatctgacatcatcacctagcagttcatgcagctagcaagtggtttgttcttagggtaacagaggaggaaattgttcctcgtctgataagacaacagtggagaaaggacgcatgctgtttcttagggacacggctgacttccagatatgaccatgtatttgtggcttaaactcttggcatttggctttgcctttctggacacagaagtatttgtgacagggcaaagcccaacaccttcccccactggattgactacagcaaagatgcccagtgttccactttcaagtgaccccttacctactcacaccactgcattctcacccgcaagcacctttgaaagagaaaatgacttctcagagaccacaacttctcttagtccagacaatacttccacccaagtatccccggactctttggataatgctagtgcttttaataccacaggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcagatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgagataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggccaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatagtttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttctccaatgcttagaatgtttttaccaggaatggatgtcgctaatcataataaaattcaaccattatttttttcttgtttataatacattgtgttatatgttcaaatatgaaatgtgtatgcacctattgaaatatgtttaatgcatttattaacatttgcaggacacttttacaggccccaattatccaatagtctaataattgtttaagatctag

SEQ ID NO: 3396 - DNA, 5123 bp, Homo sapiens
ggagaagttagtaaaaccgaatctgacatcatcacctagcagttcatgcagctagcaagtggtttgttcttagggtaacagaggaggaaattgttcctcgtctgataagacaacagtggagaaaggacgcatgctgtttcttagggacacggctgacttccagatatgaccatgtatttgtggcttaaactcttggcatttggctttgcctttctggacacagaagtatttgtgacagggcaaagcccaacaccttcccccactggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcagatgtcccaggagagaggagtacagccagcacctttcctacagacccagtttccccattgacaaccaccctcagccttgcacaccacagctctgctgccttacctgcacgcacctccaacaccaccatcacagcgaacacctcagatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgagataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggccaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatagtttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttctccaatgcttagaatgtttttaccaggaatggatgtcgctaatcataataaaattcaaccattatttttttcttgtttataatacattgtgttatatgttcaaatatgaaatgtgtatgcacctattgaaatatgtttaatgcatttattaacatttgcaggacacttttacaggccccaattatccaatagtctaataattgtttaagatctag

SEQ ID NO: 3397 - DNA, 2291 bp, Homo sapiens
agaggaggaaattgttcctcgtctgataagacaacagtggagaaaggacgcatgctgtttcttagggacacggctgacttccagatatgaccatgtatttgtggcttaaactcttggcatttggctttgcctttctggacacagaagtatttgtgacagggcaaagcccaacaccttcccccactggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcagatgtcccaggagagaggagtacagccagcacctttcctacagacccagtttccccattgacaaccaccctcagccttgcacaccacagctctgctgccttacctgcacgcacctccaacaccaccatcacagcgaacacctcagatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgagataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaat

SEQ ID NO: 3398 - DNA, 5321 bp, Homo sapiens
ggagaagttagtaaaaccgaatctgacatcatcacctagcagttcatgcagctagcaagtggtttgttcttagggtaacagaggaggaaattgttcctcgtctgataagacaacagtggagaaaggacgcatgctgtttcttagggacacggctgacttccagatatgaccatgtatttgtggcttaaactcttggcatttggctttgcctttctggacacagaagtatttgtgacagggcaaagcccaacaccttcccccactggattgactacagcaaagatgcccagtgttccactttcaagtgaccccttacctactcacaccactgcattctcacccgcaagcacctttgaaagagaaaatgacttctcagagaccacaacttctcttagtccagacaatacttccacccaagtatccccggactctttggataatgctagtgcttttaataccacaggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcagatgtcccaggagagaggagtacagccagcacctttcctacagacccagtttccccattgacaaccaccctcagccttgcacaccacagctctgctgccttacctgcacgcacctccaacaccaccatcacagcgaacacctcagatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgagataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggccaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatagtttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttctccaatgcttagaatgtttttaccaggaatggatgtcgctaatcataataaaattcaaccattatttttttcttgtttataatacattgtgttatatgttcaaatatgaaatgtgtatgcacctattgaaatatgtttaatgcatttattaacatttgcaggacacttttacaggccccaattatccaatagtctaataattgtttaagatctag

SEQ ID NO: 3399 - DNA, 517 bp, Homo sapiens
tagttttttcattcatttggccgtctcaaaggacgcatgctgtttcttagggacacggctgacttccagatatgaccatgtatttgtggcttaaactcttggcatttggctttgcctttctggacacagaagtatttgtgacagggcaaagcccaacaccttcccccactgatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatga

SEQ ID NO: 3400 - DNA, 462 bp, Homo sapiens
acatttttgattcgtttttacagagaaaaacttctacagagataacaattattttgcttttcagaaggacgcatgctgtttcttagggacacggctgacttccagatatgaccatgtatttgtggcttaaactcttggcatttggctttgcctttctggacacagaagtatttgtgacagggcaaagcccaacaccttcccccactggattgactacagcaaagatgcccagtgttccactttcaagtgaccccttacctactcacaccactgcattctcacccgcaagcacctttgaaagagaaaatgacttctcagagaccacaacttctcttagtccagacaatacttccacccaagtatccccggactctttggataatgctagtgcttttaataccacaggtgtttcatcagtacagacgcctcaccttcccacgcacgcagactcgcagacgccct

SEQ ID NO: 3401 - DNA, 5164 bp, Homo sapiens
gacatcatcacctagcagttcatgcagctagcaagtggtttgttcttagggtaacagaggaggaaattgttcctcgtctgataagacaacagtggagaaaggacgcatgctgtttcttagggacacggctgacttccagatatgaccatgtatttgtggcttaaactcttggcatttggctttgcctttctggacacagaagtatttgtgacagggcaaagcccaacaccttcccccactggattgactacagcaaagatgcccagtgttccactttcaagtgaccccttacctactcacaccactgcattctcacccgcaagcacctttgaaagagaaaatgacttctcagagaccacaacttctcttagtccagacaatacttccacccaagtatccccggactctttggataatgctagtgcttttaataccacaggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcagatgtcccaggagagaggagtacagccagcacctttcctacagacccagtttccccattgacaaccaccctcagccttgcacaccacagctctgctgccttacctgcacgcacctccaacaccaccatcacagcgaacacctcagatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgagataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggccaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatagtttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttctccaatgcttagaatgtttttaccaggaatggatgtcgctaatcataataaaattcaaccattatttttttcttgtttataa

SEQ ID NO: 3402 - DNA, 1962 bp, Homo sapiens
gaagttagtaaaaccgaatctgacatcatcacctagcagttcatgcagctagcaagtggtttgttcttagggtaacagaggaggaaattgttcctcgtctgataagacaacagtggagaaaggacgcatgctgtttcttagggacacggctgacttccagatatgaccatgtatttgtggcttaaactcttggcatttggctttgcctttctggacacagaagtatttgtgacagggcaaagcccaacaccttcccccactggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcagatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgagataaacggagatgcagggtcaaactacataaatgccagctatattgat

SEQ ID NO: 3403 - DNA, 2439 bp, Homo sapiens
ggagaagttagtaaaaccgaatctgacatcatcacctagcagttcatgcagctagcaagtggtttgttcttagggtaacagaggaggaaattgttcctcgtctgataagacaacagtggagaaaggacgcatgctgtttcttagggacacggctgacttccagatatgaccatgtatttgtggcttaaactcttggcatttggctttgcctttctggacacagaagtatttgtgacagggcaaagcccaacaccttcccccactggattgactacagcaaagatgcccagtgttccactttcaagtgaccccttacctactcacaccactgcattctcacccgcaagcacctttgaaagagaaaatgacttctcagagaccacaacttctcttagtccagacaatacttccacccaagtatccccggactctttggataatgctagtgcttttaataccacaggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcagatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgagataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaacaaaagtcaaag

SEQ ID NO: 3404 - DNA, 1662 bp, Homo sapiens
agcgattatatgattatcaaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagcctgccattacacatctttgcactggaattggtgcagatatataagtgatcctaatgttgattgcccagaccccaggaatgcagaggtaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagttttcagaacccagctcagatgttacctgcttcaggaaggcttcctaatcaaccctgccccgaaagagagaattactcctttgccaccttttga

SEQ ID NO: 3405 - DNA, 4337 bp, Homo sapiens
gaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagatgaaataccaggagcagaaacagatgattatgctgagattatagatgaagaagatacttacaccatgccctcaattaaaagttattgtattgatgtagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcctctgagacttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 3406 - DNA, 4088 bp, Homo sapiens
aaagcagaatatgacagatacctagcatctagcaaaataatggcagctgcttaccttgaccccaacttgaatcacacaccaaaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcaggagtcagtcactgccaacataaagttaagaaagctaggcgctttctccctttggtcttctgttcccatgatcctccttctacggatgaaattagtggggacgaaacagatgattatgctgagattatagatgaagaagatacttacaccatgccctcaattaaaagttattgtattgatgtagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcctctgagacttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 3407 - DNA, 4492 bp, Homo sapiens
gaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccaggtaaagaagaaaagaattgggcggaaagaaatcctgcagctccaccaaagaaaccgcctcgccctggagctcccggtcatctgggaagccttgccagcctcagcagccctgctgacagctacaacgagggtgtcaagccaaatcagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 3408 - DNA, 4564 bp, Homo sapiens
gaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcaggagtcagtcactgccaacataaagttaagaaagctaggcgctttctccctttggtcttctgttcccatgatcctccttctacggatgaaattagtggggacgaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccttgcagacttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 3409 - DNA, 1940 bp, Homo sapiens
aacagcacattctagcctccagccaagcaggaatgtctttttaaacagttgagcaaattcccagattagaaagtctggtgcactgatgtcactctttcctgagtaatttttgggtggttgtttactgcacactatctaccaggagcctagaaactttgaatgagtgtcattattagaactctagagttgtaggaatgtaggaagagctgtttgccacagttaggacgagggtttcaaactgtctgctgagccctggggcatctgcgtggaatgggaaactagcaaagtctcgctttggctgcattctgaggggtttatgtgatggcaaacagccaagatgaagaagctgcctagcagtcgctgcagcggctgcagcgttatgtgggacttcagatagcttctgagtagtcaagcagtgcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatg

SEQ ID NO: 3410 - DNA, 571 bp, Homo sapiens
ataaccaactagctcctcgctgaaactggctcacaccgcggaagcccgggtcggtgtcggggcgagccttccctccttttcctggagcccgtctcaggcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccaga

SEQ ID NO: 3411 - DNA, 4661 bp, Homo sapiens
taggaacacagagccatggggtcacattactaagctggtttcattctgttcagtagcttgatctagccaggatggtctgtgtttcagattgcggaagcatgagaagattctgtaactgagaggcattcttcaagctgctggaaaatattacagaaggaacaccttccaaattttgcttcaagctctgaaaaaaggagcacacaggggaaccttagtcttgcttgtggatcgaagcaaatactatcacagcgaggaactgggactttgtgtgcagactcctggcttgatctttataggattgggtgtatgttgttggaactggcaggccaagaggccctgaaaccagcaggtgccatctatatggagaaaagcggatgtagtccatttccagtgtgttgggctaaagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 3412 - DNA, 4439 bp, Homo sapiens
tctctgactgcaatggaaagaggaaagagaaattagaagtatttttttaaattgtcatttgatttcttcagagttattgtgggcttctgaactattgcggaagcatgagaagattctgtaactgagaggcattcttcaagctgctggaaaatattacagaaggaacaccttccaaattttgcttcaagctctgaaaaaaggagcacacaggggaaccttagtcttgcttgtggatcgaagcaaatactatcacagcgaggaactgggactttgtgtgcagactcctggcttgatctttataggattgggtgtatgttgttggaactggcaggccaagaggccctgaaaccagcaggtgccatctatatggagaaaagcggatgtagtccatttccagtgtgttgggctaaagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactatt

SEQ ID NO: 3413 - DNA, 3279 bp, Homo sapiens
agccctgtttgctctccgataaacaagtctgtgtattataacgtattggacaatgatgtcacttttatttccataaatgactcatgtgtgagcaaaatttgagtaatagtgttttaagaatatttcagcgtagtagaggatttaagcagatcgctttgcctactttaattatatgaaataccaggaggtcagatgtttaacctctttcaacatatctgtttcttttcctgcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 3414 - DNA, 4129 bp, Homo sapiens
atatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaa

SEQ ID NO: 3415 - DNA, 602 bp, Homo sapiens
agcacggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaatccatggttggttgaatctggatgtggaacccgctgacgtggatggctgactgtattaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccacca

SEQ ID NO: 3416 - DNA, 570 bp, Homo sapiens
acgtaaattttaagaaacttgttgggatggttgtgttctaaagttaaggaatcaaggatgatgtcaagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgtt

SEQ ID NO: 3417 - DNA, 4405 bp, Homo sapiens
gcgcggctgctgtcgcccagcgccgccccgtcgtcgtctgccttcgcttcacggcgccgagccgcggtccgaagtcttgctgtgtcacccaggctgccaggctggagtggagtggcatgatctcggctgactgcaacctctgcctcccagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 3418 - DNA, 630 bp, Homo sapiens
gagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggaggtatagtaatggttaagaaactttgcaaagaaagtgaataatgccagtactgtcaccttttggaacttgttggtatttcctgttgtctgtctttggaaggtatggaacctgtggtgacttaagagttgtataattgtgagagctaagcacagtccttgttattaaatgacagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcagg

SEQ ID NO: 3419 - DNA, 540 bp, Homo sapiens
agccactggaggatcttgagcagaggcgtgacgtaaattttaagaaacttgttgggatggttgtgttctaaagttaaggaatcaaggatgatgtcaaggcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtg

SEQ ID NO: 3420 - DNA, 542 bp, Homo sapiens
ttagtagagacggggttttaccgtcttggccaggctggtcttgaactcctgacttcaggtgatccacccaccttggcctcccaaagtgttgggattacaggcctgagccaccgtgcccggcagtgcttggtcttattaaacgctttatgaaagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggag

SEQ ID NO: 3421 - DNA, 2393 bp, Homo sapiens
gcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcaggagtcagtcactgccaacataaagttaagaaagctaggcgctttctccctttggtcttctgttcccatgatcctccttctacggatgaaattagtggggacgaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctg

SEQ ID NO: 3422 - DNA, 4955 bp, Homo sapiens
gaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtcacctattaaatgcagagctcaggatggaagtagcaatggtcttcaatgaaagaaccttcccctgcgcagggtctcactattccgctaactcggactcaaagcataattcacttgtcaaggaaattgttagcatttcccaggcccaccctagtcttgctagaatctctgtgagccacagagcagggagcaaatagaactgagatctccagcactagggactcagactccaaagggagggatttgagtgaattttttccaggtaaatacatgctcttatgtgcaaaagca

SEQ ID NO: 3423 - DNA, 3236 bp, Homo sapiens
attgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagt

SEQ ID NO: 3424 - DNA, 750 bp, Homo sapiens
gggattacaggcacatgccaccacacccggctgatatttgtatttttagtagagacggggttttaccgtcttggccaggctggtcttgaactcctgacttcaggtgatccacccaccttggcctcccaaagtgttgggattacaggcctgagccaccgtgcccggcagtgcttggtcttattaaacgctttatgaaagttagcttggaaagttaacctaacttggaaagacacaatagcttgacactgttgctatttgttaaataaggcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaa

SEQ ID NO: 3425 - DNA, 475 bp, Homo sapiens
gagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgaatccatggttggttgaatctggatgtggaacccgctgacgtggatggctgactgtattgcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacct

SEQ ID NO: 3426 - DNA, 4127 bp, Homo sapiens
atatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgt

SEQ ID NO: 3427 - DNA, 3236 bp, Homo sapiens; identical to SEQ ID NO: 3423

SEQ ID NO: 3428 - DNA, 4414 bp, Homo sapiens
tgccttcgcttcacggcgccgagccgcggtccgagcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccaggtaaagaagaaaagaattgggcggaaagaaatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagt

SEQ ID NO: 3429 - DNA, 4589 bp, Homo sapiens
gcagttcccgcctcctcaggtccgggcgggtccctggccggggtagcacggaagggtctcccaggcggcgtagtagggcttccgtgttactggaaacctacttccggctgcaaatgggaaaaggagcctctaccttaaccaatccccgggaacctcaggcccgcggatgggagaaaccagagatgccaacttcctgcttccgaagtagtggctgggtcttaaagcaccgatgtttctgcattgaatagccctggaagacagaattcttgtctctccaaagatctggcagacttattcccaattataagagatccttgcaaaggaggtgtcttgcttcaccttcaccttccactgtgattgtaagttttctgaggcctcgccagccatgcggaactgaataggactagcaacttcatagacggttgtgaagacaagctagacggcagatgaaagttcttggcacagagtgaacacttgataaactatatggcagggagggctggaacggggcttgtttgaagagcaatatgagccagggttatagacctgagtttggggtaagagtggaacatccaaatggaagagtccagcagctgaaaggacatttgttcaaaggcctttttcattacagttttctccttcttctgatccagccacagcctccggagccgttgcacacctacctgcccggccgacttacctgtacttgccgccgtcccggctcacctggcggtgcccgaggagtagtcgctggagtccgcgcctccctgggactgcaatgtgccgatcttagctgctgcctgagaggatgtctggggtgtccgagcccctgagtcgagtaaagttgggcacgttacgccggcctgaaggccctgcagagcccatggtggtggtaccagtagatgtggaaaaggaggacgtgcgtatcctcaaggtctgcttctatagcaacagcttcaatcctgggaaaaacttcaaactggtcaaatgcactgtccagacggagatccgggagatcatcacctccatcctgctgagcgggcggatcgggcccaacatccggttggctgagtgctatgggctgaggctgaagcacatgaagtccgatgagatccactggctgcacccacagatgacggtgggtgaggtgcaggacaagtatgagtgtctgcacgtggaagccgagtggaggtatgaccttcaaatccgctacttgccagaagacttcatggagagcctgaaggaggacaggaccacgctgctctatttttaccaacagctccggaacgactacatgcagcgctacgccagcaaggtcagcgagggcatggccctgcagctgggctgcctggagctcaggcggttcttcaaggatatgccccacaatgcacttgacaagaagtccaacttcgagctcctagaaaaggaagtggggctggacttgtttttcccaaagcagatgcaggagaacttaaagcccaaacagttccggaagatgatccagcagaccttccagcagtacgcctcgctcagggaggaggagtgcgtcatgaagttcttcaacactctcgccggcttcgccaacatcgaccaggagacctaccgctgtgaactcattcaaggatggaacattactgtggacctggtcattggccctaaagggatccgccagctgactagtcaggacgcaaagcccacctgcctggccgagttcaagcagatcaggtccatcaggtgcctcccgctggaggagggccaggcagtacttcagctgggcattgaaggtgccccccaggccttgtccatcaaaacctcatccctagcagaggctgagaacatggctgacctcatagacggctactgccggctgcagggtgagcaccaaggctctctcatcatccatcctaggaaagatggtgagaagcggaacagcctgccccagatccccatgctaaacctggaggcccggcggtcccacctctcagagagctgcagcatagagtcagacatctacgcagagattcccgacgaaaccctgcgaaggcccggaggtccacagtatggcattgcccgtgaagatgtggtcctgaatcgtattcttggggaaggcttttttggggaggtctatgaaggtgtctacacaaatcacaaaggggagaaaatcaatgtagctgtcaagacctgcaagaaagactgcactctggacaacaaggagaagttcatgagcgaggcagtgatcatgaagaacctcgaccacccgcacatcgtgaagctgatcggcatcattgaagaggagcccacctggatcatcatggaattgtatccctatggggagctgggccactacctggagcggaacaagaactccctgaaggtgctcaccctcgtgctgtactcactgcagatatgcaaagccatggcctacctggagagcatcaactgcgtgcacagggacattgctgtccggaacatcctggtggcctcccctgagtgtgtgaagctgggggactttggtctttcccggtacattgaggacgaggactattacaaagcctctgtgactcgtctccccatcaaatggatgtccccagagtccattaacttccgacgcttcacgacagccagtgacgtctggatgttcgccgtgtgcatgtgggagatcctgagctttgggaagcagcccttcttctggctggagaacaaggatgtcatcggggtgctggagaaaggagaccggctgcccaagcctgatctctgtccaccggtcctttataccctcatgacccgctgctgggactacgaccccagtgaccggccccgcttcaccgagctggtgtgcagcctcagtgacgtttatcagatggagaaggacattgccatggagcaagagaggaatgctcgctaccgaacccccaaaatcttggagcccacagccttccaggaacccccacccaagcccagccgacctaagtacagaccccctccgcaaaccaacctcctggctccaaagctgcagttccaggaggaggacttcatccaacccagcagccgagaagaggcccagcagctgtgggaggctgaaaaggtcaaaatgcggcaaatcctggacaaacagcagaagcagatggtggaggactaccagtggctcaggcaggaggagaagtccctggaccccatggtttatatgaatgataagtccccattgacgccagagaaggaggtcggctacctggagttcacagggcccccacagaagcccccgaggctgggcgcacagtccatccagcccacagctaacctggaccggactgatgacctggtgtacctcaatgtcatggagctggtgcgggccgtgctggagctcaagaatgagctctgtcagctgccccccgagggctacgtggtggtggtgaagaatgtggggctgaccctgcggaagctcatcgggagcgtggatgatctcctgccttccttgccgtcatcttcacggacagagatcgagggcacccagaaactgctcaacaaagacctggcagagctcatcaacaagatgcggctggcacagcagaacgccgtgacctccctaagtgaggagtgcaagaggcagatgctgacggcttcacacaccctggctgtggacgccaagaacctgctcgacgctgtggaccaggccaaggttctggccaatctggcccacccacctgcagagtgacggagggtgggggccacctgcctgcgtcttccgcccctgcctgccatgtacctcccctgccttgctgttggtcatgtgggtcttccagggggaaggccaaggggagtcaccttcccttgccactttgcacgacgccctctccccacccctacccctggctgtactgctcaggctgcagctggacagaggggactctgggctatggacacagggtgacggtgacaaagatggctcagagggggactgctgctgcctggccactgctccctaagccagcctggtccatgcagggggctcctgggggtggggaggtgtcacatggtgcccctagctttatatatggacatggcaggccgatttgggaaccaagctattcctttcccttcctcttcggccctcagatgtcccttgatgcacagagaagctggggaggagctttgttttgggggtcaggcagccagtgagatgagggatgggcctggcattcttgtacagtgtatattgaaatttatttaatgtgagtttggtctggactgacagcatgtgccctcctgagggaggacctggggcacagtccaggaacaagctaattgggagtccaggcacaggatgctgtgttgtcaacaaaccaagcatcagggggaagaagcagagagatgcggccaagataggaccttgggccaaatccgctctcttcctgcccctctttctctttcttcctttactttcccttgcttttccctcttttcttactcctcctctttctctccccaacccccattctcatctgcacccttcttttctcatgtgtttgcataaacattcttttaacttctttctatttgacttgtggttgaattaaaattgtcccatttgc

SEQ ID NO: 3430 - DNA, 4147 bp, Homo sapiens
aaggaagtggggaggagagcagcaggggtgtggttaacaactcagaggaggagggagaatctaacctgtcagcccttttactcagccacagcctccggagccgttgcacacctacctgcccggccgacttacctgtacttgccgccgtcccggctcacctggcggtgcccgaggagtagtcgctggagtccgcgcctccctgggactgcaatgtgccgatcttagctgctgcctgagaggatgtctggggtgtccgagcccctgagtcgagtaaagttgggcacgttacgccggcctgaaggccctgcagagcccatggtggtggtaccagtagatgtggaaaaggaggacgtgcgtatcctcaaggtctgcttctatagcaacagcttcaatcctgggaaaaacttcaaactggtcaaatgcactgtccagacggagatccgggagatcatcacctccatcctgctgagcgggcggatcgggcccaacatccggttggctgagtgctatgggctgaggctgaagcacatgaagtccgatgagatccactggctgcacccacagatgacggtgggtgaggtgcaggacaagtatgagtgtctgcacgtggaagccgagtggaggtatgaccttcaaatccgctacttgccagaagacttcatggagagcctgaaggaggacaggaccacgctgctctatttttaccaacagctccggaacgactacatgcagcgctacgccagcaaggtcagcgagggcatggccctgcagctgggctgcctggagctcaggcggttcttcaaggatatgccccacaatgcacttgacaagaagtccaacttcgagctcctagaaaaggaagtggggctggacttgtttttcccaaagcagatgcaggagaacttaaagcccaaacagttccggaagatgatccagcagaccttccagcagtacgcctcgctcagggaggaggagtgcgtcatgaagttcttcaacactctcgccggcttcgccaacatcgaccaggagacctaccgctgtgaactcattcaaggatggaacattactgtggacctggtcattggccctaaagggatccgccagctgactagtcaggacgcaaagcccacctgcctggccgagttcaagcagatcaggtccatcaggtgcctcccgctggaggagggccaggcagtacttcagctgggcattgaaggtgccccccaggccttgtccatcaaaacctcatccctagcagaggctgagaacatggctgacctcatagacggctactgccggctgcagggtgagcaccaaggctctctcatcatccatcctaggaaagatggtgagaagcggaacagcctgccccagatccccatgctaaacctggaggcccggcggtcccacctctcagagagctgcagcatagagtcagacatctacgcagagattcccgacgaaaccctgcgaaggcccggaggtccacagtatggcattgcccgtgaagatgtggtcctgaatcgtattcttggggaaggcttttttggggaggtctatgaaggtgtctacacaaatcacaaaggggagaaaatcaatgtagctgtcaagacctgcaagaaagactgcactctggacaacaaggagaagttcatgagcgaggcagtgatcatgaagaacctcgaccacccgcacatcgtgaagctgatcggcatcattgaagaggagcccacctggatcatcatggaattgtatccctatggggagctgggccactacctggagcggaacaagaactccctgaaggtgctcaccctcgtgctgtactcactgcagatatgcaaagccatggcctacctggagagcatcaactgcgtgcacagggacattgctgtccggaacatcctggtggcctcccctgagtgtgtgaagctgggggactttggtctttcccggtacattgaggacgaggactattacaaagcctctgtgactcgtctccccatcaaatggatgtccccagagtccattaacttccgacgcttcacgacagccagtgacgtctggatgttcgccgtgtgcatgtgggagatcctgagctttgggaagcagcccttcttctggctggagaacaaggatgtcatcggggtgctggagaaaggagaccggctgcccaagcctgatctctgtccaccggtcctttataccctcatgacccgctgctgggactacgaccccagtgaccggccccgcttcaccgagctggtgtgcagcctcagtgacgtttatcagatggagaaggacattgccatggagcaagagaggaatgctcgctaccgaacccccaaaatcttggagcccacagccttccaggaacccccacccaagcccagccgacctaagtacagaccccctccgcaaaccaacctcctggctccaaagctgcagttccaggttcctgagggtctgtgtgccagctctcctacgctcaccagccctatggagtatccatctcccgttaactcactgcacaccccacctctccaccggcacaatgtcttcaaacgccacagcatgcgggaggaggacttcatccaacccagcagccgagaagaggcccagcagctgtgggaggctgaaaaggtcaaaatgcggcaaatcctggacaaacagcagaagcagatggtggaggactaccagtggctcaggcaggaggagaagtccctggaccccatggtttatatgaatgataagtccccattgacgccagagaaggaggtcggctacctggagttcacagggcccccacagaagcccccgaggctgggcgcacagtccatccagcccacagctaacctggaccggactgatgacctggtgtacctcaatgtcatggagctggtgcgggccgtgctggagctcaagaatgagctctgtcagctgccccccgagggctacgtggtggtggtgaagaatgtggggctgaccctgcggaagctcatcgggagcgtggatgatctcctgccttccttgccgtcatcttcacggacagagatcgagggcacccagaaactgctcaacaaagacctggcagagctcatcaacaagatgcggctggcacagcagaacgccgtgacctccctaagtgaggagtgcaagaggcagatgctgacggcttcacacaccctggctgtggacgccaagaacctgctcgacgctgtggaccaggccaaggttctggccaatctggcccacccacctgcagagtgacggagggtgggggccacctgcctgcgtcttccgcccctgcctgccatgtacctcccctgccttgctgttggtcatgtgggtcttccagggggaaggccaaggggagtcaccttcccttgccactttgcacgacgccctctccccacccctacccctggctgtactgctcaggctgcagctggacagaggggactctgggctatggacacagggtgacggtgacaaagatggctcagagggggactgctgctgcctggccactgctccctaagccagcctggtccatgcagggggctcctgggggtggggaggtgtcacatggtgcccctagctttatatatggacatggcaggccgatttgggaaccaagctattcctttcccttcctcttcggccctcagatgtcccttgatgcacagagaagctggggaggagctttgttttgggggtcaggcagccagtgagatgagggatgggcctggcattcttgtacagtgtatattgaaatttatttaatgtgagtttggtctggactgacagcatgtgccctcctgagggaggacctggggcacagtccaggaacaagctaattgggagtccaggcacaggatgctgtgttgtcaacaaaccaagcatcagggggaagaagcagagagatgcggccaagataggaccttgggccaaatccgctctcttcctgcccctctttctctttcttcctttactttcccttgcttttccctcttttcttactcctcctctttctctccccaacccccattctcatctgcacccttcttttctcatgtgtttgcataaacattcttttaacttctttctatttgacttgtggttgaattaaaattgtcccatttgc

SEQ ID NO: 3431 - DNA, 4715 bp, Homo sapiens
gcagttcccgcctcctcaggtccgggcgggtccctggccggggtagcacggaagggtctcccaggcggcgtagtagggcttccgtgttactggaaacctacttccggctgcaaatgggaaaaggagcctctaccttaaccaatccccgggaacctcaggcccgcggatgggagaaaccagagatgccaacttcctgcttccgaagtagtggctgggtcttaaagcaccgatgtttctgcattgaatagccctggaagacagaattcttgtctctccaaagatctggcagacttattcccaattataagagatccttgcaaaggaggtgtcttgcttcaccttcaccttccactgtgattgtaagttttctgaggcctcgccagccatgcggaactgaataggactagcaacttcatagacggttgtgaagacaagctagacggcagatgaaagttcttggcacagagtgaacacttgataaactatatggcagggagggctggaacggggcttgtttgaagagcaatatgagccagggttatagacctgagtttggggtaagagtggaacatccaaatggaagagtccagcagctgaaaggacatttgttcaaaggcctttttcattacagttttctccttcttctgatccagccacagcctccggagccgttgcacacctacctgcccggccgacttacctgtacttgccgccgtcccggctcacctggcggtgcccgaggagtagtcgctggagtccgcgcctccctgggactgcaatgtgccgatcttagctgctgcctgagaggatgtctggggtgtccgagcccctgagtcgagtaaagttgggcacgttacgccggcctgaaggccctgcagagcccatggtggtggtaccagtagatgtggaaaaggaggacgtgcgtatcctcaaggtctgcttctatagcaacagcttcaatcctgggaaaaacttcaaactggtcaaatgcactgtccagacggagatccgggagatcatcacctccatcctgctgagcgggcggatcgggcccaacatccggttggctgagtgctatgggctgaggctgaagcacatgaagtccgatgagatccactggctgcacccacagatgacggtgggtgaggtgcaggacaagtatgagtgtctgcacgtggaagccgagtggaggtatgaccttcaaatccgctacttgccagaagacttcatggagagcctgaaggaggacaggaccacgctgctctatttttaccaacagctccggaacgactacatgcagcgctacgccagcaaggtcagcgagggcatggccctgcagctgggctgcctggagctcaggcggttcttcaaggatatgccccacaatgcacttgacaagaagtccaacttcgagctcctagaaaaggaagtggggctggacttgtttttcccaaagcagatgcaggagaacttaaagcccaaacagttccggaagatgatccagcagaccttccagcagtacgcctcgctcagggaggaggagtgcgtcatgaagttcttcaacactctcgccggcttcgccaacatcgaccaggagacctaccgctgtgaactcattcaaggatggaacattactgtggacctggtcattggccctaaagggatccgccagctgactagtcaggacgcaaagcccacctgcctggccgagttcaagcagatcaggtccatcaggtgcctcccgctggaggagggccaggcagtacttcagctgggcattgaaggtgccccccaggccttgtccatcaaaacctcatccctagcagaggctgagaacatggctgacctcatagacggctactgccggctgcagggtgagcaccaaggctctctcatcatccatcctaggaaagatggtgagaagcggaacagcctgccccagatccccatgctaaacctggaggcccggcggtcccacctctcagagagctgcagcatagagtcagacatctacgcagagattcccgacgaaaccctgcgaaggcccggaggtccacagtatggcattgcccgtgaagatgtggtcctgaatcgtattcttggggaaggcttttttggggaggtctatgaaggtgtctacacaaatcacaaaggggagaaaatcaatgtagctgtcaagacctgcaagaaagactgcactctggacaacaaggagaagttcatgagcgaggcagtgatcatgaagaacctcgaccacccgcacatcgtgaagctgatcggcatcattgaagaggagcccacctggatcatcatggaattgtatccctatggggagctgggccactacctggagcggaacaagaactccctgaaggtgctcaccctcgtgctgtactcactgcagatatgcaaagccatggcctacctggagagcatcaactgcgtgcacagggacattgctgtccggaacatcctggtggcctcccctgagtgtgtgaagctgggggactttggtctttcccggtacattgaggacgaggactattacaaagcctctgtgactcgtctccccatcaaatggatgtccccagagtccattaacttccgacgcttcacgacagccagtgacgtctggatgttcgccgtgtgcatgtgggagatcctgagctttgggaagcagcccttcttctggctggagaacaaggatgtcatcggggtgctggagaaaggagaccggctgcccaagcctgatctctgtccaccggtcctttataccctcatgacccgctgctgggactacgaccccagtgaccggccccgcttcaccgagctggtgtgcagcctcagtgacgtttatcagatggagaaggacattgccatggagcaagagaggaatgctcgctaccgaacccccaaaatcttggagcccacagccttccaggaacccccacccaagcccagccgacctaagtacagaccccctccgcaaaccaacctcctggctccaaagctgcagttccaggttcctgagggtctgtgtgccagctctcctacgctcaccagccctatggagtatccatctcccgttaactcactgcacaccccacctctccaccggcacaatgtcttcaaacgccacagcatgcgggaggaggacttcatccaacccagcagccgagaagaggcccagcagctgtgggaggctgaaaaggtcaaaatgcggcaaatcctggacaaacagcagaagcagatggtggaggactaccagtggctcaggcaggaggagaagtccctggaccccatggtttatatgaatgataagtccccattgacgccagagaaggaggtcggctacctggagttcacagggcccccacagaagcccccgaggctgggcgcacagtccatccagcccacagctaacctggaccggactgatgacctggtgtacctcaatgtcatggagctggtgcgggccgtgctggagctcaagaatgagctctgtcagctgccccccgagggctacgtggtggtggtgaagaatgtggggctgaccctgcggaagctcatcgggagcgtggatgatctcctgccttccttgccgtcatcttcacggacagagatcgagggcacccagaaactgctcaacaaagacctggcagagctcatcaacaagatgcggctggcacagcagaacgccgtgacctccctaagtgaggagtgcaagaggcagatgctgacggcttcacacaccctggctgtggacgccaagaacctgctcgacgctgtggaccaggccaaggttctggccaatctggcccacccacctgcagagtgacggagggtgggggccacctgcctgcgtcttccgcccctgcctgccatgtacctcccctgccttgctgttggtcatgtgggtcttccagggggaaggccaaggggagtcaccttcccttgccactttgcacgacgccctctccccacccctacccctggctgtactgctcaggctgcagctggacagaggggactctgggctatggacacagggtgacggtgacaaagatggctcagagggggactgctgctgcctggccactgctccctaagccagcctggtccatgcagggggctcctgggggtggggaggtgtcacatggtgcccctagctttatatatggacatggcaggccgatttgggaaccaagctattcctttcccttcctcttcggccctcagatgtcccttgatgcacagagaagctggggaggagctttgttttgggggtcaggcagccagtgagatgagggatgggcctggcattcttgtacagtgtatattgaaatttatttaatgtgagtttggtctggactgacagcatgtgccctcctgagggaggacctggggcacagtccaggaacaagctaattgggagtccaggcacaggatgctgtgttgtcaacaaaccaagcatcagggggaagaagcagagagatgcggccaagataggaccttgggccaaatccgctctcttcctgcccctctttctctttcttcctttactttcccttgcttttccctcttttcttactcctcctctttctctccccaacccccattctcatctgcacccttcttttctcatgtgtttgcataaacattcttttaacttctttctatttgacttgtggttgaattaaaattgtcccatttgc

SEQ ID NO: 3432 - DNA, 3936 bp, Homo sapiens
ccacagcctccggagccgttgcacacctacctgcccggccgacttacctgtacttgccgccgtcccggctcacctggcggtgcccgaggagtagtcgctggagtccgcgcctccctgggactgcaatgtgccgatcttagctgctgcctgagaggatgtctggggtgtccgagcccctgagtcgagtaaagttgggcacgttacgccggcctgaaggccctgcagagcccatggtggtggtaccagtagatgtggaaaaggaggacgtgcgtatcctcaaggtctgcttctatagcaacagcttcaatcctgggaaaaacttcaaactggtcaaatgcactgtccagacggagatccgggagatcatcacctccatcctgctgagcgggcggatcgggcccaacatccggttggctgagtgctatgggctgaggctgaagcacatgaagtccgatgagatccactggctgcacccacagatgacggtgggtgaggtgcaggacaagtatgagtgtctgcacgtggaagccgagtggaggtatgaccttcaaatccgctacttgccagaagacttcatggagagcctgaaggaggacaggaccacgctgctctatttttaccaacagctccggaacgactacatgcagcgctacgccagcaaggtcagcgagggcatggccctgcagctgggctgcctggagctcaggcggttcttcaaggatatgccccacaatgcacttgacaagaagtccaacttcgagctcctagaaaaggaagtggggctggacttgtttttcccaaagcagatgcaggagaacttaaagcccaaacagttccggaagatgatccagcagaccttccagcagtacgcctcgctcagggaggaggagtgcgtcatgaagttcttcaacactctcgccggcttcgccaacatcgaccaggagacctaccgctgtgaactcattcaaggatggaacattactgtggacctggtcattggccctaaagggatccgccagctgactagtcaggacgcaaagcccacctgcctggccgagttcaagcagatcaggtccatcaggtgcctcccgctggaggagggccaggcagtacttcagctgggcattgaaggtgccccccaggccttgtccatcaaaacctcatccctagcagaggctgagaacatggctgacctcatagacggctactgccggctgcagggtgagcaccaaggctctctcatcatccatcctaggaaagatggtgagaagcggaacagcctgccccagatccccatgctaaacctggaggcccggcggtcccacctctcagagagctgcagcatagagtcagacatctacgcagagattcccgacgaaaccctgcgaaggcccggaggtccacagtatggcattgcccgtgaagatgtggtcctgaatcgtattcttggggaaggcttttttggggaggtctatgaaggtgtctacacaaatcacaaaggggagaaaatcaatgtagctgtcaagacctgcaagaaagactgcactctggacaacaaggagaagttcatgagcgaggcagtgatcatgaagaacctcgaccacccgcacatcgtgaagctgatcggcatcattgaagaggagcccacctggatcatcatggaattgtatccctatggggagctgggccactacctggagcggaacaagaactccctgaaggtgctcaccctcgtgctgtactcactgcagatatgcaaagccatggcctacctggagagcatcaactgcgtgcacagggacattgctgtccggaacatcctggtggcctcccctgagtgtgtgaagctgggggactttggtctttcccggtacattgaggacgaggactattacaaagcctctgtgactcgtctccccatcaaatggatgtccccagagtccattaacttccgacgcttcacgacagccagtgacgtctggatgttcgccgtgtgcatgtgggagatcctgagctttgggaagcagcccttcttctggctggagaacaaggatgtcatcggggtgctggagaaaggagaccggctgcccaagcctgatctctgtccaccggtcctttataccctcatgacccgctgctgggactacgaccccagtgaccggccccgcttcaccgagctggtgtgcagcctcagtgacgtttatcagatggagaaggacattgccatggagcaagagaggaatgctcgctaccgaacccccaaaatcttggagcccacagccttccaggaacccccacccaagcccagccgacctaagtacagaccccctccgcaaaccaacctcctggctccaaagctgcagttccaggaggaggacttcatccaacccagcagccgagaagaggcccagcagctgtgggaggctgaaaaggtcaaaatgcggcaaatcctggacaaacagcagaagcagatggtggaggactaccagtggctcaggcaggaggagaagtccctggaccccatggtttatatgaatgataagtccccattgacgccagagaaggaggtcggctacctggagttcacagggcccccacagaagcccccgaggctgggcgcacagtccatccagcccacagctaacctggaccggactgatgacctggtgtacctcaatgtcatggagctggtgcgggccgtgctggagctcaagaatgagctctgtcagctgccccccgagggctacgtggtggtggtgaagaatgtggggctgaccctgcggaagctcatcgggagcgtggatgatctcctgccttccttgccgtcatcttcacggacagagatcgagggcacccagaaactgctcaacaaagacctggcagagctcatcaacaagatgcggctggcacagcagaacgccgtgacctccctaagtgaggagtgcaagaggcagatgctgacggcttcacacaccctggctgtggacgccaagaacctgctcgacgctgtggaccaggccaaggttctggccaatctggcccacccacctgcagagtgacggagggtgggggccacctgcctgcgtcttccgcccctgcctgccatgtacctcccctgccttgctgttggtcatgtgggtcttccagggggaaggccaaggggagtcaccttcccttgccactttgcacgacgccctctccccacccctacccctggctgtactgctcaggctgcagctggacagaggggactctgggctatggacacagggtgacggtgacaaagatggctcagagggggactgctgctgcctggccactgctccctaagccagcctggtccatgcagggggctcctgggggtggggaggtgtcacatggtgcccctagctttatatatggacatggcaggccgatttgggaaccaagctattcctttcccttcctcttcggccctcagatgtcccttgatgcacagagaagctggggaggagctttgttttgggggtcaggcagccagtgagatgagggatgggcctggcattcttgtacagtgtatattgaaatttatttaatgtgagtttggtctggactgacagcatgtgccctcctgagggaggacctggggcacagtccaggaacaagctaattgggagtccaggcacaggatgctgtgttgtcaacaaaccaagcatcagggggaagaagcagagagatgcggccaagataggaccttgggccaaatccgctctcttcctgcccctctttctctttcttcctttactttcccttgcttttccctcttttcttactcctcctctttctctccccaacccccattctcatctgcacccttcttttctcatgtgtttgcataaacattcttttaacttctttctatttgacttgtggttgaattaaaattgtcccatttgc

SEQ ID NO: 3433 - DNA, 3914 bp, Homo sapiens
tctgtcttggagctcggtgggtgctgtccctggggccatgaggtatgtgggcctgtgtggggctctttcagggctgaccctctgctgtctctgcaggactgcaatgtgccgatcttagctgctgcctgagaggatgtctggggtgtccgagcccctgagtcgagtaaagttgggcacgttacgccggcctgaaggccctgcagagcccatggtggtggtaccagtagatgtggaaaaggaggacgtgcgtatcctcaaggtctgcttctatagcaacagcttcaatcctgggaaaaacttcaaactggtcaaatgcactgtccagacggagatccgggagatcatcacctccatcctgctgagcgggcggatcgggcccaacatccggttggctgagtgctatgggctgaggctgaagcacatgaagtccgatgagatccactggctgcacccacagatgacggtgggtgaggtgcaggacaagtatgagtgtctgcacgtggaagccgagtggaggtatgaccttcaaatccgctacttgccagaagacttcatggagagcctgaaggaggacaggaccacgctgctctatttttaccaacagctccggaacgactacatgcagcgctacgccagcaaggtcagcgagggcatggccctgcagctgggctgcctggagctcaggcggttcttcaaggatatgccccacaatgcacttgacaagaagtccaacttcgagctcctagaaaaggaagtggggctggacttgtttttcccaaagcagatgcaggagaacttaaagcccaaacagttccggaagatgatccagcagaccttccagcagtacgcctcgctcagggaggaggagtgcgtcatgaagttcttcaacactctcgccggcttcgccaacatcgaccaggagacctaccgctgtgaactcattcaaggatggaacattactgtggacctggtcattggccctaaagggatccgccagctgactagtcaggacgcaaagcccacctgcctggccgagttcaagcagatcaggtccatcaggtgcctcccgctggaggagggccaggcagtacttcagctgggcattgaaggtgccccccaggccttgtccatcaaaacctcatccctagcagaggctgagaacatggctgacctcatagacggctactgccggctgcagggtgagcaccaaggctctctcatcatccatcctaggaaagatggtgagaagcggaacagcctgccccagatccccatgctaaacctggaggcccggcggtcccacctctcagagagctgcagcatagagtcagacatctacgcagagattcccgacgaaaccctgcgaaggcccggaggtccacagtatggcattgcccgtgaagatgtggtcctgaatcgtattcttggggaaggcttttttggggaggtctatgaaggtgtctacacaaatcacaaaggggagaaaatcaatgtagctgtcaagacctgcaagaaagactgcactctggacaacaaggagaagttcatgagcgaggcagtgatcatgaagaacctcgaccacccgcacatcgtgaagctgatcggcatcattgaagaggagcccacctggatcatcatggaattgtatccctatggggagctgggccactacctggagcggaacaagaactccctgaaggtgctcaccctcgtgctgtactcactgcagatatgcaaagccatggcctacctggagagcatcaactgcgtgcacagggacattgctgtccggaacatcctggtggcctcccctgagtgtgtgaagctgggggactttggtctttcccggtacattgaggacgaggactattacaaagcctctgtgactcgtctccccatcaaatggatgtccccagagtccattaacttccgacgcttcacgacagccagtgacgtctggatgttcgccgtgtgcatgtgggagatcctgagctttgggaagcagcccttcttctggctggagaacaaggatgtcatcggggtgctggagaaaggagaccggctgcccaagcctgatctctgtccaccggtcctttataccctcatgacccgctgctgggactacgaccccagtgaccggccccgcttcaccgagctggtgtgcagcctcagtgacgtttatcagatggagaaggacattgccatggagcaagagaggaatgctcgctaccgaacccccaaaatcttggagcccacagccttccaggaacccccacccaagcccagccgacctaagtacagaccccctccgcaaaccaacctcctggctccaaagctgcagttccaggaggaggacttcatccaacccagcagccgagaagaggcccagcagctgtgggaggctgaaaaggtcaaaatgcggcaaatcctggacaaacagcagaagcagatggtggaggactaccagtggctcaggcaggaggagaagtccctggaccccatggtttatatgaatgataagtccccattgacgccagagaaggaggtcggctacctggagttcacagggcccccacagaagcccccgaggctgggcgcacagtccatccagcccacagctaacctggaccggactgatgacctggtgtacctcaatgtcatggagctggtgcgggccgtgctggagctcaagaatgagctctgtcagctgccccccgagggctacgtggtggtggtgaagaatgtggggctgaccctgcggaagctcatcgggagcgtggatgatctcctgccttccttgccgtcatcttcacggacagagatcgagggcacccagaaactgctcaacaaagacctggcagagctcatcaacaagatgcggctggcacagcagaacgccgtgacctccctaagtgaggagtgcaagaggcagatgctgacggcttcacacaccctggctgtggacgccaagaacctgctcgacgctgtggaccaggccaaggttctggccaatctggcccacccacctgcagagtgacggagggtgggggccacctgcctgcgtcttccgcccctgcctgccatgtacctcccctgccttgctgttggtcatgtgggtcttccagggggaaggccaaggggagtcaccttcccttgccactttgcacgacgccctctccccacccctacccctggctgtactgctcaggctgcagctggacagaggggactctgggctatggacacagggtgacggtgacaaagatggctcagagggggactgctgctgcctggccactgctccctaagccagcctggtccatgcagggggctcctgggggtggggaggtgtcacatggtgcccctagctttatatatggacatggcaggccgatttgggaaccaagctattcctttcccttcctcttcggccctcagatgtcccttgatgcacagagaagctggggaggagctttgttttgggggtcaggcagccagtgagatgagggatgggcctggcattcttgtacagtgtatattgaaatttatttaatgtgagtttggtctggactgacagcatgtgccctcctgagggaggacctggggcacagtccaggaacaagctaattgggagtccaggcacaggatgctgtgttgtcaacaaaccaagcatcagggggaagaagcagagagatgcggccaagataggaccttgggccaaatccgctctcttcctgcccctctttctctttcttcctttactttcccttgcttttccctcttttcttactcctcctctttctctccccaacccccattctcatctgcacccttcttttctcatgtgtttgcataaacattcttttaacttctttctatttgacttgtggttgaattaaaattgtcccatttgc

SEQ ID NO: 3434 - DNA, 4710 bp, Homo sapiens
gcagttcccgcctcctcaggtccgggcgggtccctggccggggtagcacggaagggtctcccaggcggcgtagtagggcttccgtgttactggaaacctacttccggctgcaaatgggaaaaggagcctctaccttaaccaatccccgggaacctcaggcccgcggatgggagaaaccagagatgccaacttcctgcttccgaagtagtggctgggtcttaaagcaccgatgtttctgcattgaatagccctggaagacagaattcttgtctctccaaagatctggcagacttattcccaattataagagatccttgcaaaggaggtgtcttgcttcaccttcaccttccactgtgattgtaagttttctgaggcctcgccagccatgcggaactgaataggactagcaacttcatagacggttgtgaagacaagctagacggcagatgaaagttcttggcacagagtgaacacttgataaactatatggcagggagggctggaacggggcttgtttgaagagcaatatgagccagggttatagacctgagtttggggtaagagtggaacatccaaatggaagagtccagcagctgaaaggacatttgttcaaaggcctttttcattacagttttctccttcttctgatccagccacagcctccggagccgttgcacacctacctgcccggccgacttacctgtacttgccgccgtcccggctcacctggcggtgcccgaggagtagtcgctggagtccgcgcctccctgggactgcaatgtgccgatcttagctgctgcctgagaggatgtctggggtgtccgagcccctgagtcgagtaaagttgggcacgttacgccggcctgaaggccctgcagagcccatggtggtggtaccagtagatgtggaaaaggaggacgtgcgtatcctcaaggtctgcttctatagcaacagcttcaatcctgggaaaaacttcaaactggtcaaatgcactgtccagacggagatccgggagatcatcacctccatcctgctgagcgggcggatcgggcccaacatccggttggctgagtgctatgggctgaggctgaagcacatgaagtccgatgagatccactggctgcacccacagatgacggtgggtgaggtgcaggacaagtatgagtgtctgcacgtggaagccgagtggaggtatgaccttcaaatccgctacttgccagaagacttcatggagagcctgaaggaggacaggaccacgctgctctatttttaccaacagctccggaacgactacatgcagcgctacgccagcaaggtcagcgagggcatggccctgcagctgggctgcctggagctcaggcggttcttcaaggatatgccccacaatgcacttgacaagaagtccaacttcgagctcctagaaaaggaagtggggctggacttgtttttcccaaagcagatgcaggagaacttaaagcccaaacagttccggaagatgatccagcagaccttccagcagtacgcctcgctcagggaggaggagtgcgtcatgaagttcttcaacactctcgccggcttcgccaacatcgaccaggagacctaccgctgtgaactcattcaaggatggaacattactgtggacctggtcattggccctaaagggatccgccagctgactagtcaggacgcaaagcccacctgcctggccgagttcaagcagatcaggtccatcaggtgcctcccgctggaggagggccaggcagtacttcagctgggcattgaaggtgccccccaggccttgtccatcaaaacctcatccctagcagaggctgagaacatggctgacctcatagacggctactgccggctgcagggtgagcaccaaggctctctcatcatccatcctaggaaagatggtgagaagcggaacagcctgccccagatccccatgctaaacctggaggcccggcggtcccacctctcagagagctgcagcatagagtcagacatctacgcagagattcccgacgaaaccctgcgaaggcccggaggtccacagtatggcattgcccgtgaagatgtggtcctgaatcgtattcttggggaaggcttttttggggaggtctatgaaggtgtctacacaaatcacaaaggggagaaaatcaatgtagctgtcaagacctgcaagaaagactgcactctggacaacaaggagaagttcatgagcgaggcagtgatcatgaagaacctcgaccacccgcacatcgtgaagctgatcggcatcattgaagaggagcccacctggatcatcatggaattgtatccctatggggagctgggccactacctggagcggaacaagaactccctgaaggtgctcaccctcgtgctgtactcactgcagatatgcaaagccatggcctacctggagagcatcaactgcgtgcacagggacattgctgtccggaacatcctggtggcctcccctgagtgtgtgaagctgggggactttggtctttcccggtacattgaggacgaggactattacaaagcctctgtgactcgtctccccatcaaatggatgtccccagagtccattaacttccgacgcttcacgacagccagtgacgtctggatgttcgccgtgtgcatgtgggagatcctgagctttgggaagcagcccttcttctggctggagaacaaggatgtcatcggggtgctggagaaaggagaccggctgcccaagcctgatctctgtccaccggtcctttataccctcatgacccgctgctgggactacgaccccagtgaccggccccgcttcaccgagctggtgtgcagcctcagtgacgtttatcagatggagaaggacattgccatggagcaagagaggaatgctcgctaccgaacccccaaaatcttggagcccacagccttccaggaacccccacccaagcccagccgacctaagtacagaccccctccgcaaaccaacctcctggctccaaagctgcagttccaggttcctgagggtctgtgtgccagctctcctacgctcaccagccctatggagtatccatctcccgttaactcactgcacaccccacctctccaccggcacaatgtcttcaaacgccacagcatgcgggaggaggacttcatccaacccagcagccgaggcccagcagctgtgggaggctgaaaaggtcaaaatgcggcaaatcctggacaaacagcagaagcagatggtggaggactaccagtggctcaggcaggaggagaagtccctggaccccatggtttatatgaatgataagtccccattgacgccagagaaggaggtcggctacctggagttcacagggcccccacagaagcccccgaggctgggcgcacagtccatccagcccacagctaacctggaccggactgatgacctggtgtacctcaatgtcatggagctggtgcgggccgtgctggagctcaagaatgagctctgtcagctgccccccgagggctacgtggtggtggtgaagaatgtggggctgaccctgcggaagctcatcgggagcgtggatgatctcctgccttccttgccgtcatcttcacggacagagatcgagggcacccagaaactgctcaacaaagacctggcagagctcatcaacaagatgcggctggcacagcagaacgccgtgacctccctaagtgaggagtgcaagaggcagatgctgacggcttcacacaccctggctgtggacgccaagaacctgctcgacgctgtggaccaggccaaggttctggccaatctggcccacccacctgcagagtgacggagggtgggggccacctgcctgcgtcttccgcccctgcctgccatgtacctcccctgccttgctgttggtcatgtgggtcttccagggggaaggccaaggggagtcaccttcccttgccactttgcacgacgccctctccccacccctacccctggctgtactgctcaggctgcagctggacagaggggactctgggctatggacacagggtgacggtgacaaagatggctcagagggggactgctgctgcctggccactgctccctaagccagcctggtccatgcagggggctcctgggggtggggaggtgtcacatggtgcccctagctttatatatggacatggcaggccgatttgggaaccaagctattcctttcccttcctcttcggccctcagatgtcccttgatgcacagagaagctggggaggagctttgttttgggggtcaggcagccagtgagatgagggatgggcctggcattcttgtacagtgtatattgaaatttatttaatgtgagtttggtctggactgacagcatgtgccctcctgagggaggacctggggcacagtccaggaacaagctaattgggagtccaggcacaggatgctgtgttgtcaacaaaccaagcatcagggggaagaagcagagagatgcggccaagataggaccttgggccaaatccgctctcttcctgcccctctttctctttcttcctttactttcccttgcttttccctcttttcttactcctcctctttctctccccaacccccattctcatctgcacccttcttttctcatgtgtttgcataaacattcttttaacttctttctatttgacttgtggttgaattaaaattgtcccatttgc

SEQ ID NO: 3435 - DNA, 4555 bp, Homo sapiens
gcagttcccgcctcctcaggtccgggcgggtccctggccggggtagcacggaagggtctcccaggcggcgtagtagggcttccgtgttactggaaacctacttccggctgcaaatgggaaaaggagcctctaccttaaccaatccccgggaacctcaggcccgcggatgggagaaaccagagatgccaacttcctgcttccgaagtagtggctgggtcttaaagcaccgatgtttctgcattgaatagccctggaagacagaattcttgtctctccaaagatctggcagacttattcccaattataagagatccttgcaaaggaggtgtcttgcttcaccttcaccttccactgtgattgtaagttttctgaggcctcgccagccatgcggaactgaataggactagcaacttcatagacggttgtgaagacaagctagacggcagatgaaagttcttggcacagagtgaacacttgataaactatatggcagccacagcctccggagccgttgcacacctacctgcccggccgacttacctgtacttgccgccgtcccggctcacctggcggtgcccgaggagtagtcgctggagtccgcgcctccctgggactgcaatgtgccgatcttagctgctgcctgagaggatgtctggggtgtccgagcccctgagtcgagtaaagttgggcacgttacgccggcctgaaggccctgcagagcccatggtggtggtaccagtagatgtggaaaaggaggacgtgcgtatcctcaaggtctgcttctatagcaacagcttcaatcctgggaaaaacttcaaactggtcaaatgcactgtccagacggagatccgggagatcatcacctccatcctgctgagcgggcggatcgggcccaacatccggttggctgagtgctatgggctgaggctgaagcacatgaagtccgatgagatccactggctgcacccacagatgacggtgggtgaggtgcaggacaagtatgagtgtctgcacgtggaagccgagtggaggtatgaccttcaaatccgctacttgccagaagacttcatggagagcctgaaggaggacaggaccacgctgctctatttttaccaacagctccggaacgactacatgcagcgctacgccagcaaggtcagcgagggcatggccctgcagctgggctgcctggagctcaggcggttcttcaaggatatgccccacaatgcacttgacaagaagtccaacttcgagctcctagaaaaggaagtggggctggacttgtttttcccaaagcagatgcaggagaacttaaagcccaaacagttccggaagatgatccagcagaccttccagcagtacgcctcgctcagggaggaggagtgcgtcatgaagttcttcaacactctcgccggcttcgccaacatcgaccaggagacctaccgctgtgaactcattcaaggatggaacattactgtggacctggtcattggccctaaagggatccgccagctgactagtcaggacgcaaagcccacctgcctggccgagttcaagcagatcaggtccatcaggtgcctcccgctggaggagggccaggcagtacttcagctgggcattgaaggtgccccccaggccttgtccatcaaaacctcatccctagcagaggctgagaacatggctgacctcatagacggctactgccggctgcagggtgagcaccaaggctctctcatcatccatcctaggaaagatggtgagaagcggaacagcctgccccagatccccatgctaaacctggaggcccggcggtcccacctctcagagagctgcagcatagagtcagacatctacgcagagattcccgacgaaaccctgcgaaggcccggaggtccacagtatggcattgcccgtgaagatgtggtcctgaatcgtattcttggggaaggcttttttggggaggtctatgaaggtgtctacacaaatcacaaaggggagaaaatcaatgtagctgtcaagacctgcaagaaagactgcactctggacaacaaggagaagttcatgagcgaggcagtgatcatgaagaacctcgaccacccgcacatcgtgaagctgatcggcatcattgaagaggagcccacctggatcatcatggaattgtatccctatggggagctgggccactacctggagcggaacaagaactccctgaaggtgctcaccctcgtgctgtactcactgcagatatgcaaagccatggcctacctggagagcatcaactgcgtgcacagggacattgctgtccggaacatcctggtggcctcccctgagtgtgtgaagctgggggactttggtctttcccggtacattgaggacgaggactattacaaagcctctgtgactcgtctccccatcaaatggatgtccccagagtccattaacttccgacgcttcacgacagccagtgacgtctggatgttcgccgtgtgcatgtgggagatcctgagctttgggaagcagcccttcttctggctggagaacaaggatgtcatcggggtgctggagaaaggagaccggctgcccaagcctgatctctgtccaccggtcctttataccctcatgacccgctgctgggactacgaccccagtgaccggccccgcttcaccgagctggtgtgcagcctcagtgacgtttatcagatggagaaggacattgccatggagcaagagaggaatgctcgctaccgaacccccaaaatcttggagcccacagccttccaggaacccccacccaagcccagccgacctaagtacagaccccctccgcaaaccaacctcctggctccaaagctgcagttccaggttcctgagggtctgtgtgccagctctcctacgctcaccagccctatggagtatccatctcccgttaactcactgcacaccccacctctccaccggcacaatgtcttcaaacgccacagcatgcgggaggaggacttcatccaacccagcagccgagaagaggcccagcagctgtgggaggctgaaaaggtcaaaatgcggcaaatcctggacaaacagcagaagcagatggtggaggactaccagtggctcaggcaggaggagaagtccctggaccccatggtttatatgaatgataagtccccattgacgccagagaaggaggtcggctacctggagttcacagggcccccacagaagcccccgaggctgggcgcacagtccatccagcccacagctaacctggaccggactgatgacctggtgtacctcaatgtcatggagctggtgcgggccgtgctggagctcaagaatgagctctgtcagctgccccccgagggctacgtggtggtggtgaagaatgtggggctgaccctgcggaagctcatcgggagcgtggatgatctcctgccttccttgccgtcatcttcacggacagagatcgagggcacccagaaactgctcaacaaagacctggcagagctcatcaacaagatgcggctggcacagcagaacgccgtgacctccctaagtgaggagtgcaagaggcagatgctgacggcttcacacaccctggctgtggacgccaagaacctgctcgacgctgtggaccaggccaaggttctggccaatctggcccacccacctgcagagtgacggagggtgggggccacctgcctgcgtcttccgcccctgcctgccatgtacctcccctgccttgctgttggtcatgtgggtcttccagggggaaggccaaggggagtcaccttcccttgccactttgcacgacgccctctccccacccctacccctggctgtactgctcaggctgcagctggacagaggggactctgggctatggacacagggtgacggtgacaaagatggctcagagggggactgctgctgcctggccactgctccctaagccagcctggtccatgcagggggctcctgggggtggggaggtgtcacatggtgcccctagctttatatatggacatggcaggccgatttgggaaccaagctattcctttcccttcctcttcggccctcagatgtcccttgatgcacagagaagctggggaggagctttgttttgggggtcaggcagccagtgagatgagggatgggcctggcattcttgtacagtgtatattgaaatttatttaatgtgagtttggtctggactgacagcatgtgccctcctgagggaggacctggggcacagtccaggaacaagctaattgggagtccaggcacaggatgctgtgttgtcaacaaaccaagcatcagggggaagaagcagagagatgcggccaagataggaccttgggccaaatccgctctcttcctgcccctctttctctttcttcctttactttcccttgcttttccctcttttcttactcctcctctttctctccccaacccccattctcatctgcacccttcttttctcatgtgtttgcataaacattcttttaacttctttctatttgacttgtggttgaattaaaattgtcccatttgc

SEQ ID NO: 3436 - DNA, 2614 bp, Homo sapiens
cgactgaggcggcgggcggagcggcaggcggcggcggcgcggcagcggagcgcagcatcatggcggaccgagacagcggcagcgagcagggtggtgcggcgctgggttcgggcggctccctggggcaccccggctcgggctcaggctccggcgggggcggtggtggcggcgggggcggcggcggcagtggcggcggcggcggcggggccccaggggggctgcagcacgagacgcaggagctggcctccaagcgggtggacatccagaacaagcgcttctacctggacgtgaagcagaacgccaagggccgcttcctgaagatcgccgaggtgggcgcgggcggcaacaagagccgccttactctctccatgtcagtggccgtggagttccgcgactacctgggcgacttcatcgagcactacgcgcagctgggccccagccagccgccggacctggcccaggcgcaggacgagccgcgccgggcgctcaaaagcgagttcctggtgcgcgagaaccgcaagtactacatggatctcaaggagaaccagcgcggccgcttcctgcgcatccgccagacggtcaaccgggggcctggcctgggctccacgcagggccagaccattgcgctgcccgcgcaggggctcatcgagttccgtgacgctctggccaagctcatcgacgactacggagtggaggaggagccggccgagctgcccgagggcacctccttgactgtggacaacaagcgcttcttcttcgatgtgggctccaacaagtacggcgtgtttatgcgagtgagcgaggtgaagcccacctatcgcaactccatcaccgtgccctacaaggtgtgggccaagttcggacacaccttctgcaagtactcggaggagatgaagaagattcaagagaagcagagggagaagcgggctgcctgtgagcagcttcaccagcagcaacagcagcagcaggaggagaccgccgctgccaccctgctactgcagggtgaggaagaaggggaagaagattgatcaaactgaatgaaacccccacacacacacacatgcatacacacacacacacagccacacacacagaaaatatactgtaaagaaagagagaaaataaaaagttaaaaagttaaaaaaaaaaaaaaacctgttaactccaagggagcaccacccacagaacctccaccaactgacagtttctcttcttgacttgccacccatcgctggatgttgtccactttatccaccatataaaacagtaagcagctgctaaaaacaaaaaaaatacaaaaagtaataacattatatgaactgtgtttcctacttgattaaaaaatataaagaactgagtgtttatttccctaattaaccaagaacttttgtacacgtttaagctattattattaaaaagtgtttgcaaaatggtcaagattataatattgctgaattatataaaagtccttttcatgttgagctaacatttgactttagcacaaaaaagagatattttagaacacgtaaaataatatttttagtttttctcattttgttaccaaatttcaaaccttacatggaggttattatagtatatttgacaccctatatacctgtgattagagatgtgtatatatatgagggctaggcatgctgtgtgtctgagctttgtctaaatgttatgcagaagtttgtagagttaaaggtacgtaggtttaattcatgcaaggtaaacaataagtgctctcttttatacaatatgcattgcatctggaccttaaacttataaaaatggtcagtgaaacttctgtgaacatgaagaaattattaaaaaaggcatttaaatgaaatttgctaagttgtgatttttatggttggaaccaaagttattcaaatagtaaaaggaaaaagaaagaaaaaggagatctcccataatatttttctgcatctgtttgctttgactgagtaggcgttttgtcattattgtgtatatgagatgtacttgtatcgttcataatatattttttttattatgtgtagaaagattttaaaaaactaacgtgcagcaatttccagtgaacctgtacttggacatcaggtagtgagtctatttgtggtcactagcactgtctcctaaacttgtaagaggtctgaagctattctttgatttttgctagtgctattaacttatgtagacctgttaaaaagcagagcaacacaattatagttatcctactgagccatggattctgagttttgttttaaaagtgaaagccaagttggtgtatgtaaaggatttccatgtagctgtggtgctagttattactggctacattatatgctaagtgtatttgtgttccccaagtgtacaagccttctatcaaaagtatgttctataactcatatattcaaggtgtagggtatgaaaatgcaaagtttaggagagcactttaccaagctggtgtcctccaaactgaaattgtttgtaacgatagtcttttacaggttttcctttaaagatgtttgtgtgcttttaattgacaactaacttcttgctgctgtatagtaaaatattaatatatttttatcattaaactgctgcatgactatca

SEQ ID NO: 3437 - DNA, 989 bp, Homo sapiens
gcaggcgccacccatgagcccctctgcggccccctcccgggtcccacctcgcaggccagctggagggcgcgatcctggcgtcccccgacggcctggggccccaatccagaggcctgggtgggaggggaccaagggtgtagtaaggaagcgccttttgctggagggcaacggaccggggcggggagtcgggagaccagagtgggaggaaggcggggagtccaggttccgccccggagccgacttcctcctggtcggcggctgcagcggggtgagcggcggcagcggccggggatcctggagccatggggcgcgcgcgcgacgccatcctggatgcgctggagaacctgaccgccgaggagctcaagaagttcaagctgaagctgctgtcggtgccgctgcgcgagggctacgggcgcatcccgcggggcgcgctgctgtccatggacgccttggacctcaccgacaagctggtcagcttctacctggagacctacggcgccgagctcaccgctaacgtgctgcgcgacatgggcctgcaggagatggccgggcagctgcaggcggccacgcaccagggctctggagccgcgccagctgggatccaggcccctcctcagtcggcagccaagccaggcctgcactttatagaccagcaccgggctgcgcttatcgcgagggtcacaaacgttgagtggctgctggatgctctgtacgggaaggtcctgacggatgagcagtaccaggcagtgcgggccgagcccaccaacccaagcaagatgcggaagctcttcagtttcacaccagcctggaactggacctgcaaggacttgctcctccaggccctaagggagtcccagtcctacctggtggaggacctggagcggagctgaggctccttcccagcaacactccggtcagcccctggcaatcccaccaaatcatcctgaatctgatctttttatacacaatatacgaaaagccagcttgaa

SEQ ID NO: 3438 - DNA, 696 bp, Homo sapiens
ccgacttcctcctggtcggcggctgcagcggggtgagcggcggcagcggccggggatcctggagccatggggcgcgcgcgcgacgccatcctggatgcgctggagaacctgaccgccgaggagctcaagaagttcaagctgaagctgctgtcggtgccgctgcgcgagggctacgggcgcatcccgcggggcgcgctgctgtccatggacgccttggacctcaccgacaagctggtcagcttctacctggagacctacggcgccgagctcaccgctaacgtgctgcgcgacatgggcctgcaggagatggccgggcagctgcaggcggccacgcaccagggcctgcactttatagaccagcaccgggctgcgcttatcgcgagggtcacaaacgttgagtggctgctggatgctctgtacgggaaggtcctgacggatgagcagtaccaggcagtgcgggccgagcccaccaacccaagcaagatgcggaagctcttcagtttcacaccagcctggaactggacctgcaaggacttgctcctccaggccctaagggagtcccagtcctacctggtggaggacctggagcggagctgaggctccttcccagcaacactccggtcagcccctggcaatcccaccaaatcatcctgaatctgatctttttatacacaatatacgaaaagccagcttgaa

SEQ ID NO: 3439 - DNA, 505 bp, Homo sapiens
atggggcgcgcgcgcgacgccatcctggatgcgctggagaacctgaccgccgaggagctcaagaagttcaagctgcaggcggccacgcaccagggctctggagccgcgccagctgggatccaggcccctcctcagtcggcagccaagccaggcctgcactttatagaccagcaccgggctgcgcttatcgcgagggtcacaaacgttgagtggctgctggatgctctgtacgggaaggtcctgacggatgagcagtaccaggcagtgcgggccgagcccaccaacccaagcaagatgcggaagctcttcagtttcacaccagcctggaactggacctgcaaggacttgctcctccaggccctaagggagtcccagtcctacctggtggaggacctggagcggagctgaggctccttcccagcaacactccggtcagcccctggcaatcccaccaaatcatcctgaatctgatctttttatacacaatatacgaaaagccagcttg

SEQ ID NO: 3440 - DNA, 1989 bp, Homo sapiens
ctccttcccgctccgcgtcccgcccagcggcgcagggggccgggctccggctaggagggtgggggccgcgccggtgacagccgatccccgcccctgctgcccgccacgtccctcacgtaccactcggcagaggcgcggggaaacctggcgtactggctgtggcttctctagcgggactcggcatgaggctggcgcggctgcttcgcggagccgccttggccggcccgggcccggggctgcgcgccgccggcttcagccgcagcttcagctcggactcgggctccagcccggcgtccgagcgcggcgttccgggccaggtggacttctacgcgcgcttctcgccgtccccgctctccatgaagcagttcctggacttcggatcagtgaatgcttgtgaaaagacctcatttatgtttctgcggcaagagttgcctgtcagactggcaaatataatgaaagaaataagtctccttccagataatcttctcaggacaccatccgttcaattggtacaaagctggtatatccagagtcttcaggagcttcttgattttaaggacaaaagtgctgaggatgctaaagctatttatgactttacagatactgtgatacggatcagaaaccgacacaatgatgtcattcccacaatggcccagggtgtgattgaatacaaggagagctttggggtggatcctgtcaccagccagaatgttcagtactttttggatcgattctacatgagtcgcatttcaattagaatgttactcaatcagcactctttattgtttggtggaaaaggcaaaggaagtccatctcatcgaaaacacattggaagcataaatccaaactgcaatgtacttgaagttattaaagatggctatgaaaatgctaggcgtctgtgtgatttgtattatattaactctcccgaactagaacttgaagaactaaatgcaaaatcaccaggacagccaatacaagtggtttatgtaccatcccatctctatcacatggtgtttgaacttttcaagaatgcaatgagagccactatggaacaccatgccaacagaggtgtttacccccctattcaagttcatgtcacgctgggtaatgaggatttgactgtgaagatgagtgaccgaggaggtggcgttcctttgaggaaaattgacagacttttcaactacatgtattcaactgcaccaagacctcgtgttgagacctcccgcgcagtgcctctggctggttttggttatggattgcccatatcacgtctttacgcacaatacttccaaggagacctgaagctgtattccctagagggttacgggacagatgcagttatctacattaaggctctgtcaacagactcaatagaaagactcccagtgtataacaaagctgcctggaagcattacaacaccaaccacgaggctgatgactggtgcgtccccagcagagaacccaaagacatgacgacgttccgcagtgcctagacacacttgggacatcggaaaatccaaatgtggcttttgtattaaatttggaaggtatggtgttcagaactatattataccaagtactttatttatcgttttcacaaaactatttgagtagaataaatggaaactgaattccatttgtgcccgttaaacctcctaaaggatgaaattgcacctattttacacttatattttcacagttaattgaacatatttttaaacaactgtagttttgggcaacttttcactttgtggtagacttcagaagtgtggaaatcttcgggtttctataggaaactagttttttttttttaagaaatactttcatttatgtttgctagaaacattttctaaatgatagtgattagctggttagccatcttcctgttatttggaggagttctgccatcttttattcggtagtgacagctgtaatatggtcttcatgtttatcagtgacttgactacaagtaaagcagaaaacagttgg

SEQ ID NO: 3441 - DNA, 1515 bp, Homo sapiens
gccgggctccggctaggagggtgggggccgcgccggtgacagccgatccccgcccctgctgcccgccacgtccctcacgtaccactcggcagaggcgcggggaaacctggcgtactggctgtggcttctctagcgggactcggcatgaggctggcgcggctgcttcgcggagccgccttggccggcccgggcccggggctgcgcgccgccggcttcagccgcagcttcagctcggactcgggctccagcccggcgtccgagcgcggcgttccgggccaggtggacttctacgcgcgcttctcgccgtccccgctctccatgaagcagttcctggacttcggatcagtgaatgcttgtgaaaagacctcatttatgtttctgcggcaagagttgcctgtcagactggcaaatataatgaaagaaataagtctccttccagataatcttctcaggacaccatccgttcaattggtacaaagctggtatatccagagtcttcaggagcttcttgattttaaggacaaaagtgctgaggatgctaaagctatttatgaaaggcctagaagaacatggttgcaggtctctagtttatgctgtatggcctgcaagatgatctttacagatactgtgatacggatcagaaaccgacacaatgatgtcattcccacaatggcccagggtgtgattgaatacaaggagagctttggggtggatcctgtcaccagccagaatgttcagtactttttggatcgattctacatgagtcgcatttcaattagaatgttactcaatcagcactctttattgtttggtggaaaaggcaaaggaagtccatctcatcgaaaacacattggaagcataaatccaaactgcaatgtacttgaagttattaaagatggctatgaaaatgctaggcgtctgtgtgatttgtattatattaactctcccgaactagaacttgaagaactaaatgcaaaatcaccaggacagccaatacaagtggtttatgtaccatcccatctctatcacatggtgtttgaacttttcaagaatgcaatgagagccactatggaacaccatgccaacagaggtgtttacccccctattcaagttcatgtcacgctgggtaatgaggatttgactgtgaagatgagtgaccgaggaggtggcgttcctttgaggaaaattgacagacttttcaactacatgtattcaactgcaccaagacctcgtgttgagacctcccgcgcagtgcctctggctggttttggttatggattgcccatatcacgtctttacgcacaatacttccaaggagacctgaagctgtattccctagagggttacgggacagatgcagttatctacattaaggctctgtcaacagactcaatagaaagactcccagtgtataacaaagctgcctggaagcattacaacaccaaccacgaggctgatgactggtgcgtccccagcagagaacccaaagacatgacgacgttccgcagtgcctag

SEQ ID NO: 3442 - DNA, 2987 bp, Homo sapiens
gatccccgcccctgctgcccgccacgtccctcacgtaccactcggcagaggcgcggggaaacctggcgtactggctgtggcttctctagcgggactcggcatgaggctggcgcggctgcttcgcggagccgccttggccggcccgggcccggggctgcgcgccgccggcttcagccgcagcttcagctcggactcgggctccagcccggcgtccgagcgcggcgttccgggccaggtggacttctacgcgcgcttctcgccgtccccgctctccatgaagcagttcctggacttcggatcagtgaatgcttgtgaaaagacctcatttatgtttctgcggcaagagttgcctgtcagactggcaaatataatgaaagaaataagtctccttccagataatcttctcaggacaccatccgttcaattggtacaaagctggtatatccagagtcttcaggagcttcttgattttaaggacaaaagtgctgaggatgctaaagctatttatgactttacagatactgtgatacggatcagaaaccgacacaatgatgtcattcccacaatggcccagggtgtgattgaatacaaggagagctttggggtggatcctgtcaccagccagaatgttcagtactttttggatcgattctacatgagtcgcatttcaattagaatgttactcaatcagcactctttattgtttggtggaaaaggcaaaggaagtccatctcatcgaaaacacattggaagcataaatccaaactgcaatgtacttgaagttattaaagatggctatgaaaatgctaggcgtctgtgtgatttgtattatattaactctcccgaactagaacttgaagaactaaatgcaaaatcaccaggacagccaatacaagtggtttatgtaccatcccatctctatcacatggtgtttgaacttttcaagaatgcaatgagagccactatggaacaccatgccaacagaggtgtttacccccctattcaagttcatgtcacgctgggtaatgaggatttgactgtgaagatgagtgaccgaggaggtggcgttcctttgaggaaaattgacagacttttcaactacatgtattcaactgcaccaagacctcgtgttgagacctcccgcgcagtgcctctggctggttttggttatggattgcccatatcacgtctttacgcacaatacttccaaggagacctgaagctgtattccctagagggttacgggacagatgcagttatctacattaaggctctgtcaacagactcaatagaaagactcccagtgtataacaaagctgcctggaagcattacaacaccaaccacgaggctgatgactggtgcgtccccagcagagaacccaaagacatgacgacgttccgcagtgcctagacacacttgggacatcggaaaatccaaatgtggcttttgtattaaatttggaagtgtggcccagagttgctcagaattggagcagagcctgagacgtatctgcagatcctgtcatcagctggcaagtccaggagactgtgtcatttagagactgtgttgttagttatccctcaacatcttctaaggtggcaggaaataatattggaaataacattttaaagtaaaaattttaaagtttaaagaagagttttgccacttaaacaggggagctttgtctggaaaatacactgagttgaaacacttcatccttggaaggattatataagatgaacagttgtgataaatgtgtagattagagggatgtgaatgggcagttagtccagtgccctcatttaagaggccaagatcctgattcagaggaggcatcctttgcccagagctgcttagctaatctgaccaaatgttgggaaaaatgtctcacctaacccactattccttaattatggattttgtgaaaaacaatagaacatgttaatgagtaatttatattagttcgatgtattacaattttttagctttaaattacagttttcttataatgttgaaatgttttagaatcctttgaatctaagtatttgtttcctaaatgaaacatttgtacaacatttgatgtttttacttatgaaatattctcctcccccaagaaaatttaaactttttctctctatttaaaagctaagaaatgttttaaaggaaaaatgaaattatcttcctttagcttatttttaaggtaaaacagctttttactctgttattgtggtaatggacagaatattacatacaaaaatattctgggagagctttttcctagttggttttaaatcattgtgccacctgaaaggtttttagattttataggagctaatttgtccaccagcattaatgtaacacagtgtagttatgaaaatatattgaaggacaggaagtggacacgaagtgatttttgtaacctgagcagttaatgaatgtgccaacattttctaggaagggacagcaagaatattctgctctgtagttaaaatactggctggcttttgatgtcttcatgcttaattgtgatcactttcttgcactgtgatgtttttacgtgaatatgttgaagtagaagtctaccatattattttataaaatgttttctgtatggcaataaactgaaaacatggatcaacccttcttttgaaaataaactgagtcaatttagccttttaaaaatatagtcatctcttttaaatagaatcctcttccaccatcaaggctcaacattttgtaagcatccaaaaaattggtaattagggggcttgcactaaatttcactatcttcagtagagaggaactgtttggaacttagatttccaatgtgtatattctaatggagaaagcaagaggtagagtttgtatgtttgacttaccttagatttttattttccatacatactgcaaatgattgacttgttgcataaatgaagatcttctgttgtgtgcttttcaaacactgtaaataaatttgaaatttgaa

SEQ ID NO: 3443 - DNA, 1748 bp, Homo sapiens
ataatatgctcctttttcaggtaaagagacggaggctcagagaggttaaacagctcactcaaaggcacagagccagtacatggcagtacatctcttctcccggggccgccgtcgcggtgatactatttagggccacacgtcccagtgttcagctttcgtatttacgtactactgtttggcaagcggggactcctgaagctctctgaccctggaaaatgcgtggcttgcgtcacagaggagcgtttctggaacgcgctcgcagcacgacaccgcggtgtgtgcaagcggaacgccgccctgtccttgagccttttggctgagattgggagggcagaggaagcaggaaggatcagtgaatgcttgtgaaaagacctcatttatgtttctgcggcaagagttgcctgtcagactggcaaatataatgaaagaaataagtctccttccagataatcttctcaggacaccatccgttcaattggtacaaagctggtatatccagagtcttcaggagcttcttgattttaaggacaaaagtgctgaggatgctaaagctatttatgactttacagatactgtgatacggatcagaaaccgacacaatgatgtcattcccacaatggcccagggtgtgattgaatacaaggagagctttggggtggatcctgtcaccagccagaatgttcagtactttttggatcgattctacatgagtcgcatttcaattagaatgttactcaatcagcactctttattgtttggtggaaaaggcaaaggaagtccatctcatcgaaaacacattggaagcataaatccaaactgcaatgtacttgaagttattaaagatggctatgaaaatgctaggcgtctgtgtgatttgtattatattaactctcccgaactagaacttgaagaactaaatgcaaaatcaccaggacagccaatacaagtggtttatgtaccatcccatctctatcacatggtgtttgaacttttcaagaatgcaatgagagccactatggaacaccatgccaacagaggtgtttacccccctattcaagttcatgtcacgctgggtaatgaggatttgactgtgaagatgagtgaccgaggaggtggcgttcctttgaggaaaattgacagacttttcaactacatgtattcaactgcaccaagacctcgtgttgagacctcccgcgcagtgcctctggctggttttggttatggattgcccatatcacgtctttacgcacaatacttccaaggagacctgaagctgtattccctagagggttacgggacagatgcagttatctacattaaggctctgtcaacagactcaatagaaagactcccagtgtataacaaagctgcctggaagcattacaacaccaaccacgaggctgatgactggtgcgtccccagcagagaacccaaagacatgacgacgttccgcagtgcctagacacacttgggacatcggaaaatccaaatgtggcttttgtattaaatttggaagattcttcagttttgggacttggactggctttccttgcccctcagcttgcagatggcctgttgtgggaccttgtgatcatgaactcctcctcccacatctgatggagctaccaatcatcagatctcctctgcctctggggtgcgtctcaggctggccaatcacgttcttcatccacgtggactatgactggccctagggagaaaacatggagatatgaatgactgtgtggagc

SEQ ID NO: 3444 - DNA, 1338 bp, Homo sapiens
gcgctcgcagcacgacaccgcggtgtgtgcaagcggaacgccgccctgtccttgagccttttggctgagattgggagggcagaggaagcaggaaggatcagtgaatgcttgtgaaaagacctcatttatgtttctgcggcaagagttgcctgtcagactggcaaatataatgaaagaaataagtctccttccagataatcttctcaggacaccatccgttcaattggtacaaagctggtatatccagagtcttcaggagcttcttgattttaaggacaaaagtgctgaggatgctaaagctatttatgaggaataggtccaaaacaggcaggctttattggctcattcatcttgattccttgcagagcagagcaggtgttctctagagctttacagatactgtgatacggatcagaaaccgacacaatgatgtcattcccacaatggcccagggtgtgattgaatacaaggagagctttggggtggatcctgtcaccagccagaatgttcagtactttttggatcgattctacatgagtcgcatttcaattagaatgttactcaatcagcactctttattgtttggtggaaaaggcaaaggaagtccatctcatcgaaaacacattggaagcataaatccaaactgcaatgtacttgaagttattaaagatggctatgaaaatgctaggcgtctgtgtgatttgtattatattaactctcccgaactagaacttgaagaactaaatgcaaaatcaccaggacagccaatacaagtggtttatgtaccatcccatctctatcacatggtgtttgaacttttcaagaatgcaatgagagccactatggaacaccatgccaacagaggtgtttacccccctattcaagttcatgtcacgctgggtaatgaggatttgactgtgaagatgagtgaccgaggaggtggcgttcctttgaggaaaattgacagacttttcaactacatgtattcaactgcaccaagacctcgtgttgagacctcccgcgcagtgcctctggctggttttggttatggattgcccatatcacgtctttacgcacaatacttccaaggagacctgaagctgtattccctagagggttacgggacagatgcagttatctacattaaggctctgtcaacagactcaatagaaagactcccagtgtataacaaagctgcctggaagcattacaacaccaaccacgaggctgatgactggtgcgtccccagcagagaacccaaagacatgacgacgttccgcagtgcctagacacacttgggacatcggaaaatccaaatgtggcttttgtattaaattt

SEQ ID NO: 3445 - DNA, 2384 bp, Homo sapiens
cttttcctgagccgcttggatctttgtggaagcgggtgggctgcatatatacaggacggattcgtataggcttgcaccctggttccgaattttgcaaatattcgcagtctgggtcactgtcatccggactgggaatccccaagacccgttaagggaggatagaaggagctggaccctagctgccccagtgggcaaggacacttgaagatcaaatctgttccggcctggcagcctctccccagctgggcaggggccccaggcaccgtgatgtggagtcaagccgcctatacctcccttggctgccccagggctgctaggatccagcaatgcctgtgagaaaacctccttcaccttcctcaggcaggagctgcctgtgcgcctggccaacatcatgaaagagatcaacctgcttcccgaccgagtgctgagcacaccctccgtgcagctggtgcagagctggtatgtccagagcctcctggacatcatggagttcctggacaaggatcccgaggaccatcgcaccctgagccagttcactgacgccctggtcaccatccggaaccggcacaacgacgtggtgcccaccatggcacaaggcgtgcttgagtacaaggacacctacggcgatgaccccgtctccaaccagaacatccagtacttcctggaccgcttctacctcagccgcatctccatccgcatgctcatcaaccagcacaccctcatctttgatggcagcaccaacccagcccatcccaaacacatcggcagcatcgaccccaactgcaacgtctctgaggtggtcaaagatgcctacgacatggctaagctcctgtgtgacaagtattacatggcctcacctgacctggagatccaggagatcaatgcagccaactccaaacagccgattcacatggtctacgtcccctcccacctctaccacatgctctttgagctcttcaagaatgccatgagggcgactgtggaaagccatgagtccagcctcattctcccacccatcaaggtcatggtggccttgggtgaggaagatctgtccatcaagatgagtgaccgaggtgggggtgttcccttgaggaagattgagcgactcttcagctacatgtactccacagcacccaccccccagcctggcaccgggggaacgccgctggctggctttggttatgggctccccatttcccgcctctacgccaagtacttccagggagacctgcagctcttctccatggaaggctttgggaccgatgctgtcatctatctcaaggccctgtccacggactcggtggagcgcctgcctgtctacaacaagtcagcctggcgccactaccagaccatccaggaggccggcgactggtgtgtgcccagcacggagcccaagaacacgtccacgtaccgcgtcagctaagggccgccgtgcatctgcacctgagaggacggactgccgcctctgggtccccccaccgtggtgcccctcaccatcctcctgggggagcagggggtgggttctccctgatgaccaggttctgtctctatggaagtcactgcggtgataggtctgtgatggtccctaagtgccagtccatctctgtggagacccctcggtggcctccctatctctgtgggcgatgcctgagggttagggatgtctccaccctgatggggtgtcccagagacattttcccatggcagtcctcctctctgagaccagggctgtcacttttctgccaggggtactgggtccccctcagcaccctccacagcacaggccttccaagtggatgtcccgttgccttattcccccagcccacaaaggcaccctggccttggcctgctgaagtgttaggaagagggtgggtgccctccagacctggggactgagtggggaaaggagttacacccgtgagtggggaatgaggctggtcctgcagcctctccctccgctcagggcttgaaggtcggtggcggagggggtggctctcacagggcccaactctaaagtggaagaaccttgttagaccgagagcttgccatccagccaagctgctcgaggccctgcagtggccttggcaatgtctgtgccacctcctgagccctcccagcatgtcctcacatgctcatgcccacccgctcctccacaagcctagtccatcctgcctgagctccagcccccagcccccactgtgcccagacatgtgtgctcagggtggctttctccctaggaccttctgtgtatatagttagttttataaccctgaatgcccccacccttcccctaagcacacaggggttaaagctgtgtgtccctcccagtggctgtggcagtgacagtgacacccacacccacagtaaagaggagactgaatgag

SEQ ID NO: 3446 - DNA, 3440 bp, Homo sapiens
attggcgacgtcgaggcgccatgacgagccgattggctgggcgttggaatgcccgccagggcaagggtagggaggaggcggccgaaccgcgtcgctgggccgaaaggtgcgcgagcgctgcccgcgcggggaccacaaccaaagtcgcggccgccgcagccatgcgctgggtgtgggcgctgctgaagaatgcgtccctggcaggggcgcccaagtacatagagcacttcagcaagttctccccgtccccgctgtccatgaagcagtttctggacttcggatccagcaatgcctgtgagaaaacctccttcaccttcctcaggcaggagctgcctgtgcgcctggccaacatcatgaaagagatcaacctgcttcccgaccgagtgctgagcacaccctccgtgcagctggtgcagagctggtatgtccagagcctcctggacatcatggagttcctggacaaggatcccgaggaccatcgcaccctgagccagttcactgacgccctggtcaccatccggaaccggcacaacgacgtggtgcccaccatggcacaaggcgtgcttgagtacaaggacacctacggcgatgaccccgtctccaaccagaacatccagtacttcctggaccgcttctacctcagccgcatctccatccgcatgctcatcaaccagcacaccctcatctttgatggcagcaccaacccagcccatcccaaacacatcggcagcatcgaccccaactgcaacgtctctgaggtggtcaaagatgcctacgacatggctaagctcctgtgtgacaagtattacatggcctcacctgacctggagatccaggagatcaatgcagccaactccaaacagccgattcacatggtctacgtcccctcccacctctaccacatgctctttgagctcttcaagaatgccatgagggcgactgtggaaagccatgagtccagcctcattctcccacccatcaaggtcatggtggccttgggtgaggaagatctgtccatcaagatgagtgaccgaggtgggggtgttcccttgaggaagattgagcgactcttcagctacatgtactccacagcacccaccccccagcctggcaccgggggaacgccgctggctggctttggttatgggctccccatttcccgcctctacgccaagtacttccagggagacctgcagctcttctccatggaaggctttgggaccgatgctgtcatctatctcaaggccctgtccacggactcggtggagcgcctgcctgtctacaacaagtcagcctggcgccactaccagaccatccaggaggccggcgactggtgtgtgcccagcacggagcccaagaacacgtccacgtaccgcgtcagctaagggccgccgtgcatctgcacctgagaggacggactgccgcctctgggtccccccaccgtggtgcccctcaccatcctcctgggggagcagggggtgggttctccctgatgaccaggttctgtctctatggaagtcactgcggtgataggtctgtgatggtccctaagtgccagtccatctctgtggagacccctcggtggcctccctatctctgtgggcgatgcctgagggttagggatgtctccaccctgatggggtgtcccagagacattttcccatggcagtcctcctctctgagaccagggctgtcacttttctgccaggggtactgggtccccctcagcaccctccacagcacaggccttccaagtggatgtcccgttgccttattcccccagcccacaaaggcaccctggccttggcctgctgaagtgttaggaagagggtgggtgccctccagacctggggactgagtggggaaaggagttacacccgtgagtggggaatgaggctggtcctgcagcctctccctccgctcagggcttgaaggtcggtggcggagggggtggctctcacagggcccaactctaaagtggaagaaccttgttagaccgagagcttgccatccagccaagctgctcgaggccctgcagtggccttggcaatgtctgtgccacctcctgagccctcccagcatgtcctcacatgctcatgcccacccgctcctccacaagcctagtccatcctgcctgagctccagcccccagcccccactgtgcccagacatgtgtgctcagggtggctttctccctaggaccttctgtgtatatagttagttttataaccctgaatgcccccacccttcccctaagcacacaggggttaaagctgtgtgtccctcccagtggctgtggcagtgacagtgacacccacacccacagtaaagaggagactgaatgagactggcctggctgcatccctgggggaggggacccacacgtgcgcacgtacacacgcacactgcggtgccctgtgaccaccacatgacgcaccggggacgtccggcccagctcaggactgtgagtaaaacactgggcaaagccatctgttcagaacgccggatggcccagcacctggtgacagacctgttgtcccaccatactcagggcccagcagagtccggccaacccaacaactggagcagacagaaattctggtcactggcacatcataaggatttattgaaataaattgagaactgcctccccttcacatgcaggtgggcacccactatagctactgatggctttaaggatgtgggtgccttccaacctcccatggccctgccaccaggcccagatggtgccagtgtcctcatatctgtttccctccgaagcccctctcccagcacagatagcagaggggggataagggctgagtcccaggtacagggtgctggccgtaagccacagcccctgggcaggaatgagggagccagcatgcattggtgccatctgccgctctgtctgggcagatgggaggagctggaggggtttccaagcgggagcccccaggcctcatcggtaactctgaccagtgtcctggaagcgggactagctgctgaccagcgccacacatgaacacttcctccaaggacatttcctaaaaaggacacatgctgtccccaggctgctggtaaactccacccccatccagggagctggccccagccctcagtgtggcccagggaagcagagcttgcaccgcctgccagttctgagcccactgattccctgacaatgcctggggcagatgggggagggctgatgaacctttccaatctcgtagctgccggggacccccaggttttgcctctctgcctggctggggtgagggctgaccaggtcagcagctcctaggccttggctggtggaagtggtgtcctctgtccctatcagttcctgtttgctcagctcccaaagaggacttaggtgccctctgaggaagcagcaggaagtgaagggagtcctggcttggagaatgggtcaaagacca

SEQ ID NO: 3447 - DNA, 2341 bp, Homo sapiens
catgagctaccatgcccggccatactgttcttgcctgtaaaataacccactgcttaaaaataaataaataacctggcatttagaaataggctctgactccaacttaaaaagtgctttgaattctatcccaggtccatttttcaataaaaacagttaaaaaaaaaaaaaaaaaggcccaaaaagcaacatgtggcagtccttagcacttaggacaaaccatcccacctatctcaggaccttcagaagcattacagtgaaggcattcctggaccttcaagaaatgtttcaataatattaggacacctgttttaaaaagtaaagaatctacctaatgaaatctaaagaatttcttacgaaatgttaactggaaaaattgtggcacttgaaaggataaaaggcattgtgtttttttcgtgagaacactgaacaaatgaagaatatataaaataagtgaaaacataaaaatagggtctcacactgttgcccaggctgaagtgctcacggctcactgcagtttcaagttcctgggctcaaagatgggagtctccctatgttgcccaggctggtctccaacacctgggctcaagtggcttggcctcccaaagcgctgggattataggtctgtgccgcctccttccggtctcggtggcgcggcacgcgcggctctctaggcctccttcagctctgtggtgacggtggccgaggtggagggccggtctgaagagtggcgggactggcttcacttcctccgcggttcctcggagccgcctcgctcctcttcagggactttgctgagaagggctctcgggcgtccagaccccaccgcaaaggtgtttggcgatccgccgagaagttgttggccccaggagcatccctcggggccgaatgcgcagtggacgatgccccttctgacccaacagatccaagacgaggatgatcagtacagccttgtggccagccttgacaacgttaggaatctctccactatcttgaaagctattcatttccgagaacatgccacgtgtttcgcaactaaaaatggtatcaaagtaacagtggaaaatgcaaagtgtgtgcaagcaaatgcttttattcaggctggaatatttcaggagtttaaagttcaggaagagtctgttacttttcgaattaatttaactgtccttttagactgtttatctatttttggatcaagtcctatgccagggactttaactgcacttcgaatgtgttaccaaggttatggttaccctttgatgctgttcctggaagaaggaggagtggtgacagtctgcaaaatcaatacacaggaacctgaggagaccctggactttgatttctgcagcaccaatgttattaataaaattattctgcagtcagaggggctccgtgaagcattttctgaattggatatgacgagtgaagtcctacaaattaccatgtctcctgacaagccttatttcaggttatctacttttggaaatgcaggaagttcccaccttgactatcccaaagattctgatttgatggaagcatttcattgtaatcagacccaagtcaacagatacaagatttccttactgaaaccctctacaaaggcattagtcctatcttgtaaggtatctattcggacagataacagaggcttcctttcattacagtatatgattagaaatgaagatggacaaatatgttttgtggaatattactgctgccctgatgaagaagttcctgaatctgagtcttgagtatgacaattcactgatatttatgtgtacatttatgatagatgaagttcttattctgagtacagtactctttgtcatttcatattggattttctatagagaagaagcacaatggggaagataggagcaaggtcatgtaccctaatagttactatgttttgtaaatccattttgtagagggcatgtaaataaatgttttcctgtagtcatagattattcaggactgtcctttagttctgtcttttgaactcatgggaataattgtgagtcagcgtaacatttcaagagtctaaaggtggccgggtgtggtggctttaatcccagcactttgggaagccgaggtgggcggatcacctgaggtcaggagttcgagaccagcctgaccaacgtggagaaaccccatctctactaaaaatacaaaaaattagccggacgtggtggcacatgcctgtaatgccagctactcgggaggctgaggcaggagaattgcttgaacccgggaggcggaggttgtggtgagctgagatgacgccattgcactccagcctaggcaataagagcaaaactctgcctcaaaaaaaaaaaaaaaaaaa

SEQ ID NO: 3448 - DNA, 5770 bp, Homo sapiens
gcttgccatcacaccacacggggtcatttacttatcacctactccgcgctagagtactatgctaagtgcggaggacgcaaaaattaatgtcaaagataatccttgttcacagtattctgtctagcttaagaagagttcttagttgaatgaaagctaattctaacaacttgtgtgcacttcttttgaataaaaaccatcaacttatttgaattcttaagtttcctcctaaactccaacatttcaggaggaagaggtcacattctagtcatctttgcaatctcaaacccaaaggaagcctaacttggtacagtgcatggcacattcaatgtctgttgaatacaagtaaagctcatactacctagtctatttttcagtatctcttgagttaatgacctggttaacaagtcagagtcacagtcccaagggcaacaactttttaaaggctcccctaacgtacttcaggatccctgactgagagtggctgactatggcagtatatgggcatactaatcactggagaaataatagcgagaaataaccaaggaaaagcactactctccaaaaacattaaaaaaaaaaaacaactgaacaactagtaagaaagaacgctggatctgagcaccctgtaagtcgcttccccgtgggccgggtaaaggttttaaaacccgccgcctccaggaagacggccacgtgcacaaggattagctgcaaactccgtgcccagtctggccgggagaattgctaaaaccgacctaccgttaacacccgggctactctgaaattaagcaaggctgtagtcaagtaagtaacccaagaaaaggcgcacagagccgccgccgcaggtgtagcccggggacatcccctcctaccttgcaaacggggcctgggatccggtccctctcttcttcctccacctcctctgctgtggcgtgccgcttagctggcggctccgcatctatttcgtttctttttggcttcttcgcctgaactgcaaagcctccacgccgtttcctcttggttgccgccatcttgcctcgccgcccgcgctcttggcctcctttccggcgctgccgctcgctcctatttccgatctctatggttcggcggctctaagcgctcagctccgcggtcgtcctccaggtctgtgccgcctccttccggtctcggtggcgcggcacgcgcggctctctaggcctccttcagctctgtggtgacggtggccgaggtggagggccggtctgaagagtggcgggactggcttcacttcctccgcggttcctcggagccgcctcgctcctcttcagggactttgctgagaagggctctcgggcgtccagaccccaccgcaaaggtgtttggcgatccgccgagaagttgttggccccaggagcatccctcggggccgaatgcgcagtggacgatgccccttctgacccaacagatccaagacgaggatgatcagtacagccttgtggccagccttgacaacgttaggaatctctccactatcttgaaagctattcatttccgagaacatgccacgtgtttcgcaactaaaaatggtatcaaagtaacagtggaaaatgcaaagtgtgtgcaagcaaatgcttttattcaggctggaatatttcaggagtttaaagttcaggaagagtctgttacttttcgaattaatttaactgtccttttagactgtttatctatttttggatcaagtcctatgccagggactttaactgcacttcgaatgtgttaccaaggttatggttaccctttgatgctgttcctggaagaaggaggagtggtgacagtctgcaaaatcaatacacaggaacctgaggagaccctggactttgatttctgcagcaccaatgttattaataaaattattctgcagtcagaggggctccgtgaagcattttctgaattggatatgacgagtgaagtcctacaaattaccatgtctcctgacaagccttatttcaggttatctacttttggaaatgcaggaagttcccaccttgactatcccaaagattctgatttgatggaagcatttcattgtaatcagacccaagtcaacagatacaagatttccttactgaaaccctctacaaaggcattagtcctatcttgtaaggtatctattcggacagataacagaggcttcctttcattacagtatatgattagaaatgaagatggacaaatatgttttgtggaatattactgctgccctgatgaagaagttcctgaatctgagtcttgagtatgacaattcactgatatttatgtgtacatttatgatagatgaagttcttattctgagtacagtactctttgtcatttcatattggattttctatagagaagaagcacaatggggaagataggagcaaggtcatgtaccctaatagttactatgttttgtaaatccattttgtagagggcatgtaaataaatgttttcctgtagtcatagattattcaggactgtcctttagttctgtcttttgaactcatgggaataattgtgagtcagcgtaacatttcaagagtctaaaggtggccgggtgtggtggctttaatcccagcactttgggaagccgaggtgggcggatcacctgaggtcaggagttcgagaccagcctgaccaacgtggagaaaccccatctctactaaaaatacaaaaaattagccggacgtggtggcacatgcctgtaatgccagctactcgggaggctgaggcaggagaattgcttgaacccgggaggcggaggttgtggtgagctgagatgacgccattgcactccagcctaggcaataagagcaaaactctgcctcaaaaaaaaaaaaaaaaaaagtctaaaggcttaaagtttgatgcagctacctgaaatgatcttttatttatttattattagaaaaagcaaaggcatatgggcattgcttattagtttgaattctagagactagatcttaaagtagtggttctcaaagtgttgtgcccgcaccaacatcagaatggcctgcaaacttgtagcaaactctggggaggaggccagcattctgtattttaacaagcttccctcaggagattctgatgcctgctaaattttgggaaccactgttttaaaggaaactttttttttctttaatagcatttaattgtatgagatgattgcttttacatgtgatttccttgcaaatgttctgaagttgaggcatcaccaaacaagtctgaacaattctttatgtgatttatttttaaagtagaccttttgaagagatctatgaatgggatataaagcaattttcagtgttacaggttttcttcttcttctcaaaactgtttgctgtaagtaactgcaatcagtacttactactttccatttgcttatgagtttcttgacaaatcaaggtgtagaaaaccagttattaagtgattttgtactttcctggtagttgtcactaaaataatttttgtggcatataaatatatttaataaaatgcaaaaattatcttcctgtctagtagaaaaaattacatgagtaaagtgaagcttctgtctttgttactgtaccaggtgacaacagctgagtgtccctccatggacagtcactattggccttttgagtgagacagttctttaggataaaaacctgtcatcccattgcaggattcatttagcctttctggcccttacccactgatgctagtcattgtgaccaccccacctcccccaaataaaagtgtgccaaactattcattgttgagaaccattcaattgtattcaccaaaattggaggatatattggaatgccctaccttaatataggtcacatagcattagagaaaattggtttggagagtattacagcaaagtgtgctgcaaggaggctactccagcacaatggcaggcactgcttcccaggcatatggacaattctgggaggtggccagggtcagcacctgataactagtaagtgtctcaatctcagcatacaaaatttagcagtgactacaaaagaagttggaattttctaaaatgtttgtattcaagaaggaaacaaatgaatttactaaatgttgtcagagtattttttgtttagataaccaccaagaacagaacaaacctaaaagatacttgggaaaatatctaatcagtcaacattctaaggactgttaaatgtgaaatagcatagttattttttgtcttttgttactagtgtgaacaaagaacggcgcctaacatataatgggcatttagtaactctgttagatgaaagactctccaatttcagattttcttttagcatcttattagtcactacttaattctgatgatttagctctaaatttattttgatctcagtttttttatttttatttttggagacaagatcttgctctgttgcccaggctggagtacagttgtaggattacagttcactccagcctcaatctcctaggctcaagcaatcctcccatctcagcttcccaaatagctacgactacaggtgcatgcctccatgccctgctaatttttgtattttttgtagagatggggttttactatgttccctaggctaatcttgaactcctgagctcaagcaatccacccgcctcggcctcccaaagggctgggattacaggcgtgagctatcatgcctggcctaatgtattttttaaaagttgaatctaaaaagaatttaaaacaaatataaatcagctcagtaaggatggatatttttgtacatttaaaactattattttaggccgggagtggtggctcacacctgtaatcccagcattttgggaagccgaggcagggggatcatctgaggtcaggaagttcgagatcagcctggccaacatggtgaaacccctacctctactaaaaatacaaaaattagctgggtgtggtggtgggtgtctgtaatcccagctacttgagaggctgaggcaagagaatcacttgaaactggaaggcgggggttgcagtgagccgagattgcaccattgcactccagcctgggtgacagagcaagactccgtctcaaaaacaaaaaaaattaaaataaaaattattgttttagctgcatgtcttcagctatttagaattcaaagactaatgaattgtttctaagtcaccctaacatcaaggtacttattttataaagaatttcctccttatttgtgttctaattgacccaggaatttttactttaataaaagtttaactttatttcctatggaaaatcactagggggagtgctccctcaggcagagcaggcgacactttggtgccactacaaattgatgtgtagtatatagaagaatacagtcttatatttaaagacttttagttctgtctttttgaagtttatctctctttctagtaaaatggtgcttactgtgaatggataatcttttttttcatttttcatttgttgatttcccattcgatgatgtagtgcttccaccgagaattgatgaaatgcttcaaaataataaaagtatttgttaaattccactttaataaaaataaggcatgtaacacagtcattttaacaggaagccacagggtttctgtggtgttaccaaagtcctagtaaaaattaattaaaattgctaaaagggcagaatgtggcactctcaacagtggggtaggcagtccttcagaacatagagacttccttctttccttccctgtcttcacattgcttgtcccttatccccacctgaaataaaatctattgggtcctga

SEQ ID NO: 3449 - DNA, 1151 bp, Homo sapiens
gtggagggccggtctgaagagtggcgggactggcttcacttcctccgcggttcctcggagccgcctcgctcctcttcagggactttgctgagaagggctctcgggcgtccagaccccaccgcaaaggtgtttggcgatccgccgagaagttgttggccccaggagcatccctcggggccgaatgcgcagtggacgatgccccttctgacccaacagatccaagacgaggatgatcagtacagccttgtggccagccttgacaacgttaggaatctctccactatcttgaaagctattcatttccgagaacatgccacgtgtttcgcaactaaaaatggtatcaaagtaacagtggaaaatgcaaagtgtgtgcaagcaaatgcttttattcaggggactttaactgcacttcgaatgtgttaccaaggttatggttaccctttgatgctgttcctggaagaaggaggagtggtgacagtctgcaaaatcaatacacaggaacctgaggagaccctggactttgatttctgcagcaccaatgttattaataaaattattctgcagtcagaggggctccgtgaagcattttctgaattggatatgacgagtgaagtcctacaaattaccatgtctcctgacaagccttatttcaggttatctacttttggaaatgcaggaagttcccaccttgactatcccaaagattctgatttgatggaagcatttcattgtaatcagacccaagtcaacagatacaagatttccttactgaaaccctctacaaaggcattagtcctatcttgtaaggtatctattcggacagataacagaggcttcctttcattacagtatatgattagaaatgaagatggacaaatatgttttgtggaatattactgctgccctgatgaagaagttcctgaatctgagtcttgagtatgacaattcactgatatttatgtgtacatttatgatagatgaagttcttattctgagtacagtactctttgtcatttcatattggattttctatagagaagaagcacaatggggaagataggagcaaggtcatgtaccctaatagttactatgttttgtaaatccattttgtagagggcatgtaaataaatgttttcctgtagtcatagatt

SEQ ID NO: 3450 - DNA, 2135 bp, Homo sapiens
caagtgaattcatggtattttacttttttgggaaatactggaaatgaagacctgcaactgtaatttgaaataaggaaaactttaattttcagtataaaaattgctcaaatagaattgcctgattttaatgacaaaagtatatgggagtccacatttatgtaagaaatgaaactataaaatgtataaataatttgcaaatcagaattgctgtcgaaagttttactataatgaaagatattttcatactctcaaaaatatagaggaaaggggccaagattatagtaccagtcacaatcttttgatgaggacgaaatgaatcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactgaatcaagcttccatatgtttccctatcagtctcagatagcagttttcaaagagtttctactaagagcgacaaagtataacaagttacaaatgcttggagatgatctgagaactgataagaagataattctggttgaagatttacctaaccagttttatcgggattctcatactttacatgaagttctaaggaagtatgtgaggattggtcgatgtcctcttatatttataatctcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgcctccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagca

SEQ ID NO: 3451 - DNA, 3164 bp, Homo sapiens
acctgtataccttttgaaacgtcacagtctctaatcgtgaacgatttggggcggagggctgaacaatgtgttttctagtgtgtcgaggtgtttataggctatgtgtgcctccaaactgtaaagtagtccagtatactttccaatgtataagtttgtagaccttaaacttttcttctggctaacttaaaatcgttgaattcactagtttgcataaacatttaagaatttgaaaacacggttgaaaaacagtgttaccaagaaattttgtaataacatgttcaaatgaagacaaaaattttacagtttaagacttaaattcttcgtccacagcaagtgaattcatggtattttacttttttgggaaatactggaaatgaagacctgcaactgtaatttgaaataaggaaaactttaattttcagtataaaaattgctcaaatagaattgcctgattttaatgacaaaagtatatgggagtccacatttatgtaagaaatgaaactataaaatgtataaataatttgcaaatcagaattgctgtcgaaagttttactataatgaaagatattttcatactctcaaaaatatagaggaaaggggccaagattatagtaccagtcacaatcttttgatgaggacgaaatgaatcaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtggataaatataaaccagaaactcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactgaatcaagcttccatatgtttccctatcagtctcagatagcagttttcaaagagtttctactaagagcgacaaagtataacaagttacaaatgcttggagatgatctgagaactgataagaagataattctggttgaagatttacctaaccagttttatcgggattctcatactttacatgaagttctaaggaagtatgtgaggattggtcgatgtcctcttatatttataatctcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgcctccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagcagagttaatatgcttttctgatgaattacacaacagtttgttaattcttcattcttgtagtatttcatcacaagaaacctactcttctgtcatcttgaagtaaatagaagatcaagccttcaaatctcttaattttttcggtatttattaaatctgtgagtggtttaaggagcggtcagtgtgtataaagtgtgtttgaacattatgccaaatatcaagatgtgaaggactaattcaggatgcaaaaacgttattggggggttgtaaatatcaactattcaacagtttaggatgcaattacgagtgtaaactgtgtgccttatttacactttattgtctcccgcttctcagatagttttgatgtgttgtacagtggaatatcttagatactttttggaaagtatttacataagttatatcacaattaaaatgttgaatttaa

SEQ ID NO: 3452 - DNA, 2789 bp, Homo sapiens
agcccgggtagggccaggtggctgccctttcacctagggtagtccctggtcgcctccgctcttcgcctaaaaggggatgcagctccgggaaatatatgggagtccacatttatgtaagaaatgaaactataaaatgtataaataatttgcaaatcagaattgctgtcgaaagttttactataatgaaagatattttcatactctcaaaaatatagaggaaaggggccaagattatagtaccagtcacaatcttttgatgaggacgaaatgaatcaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtggataaatataaaccagaaactcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactgaatcaagcttccatatgtttccctatcagtctcagatagcagttttcaaagagtttctactaagagcgacaaagtataacaagttacaaatgcttggagatgatctgagaactgataagaagataattctggttgaagatttacctaaccagttttatcgggattctcatactttacatgaagttctaaggaagtatgtgaggattggtcgatgtcctcttatatttataatctcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgcctccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagcagagttaatatgcttttctgatgaattacacaacagtttgttaattcttcattcttgtagtatttcatcacaagaaacctactcttctgtcatcttgaagtaaatagaagatcaagccttcaaatctcttaattttttcggtatttattaaatctgtgagtggtttaaggagcggtcagtgtgtataaagtgtgtttgaacattatgccaaatatcaagatgtgaaggactaattcaggatgcaaaaacgttattggggggttgtaaatatcaactattcaacagtttaggatgcaattacgagtgtaaactgtgtgccttatttacactttattgtctcccgcttctcagatagttttgatgtgttgtacagtggaatatcttagatactttttggaaagtatttacataagttatatcacaattaaaatgttgaatttaa

SEQ ID NO: 3453 - DNA, 2943 bp, Homo sapiens
cgagaggctcggcgttgagcccgggtagggccaggtggctgccctttcacctagggtagtccctggtcgcctccgctcttcgcctaaaaggggatgcagctccgggaaacaagtgaattcatggtattttacttttttgggaaatactggaaatgaagacctgcaactgtaatttgaaataaggaaaactttaattttcagtataaaaattgctcaaatagaattgcctgattttaatgacaaaagtatatgggagtccacatttatgtaagaaatgaaactataaaatgtataaataatttgcaaatcagaattgctgtcgaaagttttactataatgaaagatattttcatactctcaaaaatatagaggaaaggggccaagattatagtaccagtcacaatcttttgatgaggacgaaatgaatcaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtggataaatataaaccagaaactcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactgaatcaagcttccatatgtttccctatcagtctcagatagcagttttcaaagagtttctactaagagcgacaaagtataacaagttacaaatgcttggagatgatctgagaactgataagaagataattctggttgaagatttacctaaccagttttatcgggattctcatactttacatgaagttctaaggaagtatgtgaggattggtcgatgtcctcttatatttataatctcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgcctccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagcagagttaatatgcttttctgatgaattacacaacagtttgttaattcttcattcttgtagtatttcatcacaagaaacctactcttctgtcatcttgaagtaaatagaagatcaagccttcaaatctcttaattttttcggtatttattaaatctgtgagtggtttaaggagcggtcagtgtgtataaagtgtgtttgaacattatgccaaatatcaagatgtgaaggactaattcaggatgcaaaaacgttattggggggttgtaaatatcaactattcaacagtttaggatgcaattacgagtgtaaactgtgtgccttatttacactttattgtctcccgcttctcagatagttttgatgtgttgtacagtggaatatcttagatactttttggaaagtatttacataagttatatcacaattaaaatgttgaatttaa

SEQ ID NO: 3454 - DNA, 3060 bp, Homo sapiens
gaggccgtacctccgagaggctcggcgttgagcccgggtagggccaggtggctgccctttcacctagggtagtccctggtcgcctccgctcttcgcctaaaaggggatgcagctccgggaaacaagtgaattcatggtattttacttttttgggaaatactggaaatgaagacctgcaactgtaatttgaaataaggaaaactttaattttcagtataaaaattgctcaaatagaattgcctgattttaatgacaaaaggtgaattatagtttaatgtactgcaagtcctaaactacggatgggaactattacagtttataatgtcaaaaacttttcttagaccaaaggtatcttccacaaagtatatgggagtccacatttatgtaagaaatgaaactataaaatgtataaataatttgcaaatcagaattgctgtcgaaagttttactataatgaaagatattttcatactctcaaaaatatagaggaaaggggccaagattatagtaccagtcacaatcttttgatgaggacgaaatgaatcaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtggataaatataaaccagaaactcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactgaatcaagcttccatatgtttccctatcagtctcagatagcagttttcaaagagtttctactaagagcgacaaagtataacaagttacaaatgcttggagatgatctgagaactgataagaagataattctggttgaagatttacctaaccagttttatcgggattctcatactttacatgaagttctaaggaagtatgtgaggattggtcgatgtcctcttatatttataatctcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgcctccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagcagagttaatatgcttttctgatgaattacacaacagtttgttaattcttcattcttgtagtatttcatcacaagaaacctactcttctgtcatcttgaagtaaatagaagatcaagccttcaaatctcttaattttttcggtatttattaaatctgtgagtggtttaaggagcggtcagtgtgtataaagtgtgtttgaacattatgccaaatatcaagatgtgaaggactaattcaggatgcaaaaacgttattggggggttgtaaatatcaactattcaacagtttaggatgcaattacgagtgtaaactgtgtgccttatttacactttattgtctcccgcttctcagatagttttgatgtgttgtacagtggaatatcttagatactttttggaaagtatttacataagttatatcacaattaaaatgttgaatttaa

SEQ ID NO: 3455 - DNA, 2648 bp, Homo sapiens
caagtgaattcatggtattttacttttttgggaaatactggaaatgaagacctgcaactgtaatttgaaataaggaaaactttaattttcagtataaaaattgctcaaatagaattgcctgattttaatgacaaaaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtggataaatataaaccagaaactcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactgaatcaagcttccatatgtttccctatcagtctcagatagcagttttcaaagagtttctactaagagcgacaaagtataacaagttacaaatgcttggagatgatctgagaactgataagaagataattctggttgaagatttacctaaccagttttatcgggattctcatactttacatgaagttctaaggaagtatgtgaggattggtcgatgtcctcttatatttataatctcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgcctccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagcagagttaatatgcttttctgatgaattacacaacagtttgttaattcttcattcttgtagtatttcatcacaagaaacctactcttctgtcatcttgaagtaaatagaagatcaagccttcaaatctcttaattttttcggtatttattaaatctgtgagtggtttaaggagcggtcagtgtgtataaagtgtgtttgaacattatgccaaatatcaagatgtgaaggactaattcaggatgcaaaaacgttattggggggttgtaaatatcaactattcaacagtttaggatgcaattacgagtgtaaactgtgtgccttatttacactttattgtctcccgcttctcagatagttttgatgtgttgtacagtggaatatcttagatactttttggaaagtatttacataagttatatcacaattaaaatgttgaattt

SEQ ID NO: 3456 - DNA, 3002 bp, Homo sapiens
gcaacgcccgcgagggtcggctcccggggcgctgacaaccgcctcgtggccctcggccggcctctgaagagggcagtgaggggcccccacctgggcgcccgatgcccagagcactctgcgcccccagcctgccccagcccagtccctcccggccgcgcgccctgaccgcaagtgaattcatggtattttacttttttgggaaatactggaaatgaagacctgcaactgtaatttgaaataaggaaaactttaattttcagtataaaaattgctcaaatagaattgcctgattttaatgacaaaagtatatgggagtccacatttatgtaagaaatgaaactataaaatgtataaataatttgcaaatcagaattgctgtcgaaagttttactataatgaaagatattttcatactctcaaaaatatagaggaaaggggccaagattatagtaccagtcacaatcttttgatgaggacgaaatgaatcaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtggataaatataaaccagaaactcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactgaatcaagcttccatatgtttccctatcagtctcagatagcagttttcaaagagtttctactaagagcgacaaagtataacaagttacaaatgcttggagatgatctgagaactgataagaagataattctggttgaagatttacctaaccagttttatcgggattctcatactttacatgaagttctaaggaagtatgtgaggattggtcgatgtcctcttatatttataatctcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgcctccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagcagagttaatatgcttttctgatgaattacacaacagtttgttaattcttcattcttgtagtatttcatcacaagaaacctactcttctgtcatcttgaagtaaatagaagatcaagccttcaaatctcttaattttttcggtatttattaaatctgtgagtggtttaaggagcggtcagtgtgtataaagtgtgtttgaacattatgccaaatatcaagatgtgaaggactaattcaggatgcaaaaacgttattggggggttgtaaatatcaactattcaacagtttaggatgcaattacgagtgtaaactgtgtgccttatttacactttattgtctcccgcttctcagatagttttgatgtgttgtacagtggaatatcttagatactttttggaaagtatttacataagttatatcacaattaaaatgttgaatttaa

SEQ ID NO: 3457 - DNA, 2117 bp, Homo sapiens
gtgaattatagtttaatgtactgcaagtcctaaactacggatgggaactattacagtttataatgtcaaaaacttttcttagaccaaaggtatcttccacaaaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtggataaatataaaccagaaactcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactgaatcaagcttccatatgtttccctatcagtctcagatagcagttttcaaagagtttctactaagagcgacaaagtataacaagttacaaatgcttggagatgatctgagaactgataagaagataattctggttgaagatttacctaaccagttttatcgggattctcatactttacatgaagttctaaggaagtatgtgaggattggtcgatgtcctcttatatttataatctcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgcctccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcc

SEQ ID NO: 3458 - DNA, 859 bp, Homo sapiens
ctcgcatcttcagggacagttatctgctttttaaaggagcaagtgaattcatggtattttacttttttgggaaatactggaaatgaagacctgcaactgtaatttgaaataaggaaaactttaattttcagtataaaaattgctcaaatagaattgcctgattttaatgacaaaagtatatgggagtccacatttatgtaagaaatgaaactataaaatgtataaataatttgcaaatcagaattgctgtcgaaagttttactataatgaaagatattttcatactctcaaaaatatagaggaaaggggccaagattatagtaccagtcacaatcttttgatgaggacgaaatgaatcaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtggataaatataaaccagaaactcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactg

SEQ ID NO: 3459 - DNA, 496 bp, Homo sapiens
gggtcggctcccggggcgctgacaaccgcctcgtggccctcggccggcctctgaagagggcagtgaggggcccccacctgggcgcccgatgcccagagcactctgcgcccccagcctgccccagcccagtccctcccggccgcgcgccctgaccggtgaattatagtttaatgtactgcaagtcctaaactacggatgggaactattacagtttataatgtcaaaaacttttcttagaccaaaggtatcttccacaaagtatatgggagtccacatttatgtaagaaatgaaactataaaatgtataaataatttgcaaatcagaattgctgtcgaaagttttactataatgaaagatattttcatactctcaaaaatatagaggaaaggggccaagattatagtaccagtcacaatcttttgatgaggacgaaatgaatcaggtaacagactgggttgacccatcatttgatgattttctagagtgtagtggcgt

SEQ ID NO: 3460 - DNA, 3233 bp, Homo sapiens
ccccgggaggccgtacctccgagaggctcggcgttgagcccgggtagggccaggtggctgccctttcacctagggtagtccctggtcgcctccgctcttcgcctaaaaggggatgcagctccgggaaagtaaggccgccgcggttgcggctatattatgtatatgtcttagagacgtgagtctatctctgccttcaagctttcctgggctctcgtcgctcctcctcccgacccgcccatcccatctggggatgagaagattgagggtgcagagccctgtcctgcagcggggatttgcgagctcaacccggcaccccactgattacaggattacgttggacgaatatttgagcttagtattccctgttcactgtgtggggtggtggtgggtcggctaggaatagtcttgaaggtctacctctgacatctcatttcagtaacctcgcatcttcagggacagttatctgctttttaaaggagcaagtgaattcatggtattttacttttttgggaaatactggaaatgaagacctgcaactgtaatttgaaataaggaaaactttaattttcagtataaaaattgctcaaatagaattgcctgattttaatgacaaaaggtgaattatagtttaatgtactgcaagtcctaaactacggatgggaactattacagtttataatgtcaaaaacttttcttagaccaaaggtatcttccacaaaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtggataaatataaaccagaaactcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactgaatcaagcttccatatgtttccctatcagtctcagatagcagttttcaaagagtttctactaagagcgacaaagtataacaagttacaaatgcttggagatgatctgagaactgataagaagataattctggttgaagatttacctaaccagttttatcgggattctcatactttacatgaagttctaaggaagtatgtgaggattggtcgatgtcctcttatatttataatctcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgcctccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagcagagttaatatgcttttctgatgaattacacaacagtttgttaattcttcattcttgtagtatttcatcacaagaaacctactcttctgtcatcttgaagtaaatagaagatcaagccttcaaatctcttaattttttcggtatttattaaatctgtgagtggtttaaggagcggtcagtgtgtataaagtgtgtttgaacattatgccaaatatcaagatgtgaaggactaattcaggatgcaaaaacgttattggggggttgtaaatatcaactattcaacagtttaggatgcaattacgagtgtaaactgtgtgccttatttacactttattgtctcccgcttctcagatagttttgatgtgttgtacagtggaatatcttagatactttttggaaagtatttacataagttatatcacaattaaaatgttgaatttaa

SEQ ID NO: 3461 - DNA, 2323 bp, Homo sapiens
acctccgagaggctcggcgttgagcccgggtagggccaggtggctgccctttcacctagggtagtccctggtcgcctccgctcttcgcctaaaaggggatgcagctccgggaaacaagtgaattcatggtattttacttttttgggaaatactggaaatgaagacctgcaactgtaatttgaaataaggaaaactttaattttcagtataaaaattgctcaaatagaattgcctgattttaatgacaaaaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtggataaatataaaccagaaactcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactgaatcaagcttccatatgtttccctatcagtctcagatagcagttttcaaagagtttctactaagagcgacaaagtataacaagttacaaatgcttggagatgatctgagaactgataagaagataattctggttgaagatttacctaaccagttttatcgggattctcatactttacatgaagttctaaggaagtatgtgaggattggtcgatgtcctcttatatttataatctcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgcctccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagca

SEQ ID NO: 3462 - DNA, 5886 bp, Homo sapiens
cccgcctctggcgcgtcgcgggctgctgacgtaatgcggtagcgcggggaatttcgagtggtgttggagcgccggaggctagtgggtggctgacccccagcatcctcgggagcgaccatggactccctggccgagtctcggtggcctccgggcctggcagtcatgaagacaatagatgatttgctgcggtgtggaatttgcttcgagtatttcaacattgcaatgataatacctcagtgttcacataactactgctctctctgtataagaaaatttctgtcctataaaactcagtgtccaacttgctgtgtgactgtcacagagccggatctgaaaaataaccgcatattagatgaactggtaaaaagcttgaattttgcacggaatcatctgctgcagtttgctttagagtcaccagccaaatctcctgcttcttcctcttcaaagaatcttgctgtcaaagtatatactcctgtagcctccagacagtctttaaagcaggggagcaggttaatggataatttcttgatcagagaaatgagtggttctacatcagagttgttgataaaagaaaataaaagcaaattcagccctcaaaaagaggcgagccctgctgcaaagaccaaagagacacgttctgtagaagagatcgctccagatccctcagaggctaagcgtcctgagccaccctcgacatccactttgaaacaagttactaaagtggattgtcctgtttgcggggttaacattccagaaagtcacattaataagcatttagacagctgtttatcacgcgaagagaagaaggaaagcctcagaagttctgttcacaaaaggaagccgctgcccaaaactgtatataatttgctctctgatcgtgatttaaagaaaaagctaaaagagcatggattatctattcaaggaaataaacaacagctcattaaaaggcaccaagaatttgtacacatgtacaatgcccaatgcgatgctttgcatcctaaatcagctgctgaaatagttcgagaaatcgaaaatatagagaagactaggatgcgtcttgaagctagtaaactcaatgaaagtgtaatggtttttacaaaggaccaaacagaaaaggaaatagatgaaatccacagtaaatatcgtaaaaaacataagagtgaatttcagcttctggtggatcaggctagaaaaggatacaagaaaattgctggaatgtcacaaaaaacagtaacaataacaaaagaagatgaatctacagaaaagctatcttctgtatgcatgggacaggaagataatatgacctcagtaacaaaccacttttctcaatcaaagctggactccccagaggaattggaacctgacagagaagaggattcttctagctgtattgatattcaagaagttctttcttcatcagaatcagattcatgcaatagttccagttcagacatcataagagatcttttagaagaagaggaagcctgggaagcatcacataaaaacgatcttcaagacacagaaataagtccaagacagaatcgccgcacaagagccgctgaaagtgctgagattgaaccaagaaacaagcgtaataggaattaatgtgggcttttgctgacttttcaaatgcattgattagaataccgtacttttggttgccacagatagattttctatttataaatgcccaaggaaagatgctaaattctaaatattacggttagctgatattcattcttttctgcttttccagaggggaaaaatgttacaaaatatccttacttggtcagttgcctcctgcctctaaaacatctctctctaaaaatactgacatttcacacaggtaccagctttgcagaggaggtagactctttggcactttggcacagggatttggtttggtttggtttggtttgataattaaatttcagaatgtccttaggccattctccttctcttccatggagaatccagcctcacaaaaggattctttcaacttctttattgcaagaaacagttgagttaaatgtttgtttttggaaaggcgggatgtcagttcacatccttggtgtgtgtaagtaccgatgcacgccaccaccatgcctgtgttacagcagctccatgatggttgttgcccgaggttaatgtagttgtttgttagacctgtgtcttacacatttctcagagtaggatattagtattataatttaaagctacgacagtcacaaagtcacaataacttagaaacattgcgcatattcttctgaaatagcacttaaaaatgattagtgtcagtattttttcacttgggtcaatcaaatctgtaacactgaatccaagctattaaacaaaaagtatgcaatgaatgaattttgtaaatgaatagagagtatcagtttacaataatgttcttaaaacagtatcctctggatagttgagtatgggttagaaatcattgaaatggattggtcagaaattgctatctgtgtaaaatgtctaccagtagccagatgcttccagagttcttaatgcctctctggcatttcagagccagcatcccccaactcccacccctctgccatcacccaacccaaacacatcagctttcaaatgagatgatagtaaatgcggcaatgttaagacaagaaatttatgatttgccagattcaacatttatgacctccccttccaaagactgtctccgttgaccttgtctttttggtatgccttggggtttctgataatgtgtggagtctcattatggctgagagtttagtgttttcacagtgaagtgcagacatttgatttctttatgagttccctgtgttagaaatggctatagaaaaatttgtcataataatttcatttgcatgaaatcctgaggggtgcattaaggaaactaaaagcaccacttaccaaatctatcggcagaactgatgtgaggtaagtgagcatgtcaaacaaaataggagctcacatggatatatttatgtcactgagttgtcagaaattatgtcaaaatgaaaactgtttgtttcatgacaaattatatagtctataaattaaactggaagtaattattactttaattgcagcaaaaggagtttgtgagggagcggtgagacccaagattgggaaagtaggcacatgagttcattcagcaaatatttggttatctatgtctgtcactgtgctgacactgggaatacaaaggtggccaaagatcatctagaacaatggttcccagtggggtgggcagaaagattttgccccccaggagacagctggcaatgtgtggagacacttttggaggtggagggtggtgaggggtactaccagtatcaatgggtggaggccagggatgaggctaaacacccaaccctcatggattagtttgccagggctgccgtcacaagatactgcagacggggaagcttacacaacagaaatgtgtattctcagaattctggaggctggaagtccaagatcagtagggtttcttcttcggcctctctccttggcttccactcatggtgtccttgcatggtcttttctctgtgtgcacatgactgtgcaggactggtgtcccgatttcttgtagggacagcagtcattggatcagggcccatgcgtatggcctcattttacttcagttacctcttttttagatagagggccctatctctaaatactgtcacattctgagataccggcagttaagacttccaacatatttagtggtaggggttaaggggcacgctttagactacaacactccacagtaaagaattatccagtctaacatgtcagttgtgccaagactgagaaacctgtaatgtaaaggaactcccaagtctacctgaaaagtaaggtctaaagagcatttattgagcactatctgttagcacttagcatatgtttaatattcatacattgaaagaaatgtatgttcatatccatctgacaaagattaaggaacttagagtaagtaatagatccaaaattgaaactgataaacttctggttctaaaattcaccttttagtgaaaatacagtttctcaccaaacttacagtaattcagagttattaactctttctacctcctcactcccctcaaagttataacatctcccatcaacatcagctcagaatggcagtgatgcttatggtttgtgggggtgcaggtgagctgctggatgcactttagatggcctagtatgccaggccgtcctttcatcctctactctcgtctttctttttcgacctcatgttgaggattactggtctagttgaaaaaagaattcatacacataagaccatgtatataatagagggaggtatgcctttaaaaacaaaattacatggtaaagactgatgtgtcaacagggatagacaacatagagaaggctagaactgtttctggaaaaaaacccaaaaacaatggatttcaaacttcttagcatccgataaaagaaagtagcaattattcaaatgagaaacacttctgtctgttatgtacatattatgaaagtatgaacataagagggaaaaccacaaccattacattttttaccatttcagtaatttttttttggtttttagtctgtttttagacatccttaagaacaactatctgaggctgtaaacaagtatttacattaacacccatgatactgactttatactccctacctgcattgagaccttaaagggggcatttctccattccttctgtgtatttctgggtatccccaggttcagatattcagaatacagatacaagtccatgcttgcatatgttgctgctccccccgacagacttctaccagcatctgccctcctcaccgctgctctgtcacgtgcactgcggctggccctgctggaaagtcctaccttgcctaggacgccatccccgatatagccccaagatgcaaacctgccaagtgctagggcagccctgccttcctgtccatttcagtctcttggccttgctgtgttccaagtggaaatgggagtgtgctttcctggtttgctagtgtactatcacccggaccacagcgtcctgtgcaaaaatttgcttcctctctcttcccctttcactctttctcttttctcttccccacccccttttttttctctttccccttacctttctttcctttccactcttcctgtccttccttccttcaactattaggactatatgtcaagtaatgtgcaaaacaaagacagttcctgccctgatggagcttgtagatcagaagggaagatgagcattaagtaattatatagattaatgtacaactgtgatgagtgcaacaaaagagaggttcatggcactatcaaacatgcaatggacggattttgtttttgcctataaactcttgccatagaaagcttgaaaatcagtccagggggacagcattaatcaccatgttctttccttatccctgtcttccccaaaattcatgtgttgaaacttaacaagaggtgggaactttaggatgtgattaagtcgtgagggcacagctcttatagatggggtcacggtccttctaaaagggcttgagggagtggttttgtttccttccatcccttccgccacatgaggacacagtcttcgttccctctggaggactcagcaacaacacaccatcttggaagcagagagcagtcctcaccagacacggaatctgccagtgccttgatcttggacttaccagcctccatacctgtgagaaataaatttctattgtctataagttacccagactgtggtattttcttctggcagcacaaatggacacccagaaactgatgcatgcatcttctgactcctttgattccaaaatacaaaatattagaataaagttatggaagtc

SEQ ID NO: 3463 - DNA, 581 bp, Homo sapiens
taaaaacttctgttcagagcaaggacggatagtcactgcgattagggtgggcgacccggaggggggtcatgagcctggaccttgacagatctggtgaggtaagtgcggcagaagcctggcgcatgcgcagtacaagcccttaagcggcgccccgcccacatactactacaacttccggcaggctccgcgcccgcctctggcgcgtcgcgggctgctgacgtaatgcggtagcgcggggaatttcgagtggtgttggagcgccggaggctagtgggtggctgacccccagcatcctcgggagcgaccatggactccctggccgagtctcggtggcctccgggcctggcagtcatgaagacaatagatgatttgctgcggtgtggaatttgcttcgagtatttcaacattgcaatgataatacctcagtgttcacataactactgctctctctgtataagaaaatttctgtcctataaaactcagtgtccaacttgctgtgtgactgtcacagagccggatctgaaaaataaccgcatattagatgaactggtaaaaagcttgaattttgcacggaatcatct

SEQ ID NO: 3464 - DNA, 1786 bp, Homo sapiens
ccggaagtggtcggcgcgcggcgcggcgcgcctgggcgctaagatggcggcggcgtgagttgcatgttgtgtgaggatcccggggccgccgcgtcgctcgggccccgccatggccgtcaccatcacgctcaaaacgctgcagcagcagaccttcaagatccgcatggagcctgacgagacggtgaaggtgctaaaggagaagatagaagctgagaagggtcgtgatgccttccccgtggctggacagaaactcatctatgccggcaagatcttgagtgacgatgtccctatcagggactatcgcatcgatgagaagaactttgtggtcgtcatggtgaccaagaccaaagccggccagggtacctcagcacccccagaggcctcacccacagctgccccagagtcctctacatccttcccgcctgcccccacctcaggcatgtcccatcccccacctgccgccagagaggacaagagcccatcagaggaatccgcccccacgacgtccccagagtctgtgtcaggctctgttccctcttcaggtagcagcgggcgagaggaagacgcggcctccacgctagtgacgggctctgagtatgagacgatgctgacggagatcatgtccatgggctatgagcgagagcgggtcgtggccgccctgagagccagctacaacaacccccaccgagccgtggagtatctgctcacgggaattcctgggagccccgagccggaacacggttctgtccaggagagccaggtatcggagcagccggccacggaagcagcaggagagaaccccctggagttcctgcgggaccagccccagttccagaacatgcggcaggtgattcagcagaaccctgcgctgctgcccgccctgctccagcagctgggccaggagaaccctcagcttttacagcaaatcagccggcaccaggagcagttcatccagatgctgaacgagccccctggggagctggcggacatctcagatgtggagggggaggtgggcgccataggagaggaggccccgcagatgaactacatccaggtgacgccgcaggagaaagaagctatagagaggttgaaggccctgggcttcccagagagcctggtcatccaggcctatttcgcgtgtgaaaaaaatgagaacttggctgccaacttcctcctgagtcagaactttgatgacgagtgatgccaggaagccaggccaccgaagcccccaccctacccttattccatgaaagttttataaaagaaaaaatatatatatattcatgtttatttaagaaatggaaaaaaaaatcaaaaatcttaaaaaaacaagcaaacagtccagcttcctgtcctcctaaagtggcccctgttcccatctcccgggccagacagctgtccccccgtcctcctccccagcccagcctgctcagagaagctggcaggactgggaggcgacagatgggcccctcttggcctctgtcccagctctctgcagccagacggaaaggcggctgcttgcctctccatcctccgaaaaacccctgaggacccccccccatcctcttctaggatgaggggaagctggagccccaactttgatcctccattggagtggcccaaatctttccatctagggcaagtcctgaaaggcccaaggccccctccccagtctggccttggcctccagcctggagaagggctaacatcagctcattgtcaaggccacccccaccccagaacagaaccgtgtctctgataaaggttttgaagtgaataaagtttt

SEQ ID NO: 3465 - DNA, 1350 bp, Homo sapiens
gcgcggcgcggcgcgcctgggcgctaagatggcggcggcgtgagttgcatgttgtgtgaggatcccggggccgccgcgtcgctcgggccccgccatggccgtcaccatcacgctcaaaacgctgcagcagcagaccttcaagatccgcatggagcctgacgagacggtgaaggtgctaaaggagaagatagaagctgagaagggtcgtgatgccttccccgtggctggacagaaactcatctatgccggcaagatcttgagtgacgatgtccctatcagggactatcgcatcgatgagaagaactttgtggtcgtcatggtgaccaagaccaaagccggccagggtacctcagcacccccagaggcctcacccacagctgccccagagtcctctacatccttcccgcctgcccccacctcaggcatgtcccatcccccacctgccgccagagaggacaagagcccatcagaggaatccgcccccacgacgtccccagagtctgtgtcaggtgacgggctctgagtatgagacgatgctgacggagatcatgtccatgggctatgagcgagagcgggtcgtggccgccctgagagccagctacaacaacccccaccgagccgtggagtatctgctcacgggaattcctgggagccccgagccggaacacggttctgtccaggagagccaggtatcggagcagccggccacggaagcagcaggagagaaccccctggagttcctgcgggaccagccccagttccagaacatgcggcaggtgattcagcagaaccctgcgctgctgcccgccctgctccagcagctgggccaggagaaccctcagcttttacagcaaatcagccggcaccaggagcagttcatccagatgctgaacgagccccctggggagctggcggacatctcagatgtggagggggaggtgggcgccataggagaggaggccccgcagatgaactacatccaggtgacgccgcaggagaaagaagctatagagaggttgaaggccctgggcttcccagagagcctggtcatccaggcctatttcgcgtgtgaaaaaaatgagaacttggctgccaacttcctcctgagtcagaactttgatgacgagtgatgccaggaagccaggccaccgaagcccccaccctacccttattccatgaaagttttataaaagaaaaaatatatatatattcatgtttatttaagaaatggaaaaaaaaatcaaaaatcttaaaaaaacaagcaaacagtccagcttcctgtcctcctaaagtggcccctgttcccatctcccgggccagacagctgtccccccgtcctcctccccagcc

SEQ ID NO: 3466 - DNA, 1746 bp, Homo sapiens
ggcggcgtgagttgcatgttgtgtgaggatcccggggccgccgcgtcgctcgggccccgccatggccgtcaccatcacgctcaaaacgctgcagcagcagaccttcaagatccgcatggagcctgacgagacggtgaaggtgctaaaggagaagatagaagctgagaagggtcgtgatgccttccccgtggctggacagaaactcatctatgccggcaagatcttgagtgacgatgtccctatcagggactatcgcatcgatgagaagaactttgtggtcgtcatggtgaccaagaccaaagccggccagggtacctcagcacccccagaggcctcacccacagctgccccagagtcctctacatccttcccgcctgcccccacctcaggcatgtcccatcccccacctgccgccagagaggacaagagcccatcagaggaatccgcccccacgacgtccccagagtctgtgtcaggctctgttccctcttcaggtagcagcgggcgagaggaagacgcggcctccacgctagtgacgggctctgagtatgagacgatgctgacggagatcatgtccatgggctatgagcgagagcgggtcgtggccgccctgagagccagctacaacaacccccaccgagccgtggagtatctgctcacgggaattcctgggagccccgagccggaacacggttctgtccaggagagccaggtatcggagcagccggccacggaagcagcaggagagaaccccctggagttcctgcgggaccagccccagttccagaacatgcggcaggtgattcagcagaaccctgcgctgctgcccgccctgctccagcagctgggccaggagaaccctcagcttttacagcaaatcagccggcaccaggagcagttcatccagatgctgaacgagccccctggggagctggcggacatctcagatgtggagggggaggtgggcgccataggagaggaggccccgcagatgaactacatccaggtgacgccgcaggagaaagaagctatagagaggttgaaggccctgggcttcccagagagcctggtcatccaggcctatttcgcgtgtgaaaaaaatgagaacttggctgccaacttcctcctgagtcagaactttgatgacgagtgatgccaggaagccaggccaccgaagcccccaccctacccttattccatgaaagttttataaaagaaaaaatatatatatattcatgtttatttaagaaatggaaaaaaaaatcaaaaatcttaaaaaaacaagcaaacagtccagcttcctgtcctcctaaagtggcccctgttcccatctcccgggccagacagctgtccccccgtcctcctccccagcccagcctgctcagagaagctggcaggactgggaggcgacagatgggcccctcttggcctctgtcccagctctctgcagccagacggaaaggcggctgcttgcctctccatcctccgaaaaacccctgaggacccccccccatcctcttctaggatgaggggaagctggagccccaactttgatcctccattggagtggcccaaatctttccatctagggcaagtcctgaaaggcccaaggccccctccccagtctggccttggcctccagcctggagaagggctaacatcagctcattgtcaaggccacccccaccccagaacagaaccgtgtctctgataaaggttttgaagtgaataaagttttaaaaacta

SEQ ID NO: 3467 - DNA, 1526 bp, Homo sapiens
gcgtgagttgcatgttgtgtgaggatcccggggccgccgcgtcgctcgggccccgccatggccgtcaccatcacgctcaaaacgctgcagcagcagaccttcaagatccgcatggagcctgacgagacggtgaaggtgctaaaggagaagatagaagctgagaagggtcgtgatgccttccccgtggctggacagaaactcatctatgccggcaagatcttgagtgacgatgtccctatcagggactatcgcatcgatgagaagaactttgtggtcgtcatggtgaccaagaccaaagccggccagggtacctcagcacccccagaggcctcacccacagctgccccagagtcctctacatccttcccgcctgcccccacctcaggcatgtcccatcccccacctgccgccagagaggacaagagcccatcagaggaatccgcccccacgacgtccccagagtctgtgtcaggctctgttccctcttcaggtagcagcgggcgagaggaagacgcggcctccacgctagtgacgggctctgagtatgagacgatgctgacggagatcatgtccatgggctatgagcgagagcgggtcgtggccgccctgagagccagctacaacaacccccaccgagccgtggagtatctgctcacgggaattcctgggagccccgagccggaacacggttctgtccaggagagccaggtatcggagcagccggccacggaagcagcaggagagaaccccctggagttcctgcgggaccagccccagttccagaacatgcggcaggtgattcagcagaaccctgcgctgctgcccgccctgctccagcagctgggccaggagaaccctcagcttttacagttgaaggccctgggcttcccagagagcctggtcatccaggcctatttcgcgtgtgaaaaaaatgagaacttggctgccaacttcctcctgagtcagaactttgatgacgagtgatgccaggaagccaggccaccgaagcccccaccctacccttattccatgaaagttttataaaagaaaaaatatatatatattcatgtttatttaagaaatggaaaaaaaaatcaaaaatcttaaaaaaacaagcaaacagtccagcttcctgtcctcctaaagtggcccctgttcccatctcccgggccagacagctgtccccccgtcctcctccccagcccagcctgctcagagaagctggcaggactgggaggcgacagatgggcccctcttggcctctgtcccagctctctgcagccagacggaaaggcggctgcttgcctctccatcctccgaaaaacccctgaggacccccccccatcctcttctaggatgaggggaagctggagccccaactttgatcctccattggagtggcccaaatctttccatctagggcaagtcctgaaaggcccaaggccccctccccagtctggccttggcctccagcctggagaagggctaacatcagctcattgtcaaggccacccccaccccagaac

SEQ ID NO: 3468 - DNA, 4119 bp, Homo sapiens
gagtcacgatgatggcggccaccatcctgtggtgagctagcggattccctgcttgtctcgccgaccccctcgcgccttctgcagactccgtggctggcgctcggcgcgtgaggaagcacggcggcccgagttcgcggggaaggccgcagtcgcggaggcagcggcgcggtccggggcacgggctgggggagaggccgctccgctgggcgaatgtgacaagcccccacccccaccgccttcctccccagagcgcgaggagcgcgggcgaccccggggccccgccaggccacagaccccgcccagcggccagcacccggcgcaggcccggcagccgagctgcgcggcggcaccatgcaggtcaccctgaagaccctccagcagcagaccttcaagatagacattgaccccgaggagacggtgaaagcactgaaagagaagattgaatctgaaaaggggaaagatgcctttccagtagcaggtcaaaaattaatttatgcaggcaaaatcctcaatgatgatactgctctcaaagaatataaaattgatgagaaaaactttgtggtggttatggtgaccaaacccaaagcagtgtccacaccagcaccagctacaactcagcagtcagctcctgccagcactacagcagttacttcctccaccaccacaactgtggctcaggctccaacccctgtccctgccttggcccccacttccacacctgcatccatcactccagcatcagcgacagcatcttctgaacctgcacctgctagtgcagctaaacaagagaagcctgcagaaaagccagcagagacaccagtggctactagcccaacagcaactgacagtacatcgggtgattcttctcggtcaaacctttttgaagatgcaacgagtgcacttgtgacgggtcagtcttacgagaatatggtaactgagatcatgtcaatgggctatgaacgagagcaagtaattgcagccctgagagccagtttcaacaaccctgacagagcagtggagtatcttttaatgggaatccctggagatagagaaagtcaggctgtggttgacccccctcaagcagctagtactggggctcctcagtcttcagcagtggctgcagctgcagcaactacgacagcaacaactacaacaacaagttctggaggacatccccttgaatttttacggaatcagcctcagtttcaacagatgagacaaattattcagcagaatccttccttgcttccagcgttactacagcagataggtcgagagaatcctcaattacttcagcaaattagccaacaccaggagcattttattcagatgttaaatgaaccagttcaagaagctggtggtcaaggaggaggaggtggaggtggcagtggaggaattgcagaagctggaagtggtcatatgaactacattcaagtaacacctcaggaaaaagaagctatagaaaggttaaaggcattaggatttcctgaaggacttgtgatacaagcgtattttgcttgtgagaagaatgagaatttggctgccaattttcttctacagcagaactttgatgaagattgaaagggacttttttatatctcacacttcacaccagtgcattacactaacttgttcactggattgtctgggatgacttgggctcatatccacaatacttggtataaggtagtagattgttgggggtggggagggagggatctaggatacagggcagggataaatacagtgcatgtctgcttcaattagcagatgccgcaactccacacagtgtgtaaaatatatacaaccaaaaatcagcttttgcaggtctttatttcttctgtaaaacagtaggtaacttttcctaggtttcactctttttagtgtactagatccagaaacttagtgtaatgccctgctttatatttctttgacttaacattggtttcagaaagaatcttagctacctagaatttacagtctctgtttcatggcaacactggataatggctttgtgaaatttaaaaaatttttgtagcgactgtaaacagaaatgccaaattgatggttaattgttgctgcttcaaaaataagtataaaattaatatgtaaggaagcccattctttcatgttaaatacttggggtgggaggggagaaagggaaccttttcttaaaatgaaaataattactgctattttaaaatttcttgatcattgaatgtgagacccttctaacatgatttgagaagctgtacaagtataggcagagttattttcctgtttacattttttttttgttttggggaaaaaattggtaggtgtctaattactgtttacttcattgttatattgcagtaaaagttttaaaacaaccattgcatgtttgcttttgatgtatccctttgtgaaattagcacttttggggccaatggagaaatgcagcattcactctccctgtcttttccccttccctcagcagaaacgtgtttatcagcaagtcgtgagtcaaactgctgccttttaaaaaacccacaaaatgctgattcagttcaaaattaatgcaaatgtttcaaaactgggtttctgatatttgtaaatgtgtttctttattagataagagtgtattaccattaaagtcattagtataatattgctttcaaaaagaaatggtagacaaaactataatccagcatcttttattgcattggaaagactggcaaagtcttttggatgggttgggagatgtggctggaaagtactttggaaaatatacaatcaagatatctcatggcatattaaaagaaaaatcttaatagcagtgttggcttttatttggattttttcatctcagttttttctgtggaatctccttcattggcattgttatttaatcataaacggggcagatgtctacttgttcagtttttcaaatctgttttcctgagtataaataagagtatttaaagaaataatttggattgcttttgttttttgtttccttttttttaaccatctgatactaagaagatgaatttgcacagatttctctgcataatttctcaatatctttagcacagtatggtgatgatgacttttaagcatttacatcacgtactcataacctattatgaaaataaatgaaactggctgggtatggtggctcatgcctataatcccagcactttgggaggccgaggtgggcagatcacttgaggccaggagattgagaccagcctgaccgtcatggcgaaaccccgtctatactaaaaatacaaaaaatagccaggcatggtggcgcacgcctgtggtcccagctacttgggaggctgaggcatgagaattgcttgaacccgggaagtgaaggttgccgtgagctgagatcacaccactgccataaacatgacaggcttttggactttgtattacctgtatgttttataatggatcatgcataatttctcaggagaataaaatgagaattcatatatacgttcatctttcaagtcagagcaatgagttgggaaaagaggtggcatttctgatcggataatggaatactctcatttattttatgacattctctgtctactcagatcatagtgaaaactggaaacaaaaaaaaaaaacagcctcttcttggaaagtgacagcagaaggtggcatggagcttgtgtccttggacaacaaatctggatatactaggattaattatcagaagacagctcaggccaagttttgatcgttccatacagtaccttgtttatctgcttcttaaagaatcagccgagacaccataaaagaaataggctttttgtgccttttgctgttaatgtttaatttacaaactgttttggtaaatctcttaatgtaagtagctatttgactttggaattttgcattcgaggtatactgtcatttcttgaaatctttttctcgtttagttgctctgtgggaaatgtgaggaagcctaagtttgtatttgtaaatttcttatgccatcctctagtcaaattttttttcattgtttaaaaatacggaagtgttccaatataattttttcctgtactggatggctaggattctagagaattgattataaaatattttcaatacatccaa

SEQ ID NO: 3469 - DNA, 1049 bp, Homo sapiens
tagcggattccctgcttgtctcgccgaccccctcgcgccttctgcagactccgtggctggcgctcggcgcgtgaggaagcacggcggcccgagttcgcggggaaggccgcagtcgcggaggcagcggcgcggtccggggcacgggctgggggagaggccgctccgctgggcgaatgtgacaagcccccacccccaccgccttcctccccagagcgcgaggagcgcgggcgaccccggggccccgccaggccacagaccccgcccagcggccagcacccggcgcaggcccggcagccgagctgcgcggcggcaccatgcaggtcaccctgaagaccctccagcagcagaccttcaagatagacattgaccccgaggagacggtgaaagcactgaaagagaagattgaatctgaaaaggggaaagatgcctttccagtagcaggtcaaaaattaatttatgcaggcaaaatcctcaatgatgatactgctctcaaagaatataaaattgatgagaaaaactttgtggtggttatggtgaccaaacccaaagcagtgtccacaccagcaccagctacaactcagcagtcagctcctgccagcactacagcagttacttcctccaccaccacaactgtggctcaggctccaacccctgtccctgccttggcccccacttccacacctgcatccatcactccagcatcagcgacagcatcttctgaacctgcacctgctagtgcagctaaacaagagaagcctgcagaaaagccagcagagacaccagtggctactagcccaacagcaactgacagtacatcgggtgattcttctcggtcaaacctttttgaagatgcaacgagtgcacttgtgacgggtcagtcttacgagaatatggtaactgagatcatgtcaatgggctatgaacgagagcaagtaattgcagccctgagagccagtttcaacaaccctgacagagcagtggagtatcttttaatgatcatagtgaaaactggaaacaaaaaaaaaaaacagcctcttcttggaaagtga

SEQ ID NO: 3470 - DNA, 1527 bp, Homo sapiens
ggtgggggagggagacgtaggcgtcgccactacccctgtgtggacctggttagccgcttagttcccagagttggtaacccgagaagatgagccttaagaaaaaaaaaagtatcaggttccgtttgccgccgagaggtgaaagcactgaaagagaagattgaatctgaaaaggggaaagatgcctttccagtagcaggtcaaaaattaatttatgcaggcaaaatcctcaatgatgatactgctctcaaagaatataaaattgatgagaaaaactttgtggtggttatggtgaccaaacccaaagcagtgtccacaccagcaccagctacaactcagcagtcagctcctgccagcactacagcagttacttcctccaccaccacaactgtggctcaggctccaacccctgtccctgccttggcccccacttccacacctgcatccatcactccagcatcagcgacagcatcttctgaacctgcacctgctagtgcagctaaacaagagaagcctgcagaaaagccagcagagacaccagtggctactagcccaacagcaactgacagtacatcgggtgattcttctcggtcaaacctttttgaagatgcaacgagtgcacttgtgacgggtcagtcttacgagaatatggtaactgagatcatgtcaatgggctatgaacgagagcaagtaattgcagccctgagagccagtttcaacaaccctgacagagcagtggagtatcttttaatgggaatccctggagatagagaaagtcaggctgtggttgacccccctcaagcagctagtactggggctcctcagtcttcagcagtggctgcagctgcagcaactacgacagcaacaactacaacaacaagttctggaggacatccccttgaatttttacggaatcagcctcagtttcaacagatgagacaaattattcagcagaatccttccttgcttccagcgttactacagcagataggtcgagagaatcctcaattacttcagcaaattagccaacaccaggagcattttattcagatgttaaatgaaccagttcaagaagctggtggtcaaggaggaggaggtggaggtggcagtggaggaattgcagaagctggaagtggtcatatgaactacattcaagtaacacctcaggaaaaagaagctatagaaaggttaaaggcattaggatttcctgaaggacttgtgatacaagcgtattttgcttgtgagaagaatgagaatttggctgccaattttcttctacagcagaactttgatgaagattgaaagggacttttttatatctcacacttcacaccagtgcattacactaacttgttcactggattgtctgggatgacttgggctcatatccacaatacttggtataaggtagtagattgttgggggtggggagggagggatctaggatacagggcagggataaatacagtgcatgtctgcttcaattagcagatgccgcaactccacacagtgtgtaaaatatatacaacc

SEQ ID NO: 3471 - DNA, 716 bp, Homo sapiens
gccttccgccccgcccccaattctggggcggagtcctcggccgcgccggcgcaaagcgtcgccgcaccccacgcctgcgcgcttcgcccgcccggccccatccccccaggtttttcgcgtgggggagggggcacgtctcggcgagtcacgatgatggcggccaccatcctgtgagcgcgaggagcgcgggcgaccccggggccccgccaggccacagaccccgcccagcggccagcacccggcgcaggcccggcagccgagctgcgcggcggcaccatgcaggtcaccctgaagaccctccagcagcagaccttcaagatagacattgaccccgaggagacggtgaaagcactgaaagagaagattgaatctgaaaaggggaaagatgcctttccagtagcaggtcaaaaattaatttatgcaggcaaaatcctcaatgatgatactgctctcaaagaatataaaattgatgagaaaaactttgtggtggttatggtgaccaaacccaaagcagtgtccacaccagcaccagctacaactcagcagtcagctcctgccagcactacagcagttacttcctccaccaccacaactgtggctcaggctccaacccctgtccctgccttggcccccacttccacacctgcatccatcactccagcatcagcgacagcatcttctgaacctgcacctgctagtgcagctaaacaagagaa

SEQ ID NO: 3472 - DNA, 456 bp, Homo sapiens
ataatactaagtttaaaccagcagctttctgcccaactctatttttaaaagtagttgattctattttgggtggagatcaggggctttggtgttaagtagacctgagttccatttgtggttttgtaacttatttgctatgaccttgggcaaattacggttagtttcattctctgtataatagggataatacctgccttgcagagatgtgaagattagatggtgaaagcactgaaagagaagattgaatctgaaaaggggaaagatgcctttccagtagcaggtcaaaaattaatttatgcaggcaaaatcctcaatgatgatactgctctcaaagaatataaaattgatgagaaaaactttgtggtggttatggtgaccaaacccaaagcagtgtccacaccagcaccagctacaactcagcagtcagctcctgccagcactacagcagttacttcc

SEQ ID NO: 3473 - DNA, 811 bp, Homo sapiens
cgacagcatcttctgaacctgcacctgctagtgcagctaaacaagagaagcctgcagaaaagccagcagagacaccagtggctactagcccaacagcaactgacagtacatcgggtgattcttctcggtcaaacctttttgaagatgcaacgagtgcacttgtgacgggtcagtcttacgagaatatggtaactgagatcatgtcaatgggctatgaacgagagcaagtaattgcagccctgagagccagtttcaacaaccctgacagagcagtggagtatcttttaatgatcatagtgaaaactggaaacaaaaaaaaaaaacagcctcttcttggaaagtgacagcagaaggtggcatggagcttgtgtccttggacaacaaatctggatatactaggattaattatcagaagacagctcaggccaagttttgatcgttccatacagtaccttgtttatctgcttcttaaagaatcagccgagacaccataaaagaaataggctttttgtgccttttgctgttaatgtttaatttacaaactgttttggtaaatctcttaatgtaagtagctatttgactttggaattttgcattcgaggtatactgtcatttcttgaaatctttttctcgtttagttgctctgtgggaaatgtgaggaagcctaagtttgtatttgtaaatttcttatgccatcctctagtcaaattttttttcattgtttaaaaatacggaagtgttccaatataattttttcctgtactggatggctaggattctagagaattgattataaaatattttcaataca

SEQ ID NO: 3474 - DNA, 6022 bp, Homo sapiens
ccaggagagcggcgtggacgcgtgcgggcctagaggcccacgtgatccgcagggcggccgaggcaggaagctgtgagtgcgcggttgcggggtcgcattgtggctacggctttgcgtccccggcgggcagccccaggctggtccccgcctccgctctccccaccggcggggaaagcagctggtgtgggaggaaaggctccatcccccgccccctctctcccgctgttggctggcaggatcttttggcagtcctgtggcctcgctccccgcccggatcctcctgaccctgagattcgcgggtctcacgtcccgtgcacgccttgcttcggcctcagttaagcctttgtgggctccaggtccctggtgagattagaaacgtttgcaaacatgtcccggatcgaaaagatgagcattctgggcgtgcggagttttggaatagaggacaaagataagcaaattatcactttcttcagcccccttacaattttggttggacccaatggggcgggaaagacgaccatcattgaatgtctaaaatatatttgtactggagatttccctcctggaaccaaaggaaatacatttgtacacgatcccaaggttgctcaagaaacagatgtgagagcccagattcgtctgcaatttcgtgatgtcaatggagaacttatagctgtgcaaagatctatggtgtgtactcagaaaagcaaaaagacagaatttaaaactctggaaggagtcattactagaacaaagcatggtgaaaaggtcagtctgagctctaagtgtgcagaaattgaccgagaaatgatcagttctcttggggtttccaaggctgtgctaaataatgtcattttctgtcatcaagaagattctaattggcctttaagtgaaggaaaggctttgaagcaaaagtttgatgagattttttcagcaacaagatacattaaagccttagaaacacttcggcaggtacgtcagacacaaggtcagaaagtaaaagaatatcaaatggaactaaaatatctgaagcaatataaggaaaaagcttgtgagattcgtgatcagattacaagtaaggaagcccagttaacatcttcaaaggaaattgtcaaatcctatgagaatgaacttgatccattgaagaatcgtctaaaagaaattgaacataatctctctaaaataatgaaacttgacaatgaaattaaagccttggatagccgaaagaagcaaatggagaaagataatagtgaactggaagagaaaatggaaaaggtttttcaagggactgatgagcaactaaatgacttatatcacaatcaccagagaacagtaagggagaaagaaaggaaattggtagactgtcatcgtgaactggaaaaactaaataaagaatctaggcttctcaatcaggaaaaatcagaactgcttgttgaacagggtcgtctacagctgcaagcagatcgccatcaagaacatatccgagctagagattcattaattcagtctttggcaacacagctagaattggatggctttgagcgtggaccattcagtgaaagacagattaaaaattttcacaaacttgtgagagagagacaagaaggggaagcaaaaactgccaaccaactgatgaatgactttgcagaaaaagagactctgaaacaaaaacagatagatgagataagagataagaaaactggactgggaagaataattgagttaaaatcagaaatcctaagtaagaagcagaatgagctgaaaaatgtgaagtatgaattacagcagttggaaggatcttcagacaggattcttgaactggaccaggagctcataaaagctgaacgtgagttaagcaaggctgagaaaaacagcaatgtagaaaccttaaaaatggaagtaataagtctccaaaatgaaaaagcagacttagacaggaccctgcgtaaacttgaccaggagatggagcagttaaaccatcatacaacaacacgtacccaaatggagatgctgaccaaagacaaagctgacaaagatgaacaaatcagaaaaataaaatctaggcacagtgatgaattaacctcactgttgggatattttcccaacaaaaaacagcttgaagactggctacatagtaaatcaaaagaaattaatcagaccagggacagacttgccaaattgaacaaggaactagcttcatctgagcagaataaaaatcatataaataatgaactaaaaagaaaggaagagcagttgtccagttacgaagacaagctgtttgatgtttgtggtagccaggattttgaaagtgatttagacaggcttaaagaggaaattgaaaaatcatcaaaacagcgagccatgctggctggagccacagcagtttactcccagttcattactcagctaacagacgaaaaccagtcatgttgccccgtttgtcagagagtttttcagacagaggctgagttacaagaagtcatcagtgatttgcagtctaaactgcgacttgctccagataaactcaagtcaacagaatcagagctaaaaaaaaaggaaaagcggcgtgatgaaatgctgggacttgtgcccatgaggcaaagcataattgatttgaaggagaaggaaataccagaattaagaaacaaactgcagaatgtcaatagagacatacagcgcctaaagaacgacatagaagaacaagaaacactcttgggtacaataatgcctgaagaagaaagtgccaaagtatgcctgacagatgttacaattatggagaggttccagatggaacttaaagatgttgaaagaaaaattgcacaacaagcagctaagctacaaggaatagacttagatcgaactgtccaacaagtcaaccaggagaaacaagagaaacagcacaagttagacacagtttctagtaagattgaattgaatcgtaagcttatacaggaccagcaggaacagattcaacatctaaaaagtacaacaaatgagctaaaatctgagaaacttcagatatccactaatttgcaacgtcgtcagcaactggaggagcagactgtggaattatccactgaagttcagtctttgtacagagagataaaggatgctaaagagcaggtaagccctttggaaacaacattggaaaagttccagcaagaaaaagaagaattaatcaacaaaaaaaatacaagcaacaaaatagcacaggataaactgaatgatattaaagagaaggttaaaaatattcatggctatatgaaagacattgagaattatattcaagatgggaaagacgactataagaagcaaaaagaaactgaacttaataaagtaatagctcaactaagtgaatgcgagaaacacaaagaaaagataaatgaagatatgagactcatgagacaagatattgatacacagaagatacaagaaaggtggctacaagataaccttactttaagaaaaagaaatgaggaactaaaagaagttgaagaagaaagaaaacaacatttgaaggaaatgggtcaaatgcaggttttgcaaatgaaaagtgaacatcagaagttggaagagaacatagacaatataaaaagaaatcataatttggcattagggcgacagaaaggttatgaagaagaaattattcattttaagaaagaacttcgagaaccacaatttcgggatgctgaggaaaagtatagagaaatgatgattgttatgaggacaacagaacttgtgaacaaggatctggatatttattataagactcttgaccaagcaataatgaaatttcacagtatgaaaatggaagaaatcaataaaattatacgtgacctgtggcgaagtacctatcgtggacaagatattgaatacatagaaatacggtctgatgccgatgaaaatgtatcagcttctgataaaaggcggaattataactaccgagtggtgatgctgaagggagacacagccttggatatgcgaggacgatgcagtgctggacaaaaggtattagcctcactcatcattcgcctggccctggctgaaacgttctgcctcaactgtggcatcattgccttggatgagccaacaacaaatcttgaccgagaaaacattgaatctcttgcacatgctctggttgagataataaaaagtcgctcacagcagcgtaacttccagcttctggtaatcactcatgatgaagattttgtggagcttttaggacgttctgaatatgtggagaaattctacaggattaaaaagaacatcgatcagtgctcagagattgtgaaatgcagtgttagctccctgggattcaatgttcattaaaaatatccaagatttaaatgccatagaaatgtaggtcctcagaaagtgtataataagaaacttatttctcatatcaacttagtcaataagaaaatatattctttcaaaggaacattgtgtctaggattttggatgttgagaggttctaaaatcatgaaacttgtttcactgaaaattggacagattgcctgtttctgatttgctgctcttcatcccattccaggcagcctctgtcaggccttcagggttcagcagtacagccgagactcgactctgtgcctccctccccagtgcaaatgcatgcttcttctcaaagcactgttgagaaggagataattactgccttgaaaatttatggttttggtatttttttaaatcatagttaaatgttacctctgaatttacttccttgcatgtggtttgaaaaactgagtattaatatctgaggatgaccagaaatggtgagatgtatgtttggctctgcttttaactttataaatccagtgacctctctctctgggacttggtttccccaactaaaatttgaagtagttgaatggggtctcaaagtttgacaggaaccttaagtaatcatctaagtcagtacccaccaccttcttctcctacatatcccttccagatggtcatccagactcagagctctctctacagagaggaaattctccactgtgcacacccacctttggaaagctctgaccacttgaggcctgatctgcccatcgtgaagaagcctgtaacactcctctgcgtctatcctgtgtagcatactggcttcaccatcaatcctgattcctctctaagtgggcattgccatgtggaaggcaagccaggctcactcacagagtcaaggcctgctccctgtagggtccaaccagacctggaagaacaggcctctccatttgctcttcagatgccacttctaagaaaagcctaatcacagtttttcctggaattgccagctgacatcttgaatccttccattccacacagaatgcaaccaagtcacacgcttttgaattatgctttgtagagttttgtcattcagagtcagccaggaccataccgggtcttgattcagtcacatggcatggttttgtgccatctgtagctataatgagcatgtttgcctagacagcttttctcaactgggtccagaagagaattaagccctaaggtcctaaggcatctatctgtgctaggttaaatggttggcccccaaagatagacaggtcctgatttctagaacccgtgactgttactttatacagcaaaggaaactttgcagatgtgattaaagctaaggaccttaagacagagtatcctgggggtggtggtggggtgggggggggtcctaaatgtaatcacgagtaagattaagagcaaatcaattctagtcatatattaaacatccacaataaccaagatatttttatcccaagaatgcaagatttcagaaaatgaaaaatctgttgataaatccatcactataataaaaccgaaggtgaaaaaaattctgaaaaaattctagcagctatatttgataaaattcaacatctcctagctttagcaaactcacagttttgcaaataatattttcttaatgttatctgttgctaaatcaaaattaaacagtcatcttaactgcaaaataaaacatttctcagtaaatattaaa

SEQ ID NO: 3475 - DNA, 6597 bp, Homo sapiens
tttcccggcgtgccccaggagagcggcgtggacgcgtgcgggcctagaggcccacgtgatccgcagggcggccgaggcaggaagctgtgagtgcgcggttgcggggtcgcattgtggctacggctttgcgtccccggcgggcagccccaggctggtccccgcctccgctctccccaccggcggggaaagcagctggtgtgggaggaaaggctccatcccccgccccctctctcccgctgttggctggcaggatcttttggcagtcctgtggcctcgctccccgcccggatcctcctgaccctgagattcgcgggtctcacgtcccgtgcacgccttgcttcggcctcagttaagcctttgtgggctccaggtccctggtgagattagaaacgtttgcaaacatgtcccggatcgaaaagatgagcattctgggcgtgcggagttttggaatagaggacaaagataagcaaattatcactttcttcagcccccttacaattttggttggacccaatggggcgggaaagacgaccatcattgaatgtctaaaatatatttgtactggagatttccctcctggaaccaaaggaaatacatttgtacacgatcccaaggttgctcaagaaacagatgtgagagcccagattcgtctgcaatttcgtgatgtcaatggagaacttatagctgtgcaaagatctatggtgtgtactcagaaaagcaaaaagacagaatttaaaactctggaaggagtcattactagaacaaagcatggtgaaaaggtcagtctgagctctaagtgtgcagaaattgaccgagaaatgatcagttctcttggggtttccaaggctgtgctaaataatgtcattttctgtcatcaagaagattctaattggcctttaagtgaaggaaaggctttgaagcaaaagtttgatgagattttttcagcaacaagatacattaaagccttagaaacacttcggcaggtacgtcagacacaaggtcagaaagtaaaagaatatcaaatggaactaaaatatctgaagcaatataaggaaaaagcttgtgagattcgtgatcagattacaagtaaggaagcccagttaacatcttcaaaggaaattgtcaaatcctatgagaatgaacttgatccattgaagaatcgtctaaaagaaattgaacataatctctctaaaataatgaaacttgacaatgaaattaaagccttggatagccgaaagaagcaaatggagaaagataatagtgaactggaagagaaaatggaaaaggtttttcaagggactgatgagcaactaaatgacttatatcacaatcaccagagaacagtaagggagaaagaaaggaaattggtagactgtcatcgtgaactggaaaaactaaataaagaatctaggcttctcaatcaggaaaaatcagaactgcttgttgaacagggtcgtctacagctgcaagcagatcgccatcaagaacatatccgagctagagattcattaattcagtctttggcaacacagctagaattggatggctttgagcgtggaccattcagtgaaagacagattaaaaattttcacaaacttgtgagagagagacaagaaggggaagcaaaaactgccaaccaactgatgaatgactttgcagaaaaagagactctgaaacaaaaacagatagatgagataagagataagaaaactggactgggaagaataattgagttaaaatcagaaatcctaagtaagaagcagaatgagctgaaaaatgtgaagtatgaattacagcagttggaaggatcttcagacaggattcttgaactggaccaggagctcataaaagctgaacgtgagttaagcaaggctgagaaaaacagcaatgtagaaaccttaaaaatggaagtaataagtctccaaaatgaaaaagcagacttagacaggaccctgcgtaaacttgaccaggagatggagcagttaaaccatcatacaacaacacgtacccaaatggagatgctgaccaaagacaaagctgacaaagatgaacaaatcagaaaaataaaatctaggcacagtgatgaattaacctcactgttgggatattttcccaacaaaaaacagcttgaagactggctacatagtaaatcaaaagaaattaatcagaccagggacagacttgccaaattgaacaaggaactagcttcatctgagcagaataaaaatcatataaataatgaactaaaaagaaaggaagagcagttgtccagttacgaagacaagctgtttgatgtttgtggtagccaggattttgaaagtgatttagacaggcttaaagaggaaattgaaaaatcatcaaaacagcgagccatgctggctggagccacagcagtttactcccagttcattactcagctaacagacgaaaaccagtcatgttgccccgtttgtcagagagtttttcagacagaggctgagttacaagaagtcatcagtgatttgcagtctaaactgcgacttgctccagataaactcaagtcaacagaatcagagctaaaaaaaaaggaaaagcggcgtgatgaaatgctgggacttgtgcccatgaggcaaagcataattgatttgaaggagaaggaaataccagaattaagaaacaaactgcagaatgtcaatagagacatacagcgcctaaagaacgacatagaagaacaagaaacactcttgggtacaataatgcctgaagaagaaagtgccaaagtatgcctgacagatgttacaattatggagaggttccagatggaacttaaagatgttgaaagaaaaattgcacaacaagcagctaagctacaaggaatagacttagatcgaactgtccaacaagtcaaccaggagaaacaagagaaacagcacaagttagacacagtttctagtaagattgaattgaatcgtaagcttatacaggaccagcaggaacagattcaacatctaaaaagtacaacaaatgagctaaaatctgagaaacttcagatatccactaatttgcaacgtcgtcagcaactggaggagcagactgtggaattatccactgaagttcagtctttgtacagagagataaaggatgctaaagagcaggtaagccctttggaaacaacattggaaaagttccagcaagaaaaagaagaattaatcaacaaaaaaaatacaagcaacaaaatagcacaggataaactgaatgatattaaagagaaggttaaaaatattcatggctatatgaaagacattgagaattatattcaagatgggaaagacgactataagaagcaaaaagaaactgaacttaataaagtaatagctcaactaagtgaatgcgagaaacacaaagaaaagataaatgaagatatgagactcatgagacaagatattgatacacagaagatacaagaaaggtggctacaagataaccttactttaagaaaaagaaatgaggaactaaaagaagttgaagaagaaagaaaacaacatttgaaggaaatgggtcaaatgcaggttttgcaaatgaaaagtgaacatcagaagttggaagagaacatagacaatataaaaagaaatcataatttggcattagggcgacagaaaggttatgaagaagaaattattcattttaagaaagaacttcgagaaccacaatttcgggatgctgaggaaaagtatagagaaatgatgattgttatgaggacaacagaacttgtgaacaaggatctggatatttattataagactcttgaccaagcaataatgaaatttcacagtatgaaaatggaagaaatcaataaaattatacgtgacctgtggcgaagtacctatcgtggacaagatattgaatacatagaaatacggtctgatgccgatgaaaatgtatcagcttctgataaaaggcggaattataactaccgagtggtgatgctgaagggagacacagccttggatatgcgaggacgatgcagtgctggacaaaaggtattagcctcactcatcattcgcctggccctggctgaaacgttctgcctcaactgtggcatcattgccttggatgagccaacaacaaatcttgaccgagaaaacattgaatctcttgcacatgctctggttgagataataaaaagtcgctcacagcagcgtaacttccagcttctggtaatcactcatgatgaagattttgtggagcttttaggacgttctgaatatgtggagaaattctacaggattaaaaagaacatcgatcagtgctcagagattgtgaaatgcagtgttagctccctgggattcaatgttcattaaaaatatccaagatttaaatgccatagaaatgtaggtcctcagaaagtgtataataagaaacttatttctcatatcaacttagtcaataagaaaatatattctttcaaaggaacattgtgtctaggattttggatgttgagaggttctaaaatcatgaaacttgtttcactgaaaattggacagattgcctgtttctgatttgctgctcttcatcccattccaggcagcctctgtcaggccttcagggttcagcagtacagccgagactcgactctgtgcctccctccccagtgcaaatgcatgcttcttctcaaagcactgttgagaaggagataattactgccttgaaaatttatggttttggtatttttttaaatcatagttaaatgttacctctgaatttacttccttgcatgtggtttgaaaaactgagtattaatatctgaggatgaccagaaatggtgagatgtatgtttggctctgcttttaactttataaatccagtgacctctctctctgggacttggtttccccaactaaaatttgaagtagttgaatggggtctcaaagtttgacaggaaccttaagtaatcatctaagtcagtacccaccaccttcttctcctacatatcccttccagatggtcatccagactcagagctctctctacagagaggaaattctccactgtgcacacccacctttggaaagctctgaccacttgaggcctgatctgcccatcgtgaagaagcctgtaacactcctctgcgtctatcctgtgtagcatactggcttcaccatcaatcctgattcctctctaagtgggcattgccatgtggaaggcaagccaggctcactcacagagtcaaggcctgctccctgtagggtccaaccagacctggaagaacaggcctctccatttgctcttcagatgccacttctaagaaaagcctaatcacagtttttcctggaattgccagctgacatcttgaatccttccattccacacagaatgcaaccaagtcacacgcttttgaattatgctttgtagagttttgtcattcagagtcagccaggaccataccgggtcttgattcagtcacatggcatggttttgtgccatctgtagctataatgagcatgtttgcctagacagcttttctcaactgggtccagaagagaattaagccctaaggtcctaaggcatctatctgtgctaggttaaatggttggcccccaaagatagacaggtcctgatttctagaacccgtgactgttactttatacagcaaaggaaactttgcagatgtgattaaagctaaggaccttaagacagagtatcctgggggtggtggtggggtgggggggggtcctaaatgtaatcacgagtaagattaagagcaaatcaattctagtcatatattaaacatccacaataaccaagatatttttatcccaagaatgcaagatttcagaaaatgaaaaatctgttgataaatccatcactataataaaaccgaaggtgaaaaaaattctgaaaaaattctagcagctatatttgataaaattcaacatctcctagctttagcaaactcacagttttgcaaataatattttcttaatgttatctgttgctaaatcaaaattaaacagtcatcttaactgcaaaataaaacatttctcagtaaatattaaagccagttaccttctatcaacatgttaatgaaagtgctagttgttgcagcaaagaataacaaaggcaatacacgatcaatataggcagtgaaacaaaagtatcatttgcaagttaaaacagacttcccaattttaaatctggtttccccctgaatatgtggcatccttggcagcacttctgagagtggctgctttcattccaagaagcccatgggtttggaggtgggataggtgcctttctggcttctcattgctgcttctagatcagtctccaaatatcccccttccccacattggaatgaatagccatcacagcatggatggaggttagaatgagccagactgcctgggctcaaatcctagcacaccactcactagctggggaccttgagcaagttatttgtcctgttttctgtttccttatatgtaaaagtgggtaaaatggtacatattttgtagggttgttatgaagattgaatgacattatttacaaactgcttagaactgcttgccacctactaaatactgtgtaagtgttcaagaaaaagctgtcttcatttca

SEQ ID NO: 3476 - DNA, 2266 bp, Homo sapiens
gagggtttggcgggaattctgaaagccgctggcggaccgcgcgcagcggccagagaccgagccctaaggagagtgcggcgcttcccgaggcgtgcagctgggaactgcaactcatctgggttgtgcgcagaaggctggggcaagcgagtagagaagtggagcgtaagccaggggcgttgggggccgtgcgggtcgggcgcgtgccacgcccgcggggtgaagtcggagcgcggggcctgctggagagaggagcgctgcggaccgagtaatggcaatgcagatgcagcttgaagcaaatgcagatacttcagtggaagaagaaagctttggcccacaacccatttcacggttagagcagtgtggcataaatgccaacgatgtgaagaaattggaagaagctggattccatactgtggaggctgttgcctatgcgccaaagaaggagctaataaatattaagggaattagtgaagccaaagctgataaaattctggctgaggcagctaaattagttccaatgggtttcaccactgcaactgaattccaccaaaggcggtcagagatcatacagattactactggctccaaagagcttgacaaactacttcaaggtggaattgagactggatctatcacagaaatgtttggagaattccgaactgggaagacccagatctgtcatacgctagctgtcacctgccagcttcccattgaccggggtggaggtgaaggaaaggccatgtacattgacactgagggtacctttaggccagaacggctgctggcagtggctgagaggtatggtctctctggcagtgatgtcctggataatgtagcatatgctcgagcgttcaacacagaccaccagacccagctcctttatcaagcatcagccatgatggtagaatctaggtatgcactgcttattgtagacagtgccaccgccctttacagaacagactactcgggtcgaggtgagctttcagccaggcagatgcacttggccaggtttctgcggatgcttctgcgactcgctgatgagtttggtgtagcagtggtaatcactaatcaggtggtagctcaagtggatggagcagcgatgtttgctgctgatcccaaaaaacctattggaggaaatatcatcgcccatgcatcaacaaccagattgtatctgaggaaaggaagaggggaaaccagaatctgcaaaatctacgactctccctgtcttcctgaagctgaagctatgttcgccattaatgcagatggagtgggagatgccaaagactgaatcattgggtttttcctctgttaaaaaccttaagtgctgcagcctaatgagagtgcactgctccctggggttctctacaggcctcttcctgttgtgactgccaggataaagcttccgggaaaacagctattatatcagcttttctgatggtataaacaggagacaggtcagtagtcacaaactgatctaaaatgtttattccttctgtagtgtattaatctctgtgtgttttctttggttttggaggaggggtatgaagtatctttgacatggtgccttaggaatgacttgggtttaacaagctgtctactggacaatcttatgtttccaagagaactaaagctggagagacctgacccttctctcacttctaaattaatggtaaaataaaatgcctcagctatgtagcaaagggaatgggtctgcacagattctttttttctgtcagtaaaactctcaagcaggtttttaagttgtctgtctgaatgatcttgtgtaaggttttggttatggagtcttgtgccaaacctactaggccattagcccttcaccatctacctgcttggtctttcattgctaagactaactcaagataatcctagagtcttaaagcatttcaggccagtgtggtgtcttgcgcctgtactcccagcactttgggaggccgaggcaggtggatcgcttgagcccaggagttttaagtccagcttggccaaggtggtgaaatcccatctctacaaaaaatgcagaacttaatctggacacactgttacacgtgcctgtagtcccagctactcgatagcctgaggtgggagaatcacttaagcctggaaggtggaagttgcagtgagtcgagattgcactgctgcattccagccagggtgacagagtgagaccatgtttcaaacaagaaacatttcagagggtaagtaaacagatttgattgtgaggcttctaataaagtagttattagtagtg

SEQ ID NO: 3477 - DNA, 2008 bp, Homo sapiens
gttacgtcgacgcgggcgtgaccctgggcgagagggtttggcgggaattctgaaagccgctggcggaccgcgcgcagcggccagagaccgagccctaaggagagtgcggcgcttcccgaggcgtgcagctgggaactgcaactcatctgggttgtgcgcagaaggctggggcaagcgagtagagaagtggagcgtaagccaggggcgttgggggccgtgcgggtcgggcgcgtgccacgcccgcggggtgaagtcggagcgcggggcctgctggagagaggagcgctgcggaccgagtaatggcaatgcagatgcagcttgaagcaaatgcagatacttcagtggaagaagaaagctttggcccacaacccatttcacggttagagcagtgtggcataaatgccaacgatgtgaagaaattggaagaagctggattccatactgtggaggctgttgcctatgcgccaaagaaggagctaataaatattaagggaattagtgaagccaaagctgataaaattctgctcctctctcataggtatggtctctctggcagtgatgtcctggataatgtagcatatgctcgagcgttcaacacagaccaccagacccagctcctttatcaagcatcagccatgatggtagaatctaggtatgcactgcttattgtagacagtgccaccgccctttacagaacagactactcgggtcgaggtgagctttcagccaggcagatgcacttggccaggtttctgcggatgcttctgcgactcgctgatgagtttggtgtagcagtggtaatcactaatcaggtggtagctcaagtggatggagcagcgatgtttgctgctgatcccaaaaaacctattggaggaaatatcatcgcccatgcatcaacaaccagattgtatctgaggaaaggaagaggggaaaccagaatctgcaaaatctacgactctccctgtcttcctgaagctgaagctatgttcgccattaatgcagatggagtgggagatgccaaagactgaatcattgggtttttcctctgttaaaaaccttaagtgctgcagcctaatgagagtgcactgctccctggggttctctacaggcctcttcctgttgtgactgccaggataaagcttccgggaaaacagctattatatcagcttttctgatggtataaacaggagacaggtcagtagtcacaaactgatctaaaatgtttattccttctgtagtgtattaatctctgtgtgttttctttggttttggaggaggggtatgaagtatctttgacatggtgccttaggaatgacttgggtttaacaagctgtctactggacaatcttatgtttccaagagaactaaagctggagagacctgacccttctctcacttctaaattaatggtaaaataaaatgcctcagctatgtagcaaagggaatgggtctgcacagattctttttttctgtcagtaaaactctcaagcaggtttttaagttgtctgtctgaatgatcttgtgtaaggttttggttatggagtcttgtgccaaacctactaggccattagcccttcaccatctacctgcttggtctttcattgctaagactaactcaagataatcctagagtcttaaagcatttcaggccagtgtggtgtcttgcgcctgtactcccagcactttgggaggccgaggcaggtggatcgcttgagcccaggagttttaagtccagcttggccaaggtggtgaaatcccatctctacaaaaaatgcagaacttaatctggacacactgttacacgtgcctgtagtcccagctactcgatagcctgaggtgggagaatcacttaagcctggaaggtggaagttgcagtgagtcgagattgcactgctgcattccagccagggtgacagagtgagaccatgtttcaaacaagaaacatttcagagggtaagtaaacagatttgattgtgaggcttctaataaagtagttattagtagtgaa

SEQ ID NO: 3478 - DNA, 1588 bp, Homo sapiens
aattctgaaagccgctggcggaccgcgcgcagcggccagagaccgagccctaaggagagtgcggcgcttcccgaggcgtgcagctgggaactgcaactcatctgggttgtgcgcagaaggctggggcaagcgagtagagaagtggagctaatggcaatgcagatgcagcttgaagcaaatgcagatacttcagtggaagaagaaagctttggcccacaacccatttcacggttagagcagtgtggcataaatgccaacgatgtgaagaaattggaagaagctggattccatactgtggaggctgttgcctatgcgccaaagaaggagctaataaatattaagggaattagtgaagccaaagctgataaaattctgacggagtctcgctctgttgccaggctggagtgcaatagcgtgatcttggtctactgcaccctccgcctctcaggttcaagtgattctcctgcctcagcctcccgagtagttgggactacaggtggaattgagactggatctatcacagaaatgtttggagaattccgaactgggaagacccagatctgtcatacgctagctgtcacctgccagcttcccattgaccggggtggaggtgaaggaaaggccatgtacattgacactgagggtacctttaggccagaacggctgctggcagtggctgagaggtatggtctctctggcagtgatgtcctggataatgtagcatatgctcgagcgttcaacacagaccaccagacccagctcctttatcaagcatcagccatgatggtagaatctaggtatgcactgcttattgtagacagtgccaccgccctttacagaacagactactcgggtcgaggtgagctttcagccaggcagatgcacttggccaggtttctgcggatgcttctgcgactcgctgatgagtttggtgtagcagtggtaatcactaatcaggtggtagctcaagtggatggagcagcgatgtttgctgctgatcccaaaaaacctattggaggaaatatcatcgcccatgcatcaacaaccagattgtatctgaggaaaggaagaggggaaaccagaatctgcaaaatctacgactctccctgtcttcctgaagctgaagctatgttcgccattaatgcagatggagtgggagatgccaaagactgaatcattgggtttttcctctgttaaaaaccttaagtgctgcagcctaatgagagtgcactgctccctggggttctctacaggcctcttcctgttgtgactgccaggataaagcttccgggaaaacagctattatatcagcttttctgatggtataaacaggagacaggtcagtagtcacaaactgatctaaaatgtttattccttctgtagtgtattaatctctgtgtgttttctttggttttggaggaggggtatgaagtatctttgacatggtgccttaggaatgacttgggtttaacaagctgtctactggacaatcttatgtttccaagagaactaaagctggagagacctgacccttctctcacttctaaattaatggtaaaataaaatgcctcagctatgtagcaaaggg

SEQ ID NO: 3479 - DNA, 1611 bp, Homo sapiens
gttacgtcgacgcgggcgtgaccctgggcgagagggtttggcgggaattctgaaagccgctggcggaccgcgcgcagcggccagagaccgagccctaaggagagtgcggcgcttcccgaggcgtgcagctgggaactgcaactcatctgggttgtgcgcagaaggctggggcaagcgagtagagaagtggagcgtaagccaggggcgttgggggccgtgcgggtcgggcgcgtgccacgcccgcggggtgaagtcggagcgcggggcctgctggagagaggagcgctgcggaccgagtaatggcaatgcagatgcagcttgaagcaaatgcagatacttcagtggaagaagaaagctttggcccacaacccatttcacggttagagcagtgtggcataaatgccaacgatgtgaagaaattggaagaagctggattccatactgtggaggctgttgcctatgcgccaaagaaggagctaataaatattaagggaattagtgaagccaaagctgataaaattctggctgaggcagctaaattagttccaatgggtttcaccactgcaactgaattccaccaaaggcggtcagagatcatacagattactactggctccaaagagcttgacaaactacttcaaggtggaattgagactggatctatcacagaaatgtttggagaattccgaactgggaagacccagatctgtcatacgctagctgtcacctgccagcttcccattgaccggggtggaggtgaaggaaaggccatgtacattgacactgagggtacctttaggccagaacggctgctggcagtggctgagaggtatggtctctctggcagtgatgtcctggataatgtagcatatgctcgagcgttcaacacagaccaccagacccagctcctttatcaagcatcagccatgatggtagaatctaggtatgcactgcttattgtagacagtgccaccgccctttacagaacagactactcgggtcgaggtgagctttcagccaggcagatgcacttggccaggtttctgcggatgcttctgcgactcgctgatgagattgtatctgaggaaaggaagaggggaaaccagaatctgcaaaatctacgactctccctgtcttcctgaagctgaagctatgttcgccattaatgcagatggagtgggagatgccaaagactgaatcattgggtttttcctctgttaaaaaccttaagtgctgcagcctaatgagagtgcactgctccctggggttctctacaggcctcttcctgttgtgactgccaggataaagcttccgggaaaacagctattatatcagcttttctgatggtataaacaggagacaggtcagtagtcacaaactgatctaaaatgtttattccttctgtagtgtattaatctctgtgtgttttctttggttttggaggaggggtatgaagtatctttgacatggtgccttaggaatgacttgggtttaacaagctgtctactggacaatcttatgtttccaagagaactaaagctggagagacctgacccttctctcacttctaaattaatggtaaaataaaatgcctcagctatgtagcaaagg

SEQ ID NO: 3480 - DNA, 1545 bp, Homo sapiens
gctggcggaccgcgcgcagcggccagagaccgagccctaaggagagtgcggcgcttcccgaggcgtgcagctgggaactgcaactcatctgggttgtgcgcagaaggctggggcaagcgagtagagaagtggagcgtaagccaggggcgttgggggccgtgcgggtcgggcgcgtgccacgcccgcggggtgaagtcggagcgcggggcctgctggagagaggagcgctgcggaccgagtaatggcaatgcagatgcagcttgaagcaaatgcagatacttcagtggaagaagaaagctttggcccacaacccatttcacggttagagcagtgtggcataaatgccaacgatgtgaagaaattggaagaagctggattccatactgtggaggctgttgcctatgcgccaaagaaggagctaataaatattaagggaattagtgaagccaaagctgataaaattctggctgaggcagctaaattagttccaatgggtttcaccactgcaactgaattccaccaaaggcggtcagagatcatacagattactactggctccaaagagcttgacaaactacttcaaggtggaattgagactggatctatcacagaaatgtttggagaattccgaactgggaagacccagatctgtcatacgctagctgtcacctgccaggtatggtctctctggcagtgatgtcctggataatgtagcatatgctcgagcgttcaacacagaccaccagacccagctcctttatcaagcatcagccatgatggtagaatctaggtatgcactgcttattgtagacagtgccaccgccctttacagaacagactactcgggtcgaggtgagctttcagccaggcagatgcacttggccaggtttctgcggatgcttctgcgactcgctgatgagtttggtgtagcagtggtaatcactaatcaggtggtagctcaagtggatggagcagcgatgtttgctgctgatcccaaaaaacctattggaggaaatatcatcgcccatgcatcaacaaccagattgtatctgaggaaaggaagaggggaaaccagaatctgcaaaatctacgactctccctgtcttcctgaagctgaagctatgttcgccattaatgcagatggagtgggagatgccaaagactgaatcattgggtttttcctctgttaaaaaccttaagtgctgcagcctaatgagagtgcactgctccctggggttctctacaggcctcttcctgttgtgactgccaggataaagcttccgggaaaacagctattatatcagcttttctgatggtataaacaggagacaggtcagtagtcacaaactgatctaaaatgtttattccttctgtagtgtattaatctctgtgtgttttctttggttttggaggaggggtatgaagtatctttgacatggtgccttaggaatgacttgggtttaacaagctgtctactggacaatcttatgtttccaagagaactaaagctggagagacctgacccttctctcacttctaaattaa

SEQ ID NO: 3481 - DNA, 625 bp, Homo sapiens
gcggctcgtcctcgcccacctgcgtcctggccggtccagtgctcagcggcagttggggcctccgcgcgcagtgtgaaacccggacgtggcagggcgtgtccgcgcccgaccgaccctcagctgctggggcgaaaacacaagtggacctcagtctttagaactaggggagaaacattagagcctttataggcaacacctattttatgggttcgagcgagaagtccgagatcagagcggtgtagccacagctgtttaatatcacagccagggcttccggattcctgatctgtctttccattacaccgtgcttagaaagtaccaatctccgattgccaaaacagtgttttcatcatctaatgcggaaaaccattcacatgatgcctagagaatgatctgaataatggcaatgcagatgcagcttgaagcaaatgcagatacttcagtggaagaagaaagctttggcccacaacccatttcacggttagagcagtgtggcataaatgccaacgatgtgaagaaattggaagaagctggattccatactgtggaggctgttgcctatgcgccaaagaaggagctaataaatattaagggaattagtgaagccaaagctgataaaattctg

SEQ ID NO: 3482 - DNA, 566 bp, Homo sapiens
cttgggagtcgtggtcttcgatctggtaaacagaagacggcaactcgtaatggcaatgcagatgcagcttgaagcaaatgcagatacttcagtggaagaagaaagctttggcccacaacccatttcacggttagagcagtgtggcataaatgccaacgatgtgaagaaattggaagaagctggattccatactgtggaggctgttgcctatgcgccaaagaaggagctaataaatattaagggaattagtgaagccaaagctgataaaattctggctgaggcagctaaattagttccaatgggtttcaccactgcaactgaattccaccaaaggcggtcagagatcatacagattactactggctccaaagagcttgacaaactacttcaaggtggaattgagactggatctatcacagaaatgtttggagaattccgaactgggaagacccagatctgtcatacgctagctgtcacctgccagcttcccattgaccggggtggaggtgaaggaaaggccatgtacattgacactgagggtacctttaggccagaacggctgctgg

SEQ ID NO: 3483 - DNA, 658 bp, Homo sapiens
taatggcaatgcagatgcagcttgaagcaaatgcagatacttcagtggaagaagaaagctttggcccacaacccatttcacggttagagcagtgtggcataaatgccaacgatgtgaagaaattggaagaagctggattccatactgtggaggctgttgcctatgcgccaaagaaggagctaataaatattaagggaattagtgaagccaaagctgataaaattctggtggaattgagactggatctatcacagaaatgtttggagaattccgaactgggaagacccagatctgtcatacgctagctgtcacctgccagcttcccattgaccggggtggaggtgaaggaaaggccatgtacattgacactgagggtacctttaggccagaacggctgctggcagtggctgagaggtatggtctctctggcagtgatgtcctggataatgtagcatatgctcgagcgttcaacacagaccaccagacccagctcctttatcaagcatcagccatgatggtagaatctaggtatgcactgcttattgtagacagtgccaccgccctttacagaacagactactcgggtcgaggtgagctttcagccaggcagatgcacttggccaggtttctgcggatgcttctgcgactcgctgatgag

SEQ ID NO: 3484 - DNA, 1515 bp, Homo sapiens
aattctgaaagccgctggcggaccgcgcgcagcggccagagaccgagccctaaggagagtgcggcgcttcccgaggcgtgcagctgggaactgcaactcatctgggttgtgcgcagaaggctggggcaagcgagtagagaagtggagcgtaagccaggggcgttgggggccgtgcgggtcgggcgcgtgccacgcccgcggggtgaagtcggagcgcggggcctgctggagagaggagcgctgcggaccgagtaatggcaatgcagatgcagcttgaagcaaatgcagatacttcagtggaagaagaaagctttggcccacaacccatttcacggttagagcagtgtggcataaatgccaacgatgtgaagaaattggaagaagctggattccatactgtggaggctgttgcctatgcgccaaagaaggagctaataaatattaagggaattagtgaagccaaagctgataaaattctgacggagtctcgctctgttgccaggctggagtgcaatagcgtgatcttggtctactgcaccctccgcctctcaggttcaagtgattctcctgcctcagcctcccgagtagttgggactacaggtggaattgagactggatctatcacagaaatgtttggagaattccgaactgggaagacccagatctgtcatacgctagctgtcacctgccagcttcccattgaccggggtggaggtgaaggaaaggccatgtacattgacactgagggtacctttaggccagaacggctgctggcagtggctgagaggtatggtctctctggcagtgatgtcctggataatgtagcatatgctcgagcgttcaacacagaccaccagacccagctcctttatcaagcatcagccatgatggtagaatctaggtatgcactgcttattgtagacagtgccaccgccctttacagaacagactactcgggtcgaggtgagctttcagccaggcagatgcacttggccaggtttctgcggatgcttctgcgactcgctgatgagtttggtgtagcagtggtaatcactaatcaggtggtagctcaagtggatggagcagcgatgtttgctgctgatcccaaaaaacctattggaggaaatatcatcgcccatgcatcaacaaccagattgtatctgaggaaaggaagaggggaaaccagaatctgcaaaatctacgactctccctgtcttcctgaagctgaagctatgttcgccattaatgcagatggagtgggagatgccaaagactgaatcattgggtttttcctctgttaaaaaccttaagtgctgcagcctaatgagagtgcactgctccctggggttctctacaggcctcttcctgttgtgactgccaggataaagcttccgggaaaacagctattatatcagcttttctgatggtataaacaggagacaggtcagtagtcacaaactgatctaaaatgtttattccttctgtagtgtattaatctctgtgtgttttctttgg

SEQ ID NO: 3485 - DNA, 1397 bp, Homo sapiens
ggaattctgaaagccgctggcggaccgcgcgcagcggccagagaccgagccctaaggagagtgcggcgcttcccgaggcgtgcagctgggaactgcaactcatctgggttgtgcgcagaaggctggggcaagcgagtagagaagtggagcgtaagccaggggcgttgggggccgtgcgggtcgggcgcgtgccacgcccgcggggtgaagtcggagcgcggggcctgctggagagaggagcgctgcggaccgagtaatggcaatgcagatgcagcttgaagcaaatgcagatacttcagtggaagaagaaagctttggcccacaacccatttcacggttagagcagtgtggcataaatgccaacgatgtgaagaaattggaagaagctggattccatactgtggaggctgttgcctatgcgccaaagaaggagctaataaatattaagggaattagtgaagccaaagctgataaaattctggcagtggctgagaggtatggtctctctggcagtgatgtcctggataatgtagcatatgctcgagcgttcaacacagaccaccagacccagctcctttatcaagcatcagccatgatggtagaatctaggtatgcactgcttattgtagacagtgccaccgccctttacagaacagactactcgggtcgaggtgagctttcagccaggcagatgcacttggccaggtttctgcggatgcttctgcgactcgctgatgagtttggtgtagcagtggtaatcactaatcaggtggtagctcaagtggatggagcagcgatgtttgctgctgatcccaaaaaacctattggaggaaatatcatcgcccatgcatcaacaaccagattgtatctgaggaaaggaagaggggaaaccagaatctgcaaaatctacgactctccctgtcttcctgaagctgaagctatgttcgccattaatgcagatggagtgggagatgccaaagactgaatcattgggtttttcctctgttaaaaaccttaagtgctgcagcctaatgagagtgcactgctccctggggttctctacaggcctcttcctgttgtgactgccaggataaagcttccgggaaaacagctattatatcagcttttctgatggtataaacaggagacaggtcagtagtcacaaactgatctaaaatgtttattccttctgtagtgtattaatctctgtgtgttttctttggttttggaggaggggtatgaagtatctttgacatggtgccttaggaatgacttgggtttaacaagctgtctactggacaatcttatgtttccaagagaactaaagctggagagacctgacccttctctcacttctaaattaatggtaaaataaaatgcctcagctatgtagcaaa

SEQ ID NO: 3486 - DNA, 1050 bp, Homo sapiens
atgggtagcaagaaactaaaacgagtgggtttatcacaagagctgtgtgaccgtctgagtagacatcagatccttacctgtcaggactttttatgtctttccccactggagcttatgaaggtgactggtctgagttatcgaggtgtccatgaacttctatgtatggtcagcagggcctgtgccccaaagatgcaaacggcttatgggataaaagcacaaaggtctgctgatttctcaccagcattcttatctactaccctttctgctttggacgaagccctgcatggtggtgtggcttgtggatccctcacagagattacaggtccaccaggttgtggaaaaactcagttttgtataatgatgagcattttggctacattacccaccaacatgggaggattagaaggagctgtggtgtacattgacacagagtctgcatttagtgctgaaagactggttgaaatagcagaatcccgttttcccagatattttaacactgaagaaaagttacttttgacaagtagtaaagttcatctttatcgggaactcacctgtgatgaagttctacaaaggattgaatctttggaagaagaaattatctcaaaaggaattaaacttgtgattcttgactctgttgcttctgtggtcagaaaggagtttgatgcacaacttcaaggcaatctcaaagaaagaaacaagttcttggcaagagaggcatcctccttgaagtatttggctgaggagttttcaatcccagttatcttgacgaatcagattacaacccatctgagtggagccctggcttctcaggcagacctggtgtctccagctgatgatttgtccctgtctgaaggcacttctggatccagctgtgtgatagccgcactaggaaatacctggagtcacagtgtgaatacccggctgatcctccagtaccttgattcagagagaagacagattcttattgccaagtcccctctggctcccttcacctcatttgtctacaccatcaaggaggaaggcctggttcttcaagcttatgctcagtgc

SEQ ID NO: 3487 - DNA, 1101 bp, Homo sapiens
atgggtagcaagaaactaaaacgagtgggtttatcacaagagctgtgtgaccgtctgagtagacatcagatccttacctgtcaggactttttatgtctttccccactggagcttatgaaggtgactggtctgagttatcgaggtgtccatgaacttctatgtatggtcagcagggcctgtgccccaaagatgcaaacggcttatgggataaaagcacaaaggtctgctgatttctcaccagcattcttatctactaccctttctgctttggacgaagccctgcatggtggtgtggcttgtggatccctcacagagattacaggtccaccaggttgtggaaaaactcagttttgtataatgatgagcattttggctacattacccaccaacatgggaggattagaaggagctgtggtgtacattgacacagagtctgcatttagtgctgaaagactggttgaaatagcagaatcccgttttcccagatattttaacactgaagaaaagttacttttgacaagtagtaaagttcatctttatcgggaactcacctgtgatgaagttctacaaaggattgaatctttggaagaagaaattatctcaaaaggaattaaacttgtgattcttgactctgttgcttctgtggtcagaaaggagtttgatgcacaacttcaaggcaatctcaaagaaagaaacaagttcttggcaagagaggcatcctccttgaagtatttggctgaggagttttcaatcccagttatcttgacgaatcagattacaacccatctgagtggagccctggcttctcaggcagacctggtgtctccagctgatgatttgtccctgtctgaaggcacttctggatccagctgtgtgatagccgcactaggaaatacctggagtcacagtgtgaatacccggctgatcctccagtaccttgattcagagagaagacagattcttattgccaagtcccctctggctcccttcacctcatttgtctacaccatcaaggaggaaggcctggttcttcaagaattttggcacatttgcatatctggtttctcaatccagaacagactaaaagaaaatgagtcctga

SEQ ID NO: 3488 - DNA, 1050 bp, Homo sapiens
atgggtagcaagaaactaaaacgagtgggtttatcacaagagctgtgtgaccgtctgagtagacatcagatccttacctgtcaggactttttatgtctttccccactggagcttatgaaggtgactggtctgagttatcgaggtgtccatgaacttctatgtatggtcagcagggcctgtgccccaaagatgcaaacggcttatgggataaaagcacaaaggtctgctgatttctcaccagcattcttatctactaccctttctgctttggacgaagccctgcatggtggtgtggcttgtggatccctcacagagattacaggtccaccaggttgtggaaaaactcagttttgtataatgatgagcattttggctacattacccaccaacatgggaggattagaaggagctgtggtgtacattgacacagagtctgcatttagtgctgaaagactggttgaaatagcagaatcccgttttcccagatattttaacactgaagaaaagttacttttgacaagtagtaaagttcatctttatcgggaactcacctgtgatgaagttctacaaaggattgaatctttggaagaagaaattatctcaaaaggaattaaacttgtgattcttgactctgttgcttctgtggtcagaaaggagtttgatgcacaacttcaaggcaatctcaaagaaagaaacaagttcttggcaagagaggcatcctccttgaagtatttggctgaggagttttcaatcccagttatcttgacgaatcagattacaacccatctgagtggagccctggcttctcaggcagacctggtgtctccagctgatgatttgtccctgtctgaaggcacttctggatccagctgtgtgatagccgcactaggaaatacctggagtcacagtgtgaatacccggctgatcctccagtaccttgattcagagagaagacagattcttattgccaagtcccctctggctcccttcacctcatttgtctacaccatcaaggaggaaggcctggttcttcaagggcaggagacccca

SEQ ID NO: 3489 - DNA, 1536 bp, Homo sapiens
ctgtgtaaagggtggggaaacttgaaagttggatgctgcagacccggcatgggtagcaagaaactaaaacgagtgggtttatcacaagagctgtgtgaccgtctgagtagacatcagatccttacctgtcaggactttttatgtctttccccactggagcttatgaaggtgactggtctgagttatcgaggtgtccatgaacttctatgtatggtcagcagggcctgtgccccaaagatgcaaacggcttatgggataaaagcacaaaggtctgctgatttctcaccagcattcttatctactaccctttctgctttggacgaagccctgcatggtggtgtggcttgtggatccctcacagagattacaggtccaccaggttgtggaaaaactcagttttgtataatgatgagcattttggctacattacccaccaacatgggaggattagaaggagctgtggtgtacattgacacagagtctgcatttagtgctgaaagactggttgaaatagcagaatcccgttttcccagatattttaacactgaagaaaagttacttttgacaagtagtaaagttcatctttatcgggaactcacctgtgatgaagttctacaaaggattgaatctttggaagaagaaattatctcaaaaggaattaaacttgtgattcttgactctgttgcttctgtggtcagaaaggagtttgatgcacaacttcaaggcaatctcaaagaaagaaacaagttcttggcaagagaggcatcctccttgaagtatttggctgaggagttttcaatcccagttatcttgacgaatcagattacaacccatctgagtggagccctggcttctcaggcagacctggtgtctccagctgatgatttgtccctgtctgaaggcacttctggatccagctgtgtgatagccgcactaggaaatacctggagtcacagtgtgaatacccggctgatcctccagtaccttgattcagagagaagacagattcttattgccaagtcccctctggctcccttcacctcatttgtctacaccatcaaggaggaaggcctggttcttcaaggccaagagaagccatagggatactgtgacctttgtctagagttgatgggggtgtgatttgtgaaataaaacaggaccgtactgcttggaagaaggaaacggaagctgacataatggggattaattagttgattgctgttgagatggtaacagatttgctcctaaaccattgagctagcgatttcagacctagcagggaaggtgaagatgaagaagcctttgttcaggtctctagatgtgtagggctgagggctttgccgccatgggatgtcaacagccataataataatttgcacttatatagcacctttcaaccaggcacctcaaagcggtttaaccacattaattaattaaagcccacaatcctcctggggagaggaggaggatgactaacaagatttgtaattacaggagggaacatttccgaataaagtattgtctaccagataaaaa

SEQ ID NO: 3490 - DNA, 568 bp, Homo sapiens
cttggatccatgaagagttcctgtttcagttcgttccagaggatacttctttaccatctcaatgagatatacagcttctcctttgtatgcattaagagactcacagtaattcttttttagctctgtgaagataaatctttcatgagcctcatttacccctagcaaggcatgggtagcaagaaactaaaacgagtgggtttatcacaagagctgtgtgaccgtctgagtagacatcagatccttacctgtcaggactttttatgtctttccccactggagcttatgaaggtgactggtctgagttatcgaggtgtccatgaacttctatgtatggtcagcagggcctgtgccccaaagatgcaaacggcttatgggataaaagcacaaaggtctgctgatttctcaccagcattcttatctactaccctttctgctttggacgaagccctgcatggtggtgtggcttgtggatccctcacagagattacaggtccaccaggttgtggaaaaactcagttttgtataatgatgagcattttggctacattacccaccaacatgggaggat

SEQ ID NO: 3491 - DNA, 2596 bp, Homo sapiens
ctgtgtaaagggtggggaaacttgaaagttggatgctgcagacccggcatgggtagcaagaaactaaaacgagtgggtttatcacaagagctgtgtgaccgtctgagtagacatcagatccttacctgtcaggactttttatgtctttccccactggagcttatgaaggtgactggtctgagttatcgaggtgtccatgaacttctatgtatggtcagcagggcctgtgccccaaagatgcaaacggcttatgggataaaagcacaaaggtctgctgatttctcaccagcattcttatctactaccctttctgctttggacgaagccctgcatggtggtgtggcttgtggatccctcacagagattacaggtccaccaggttgtggaaaaactcagttttgtataatgatgagcattttggctacattacccaccaacatgggaggattagaaggagctgtggtgtacattgacacagagtctgcatttagtgctgaaagactggttgaaatagcagaatcccgttttcccagatattttaacactgaagaaaagttacttttgacaagtagtaaagttcatctttatcgggaactcacctgtgatgaagttctacaaaggattgaatctttggaagaagaaattatctcaaaaggaattaaacttgtgattcttgactctgttgcttctgtggtcagaaaggagtttgatgcacaacttcaaggcaatctcaaagaaagaaacaagttcttggcaagagaggcatcctccttgaagtatttggctgaggagttttcaatcccagttatcttgacgaatcagattacaacccatctgagtggagccctggcttctcaggcagacctggtgtctccagctgatgatttgtccctgtctgaaggcacttctggatccagctgtgtgatagccgcactaggaaatacctggagtcacagtgtgaatacccggctgatcctccagtaccttgattcagagagaagacagattcttattgccaagtcccctctggctcccttcacctcatttgtctacaccatcaaggaggaaggcctggttcttcaagagacaacattttgctctgtcacccaagctgaactgaactgggctccagaaatcctcccacctcagcctcctgagcagctaggactacagatgtgccaccatacccagctaattttttaattttttgtagaggtggggtctcattatgttgcccaagctgatctcaaactcctggcttcaagagatccacccacctcagcctcccaaagcgctaggattacaagtatgagactttgccattccaatgagaattttgtccttagcaatctcatccaatggccactggagatgtgtgtagggccacaagaatgagaaagggggcaatggagtgacaggtgacctgctcaggtgcccctccccagaccaaatgtcccaggcacacagcccatgccctccaccatggagtacattttctccctggcttgctgctgagctaaaggaccagggacgtggaaacaggaggtgaactaaggcaccccgccacccactgtggcagcttgaatttcttgaggctgagacaaactaggatccagtagcctagattttgccccagtttctccactgagtatttactcagtgctcctgagccgatgccttcccctctgcctagatgaaccacagcattttggtaaatgcctcagcatgttaggagcgctggaacgtttattctcttccctcccaattatccactctaatggagcagaacacttacatggaaaatcctaaacatggaagatgatttaaaaatgattcaccctggaatacatgcttccagttgcttctacaggtttaccttgctaaaggcatttcgcttcctttgctgttacaataagcttgcctgccttgaagaaaagaagaccagggccaaagggaaatcagtcaagggagcctgttttgtctgaaataatgcatccatgaacaaatgaattgagtataactgtctttttacatcagtgtttctgtggaattaagagaacatccaaggccactcctagcttgagtagattaaatttgtccttgtgtttggagcaagggttgtgaagtctgtctggcccatcaaatgaccaatggcttttaaggaaggactaagtgacttatgaccagaacaagggagcagcctgagtcagtctccccaatgtctacattgtgttatttatactagcaaaaaaatagacacaactaaatgttcgaccatatggtattggttaaattaacatctatacgatggaatactagatggtcattaaaattatgtgtcagaagaaggcttaatctcatgggaaagtgttcacaccatattattaaagagaaaaaacagattataaagcaatatgcatacaatgtagtagttctgtaagaaaaaagtattatgtgcattttaactggaaaaatatgtataaaaatgttaacagtgcaatctctgggcaataagattatacttgacttttatttcttttttggaattgtcttttttttttttttttcaagtttcctcccattaacatgcatgttc

SEQ ID NO: 3492 - DNA, 1550 bp, Homo sapiens
ttgaaagttggatgctgcagacccggcatgggtagcaagaaactaaaacgagtgggtttatcacaagagctgtgtgaccgtctgagtagacatcagatccttacctgtcaggactttttatgtctttccccactggagcttatgaaggtgactggtctgagttatcgaggtgtccatgaacttctatgtatggtcagcagggcctgtgccccaaagatgcaaacggcttatgggataaaagcacaaaggtctgctgatttctcaccagcattcttatctactaccctttctgctttggacgaagccctgcatggtggtgtggcttgtggatccctcacagagattacaggtccaccaggttgtggaaaaactcagttttgtataatgatgagcattttggctacattacccaccaacatgggaggattagaaggagctgtggtgtacattgacacagagtctgcatttagtgctgaaagactggttgaaatagcagaatcccgttttcccagatattttaacactgaagaaaagttacttttgacaagtagtaaagttcatctttatcgggaactcacctgtgatgaagttctacaaaggattgaatctttggaagaagaaattatctcaaaaggaattaaacttgtgattcttgactctgttgcttctgtggtcagaaaggagtttgatgcacaacttcaaggcaatctcaaagaaagaaacaagttcttggcaagagaggcatcctccttgaagtatttggctgaggagttttcaatcccagttatcttgacgaatcagattacaacccatctgagtggagccctggcttctcaggcagacctggtgtctccagctgatgatttgtccctgtctgaaggcacttctggatccagctgtgtgatagccgcactaggaaatacctggagtcacagtgtgaatacccggctgatcctccagtaccttgattcagagagaagacagattcttattgccaagtcccctctggctcccttcacctcatttgtctacaccatcaaggaggaaggcctggttcttcaagaattttggcacatttgcatatctggtttctcaatccagaacagactaaaagaaaatgagtcctgagattgctacagatgagacccacccatcggagccaggctttgaaggaactgaccgcagtgtgcatgaggaagtacttcacggtgatgaccctcgccaccctctcaggaaaacacagtgacctctcccccaacatccccttcccactcccaggtcccccggcaaaggcagaagaaccaagcaagcctttccaccaaagcagccatgaaccccattctcatcctttccaagaactctctgctataccagataggggtttggggttctgttttccattttttaaaaaaatcatttcaagactcttgaacagtgtgtcggtttacactattctatcttcttaagccaccatatcaacatattcactctgcttcctttcttttcatttggcagatgccacacttttaatggcagcaataaaaggtgtt

SEQ ID NO: 3493 - DNA, 249 bp, Homo sapiens
cttttctttgctggatctggaggcatgggtagcaagaaactaaaacgagtgggtttatcacaagagctgtgtgaccgtctgagtagacatcagatccttacctgtcaggactttttatgtctttccccactggagcttatgaaggtgactggtctgagttatcgaggtgtccatgaacttctatgtatggtcagcagggcctgtgccccaaagatgcaaacggcttatgggataaaagcacaaaggtct

SEQ ID NO: 3494 - DNA, 1322 bp, Homo sapiens
gacgtcacgccgcacgccccagcgagggcgtgcggagtttggctgctccggggttagcaggtgagcctgcgatgcgcgggaagacgttccgctttgaaatgcagcgggatttggtgagtttcccgctgtctccagcggtgcgggtgaagctggtgtctgcggggttccagactgctgaggaactcctagaggtgaaaccctccgagcttagcaaagaagttgggatatctaaagcagaagccttagaaactctgcaaattatcagaagagaatgtctcacaaataaaccaagatatgctggtacatctgagtcacacaagaagtgtacagcactggaacttcttgagcaggagcatacccagggcttcataatcaccttctgttcagcactagatgatattcttgggggtggagtgcccttaatgaaaacaacagaaatttgtggtgcaccaggtgttggaaaaacacaattatgtatgcagttggcagtagatgtgcagataccagaatgttttggaggagtggcaggtgaagcagtttttattgatacagagggaagttttatggttgatagagtggtagaccttgctactgcctgcattcagcaccttcagcttatagcagaaaaacacaagggagaggaacaccgaaaagctttggaggatttcactcttgataatattctttctcatatttattattttcgctgtcgtgactacacagagttactggcacaagtttatcttcttccagatttcctttcagaacactcaaaggttcgactagtgatagtggatggtattgcttttccatttcgtcatgacctagatgacctgtctcttcgtactcggttattaaatggcctagcccagcaaatgatcagccttgcaaataatcacagattagctgtaattttaaccaatcagatgacaacaaagattgatagaaatcaggccttgcttgttcctgcattaggggaaagttggggacatgctgctacaatacggctaatctttcattgggaccgaaagcaaaggttggcaacattgtacaagtcacccagccagaaggaatgcacagtactgtttcaaatcaaacctcagggatttagagatactgttgttacttctgcatgttcattgcaaacagaaggttccttgagcacccggaaacggtcacgagacccagaggaagaattataacccagaaacaaatctcaaagtgtacaaatttattgatgttgtgaaatcaatgtgtacaagtggacttgttaccttaaagtataaataaacacactatggcatgaatgaatccagatcata

SEQ ID NO: 3495 - DNA, 2399 bp, Homo sapiens
ctggaacccggaagcggcagcgcggcgcgacccggcgggcgggctctgggcgcgggaatcccggcggatcccgggcgggcggatgacccccagccctacccttggtgccgcctcctcctctctcctttctcctccggcagccagcgcgcctgtgtcctctctaggaaggggtaggggaggggcgtctggagaggaccccccgcgaatgcccacgtgacgtgcagtccccctggggctgttccggcctgcggggaacatgggcgtgctcagggtcggactgtgccctggccttaccgaggagatgatccagcttctcaggagccacaggatcaagacagtggtggacctggtttctgcagacctggaagaggtagctcagaaatgtggcttgtcttacaaggccctggttgccctgaggcgggtgctgctggctcagttctcggctttccccgtgaatggcgctgatctctacgaggaactgaagacctccactgccatcctgtccactggcattggcagaataagactgtcaggaaatgcacggtggctcatgcctaaagtgactgaaattgtaggaggcccaggtagcggcaaaactcaggtatgtctctgtatggcagcaaatgtggcccatggcctgcagcaaaacgtcctatatgtagattccaatggagggctgacagcttcccgcctcctccagctgcttcaggctaaaacccaggatgaggaggaacaggcagaagctctccggaggatccaggtggtgcatgcatttgacatcttccagatgctggatgtgctgcaggagctccgaggcactgtggcccagcaggtgactggttcttcaggaactgtgaaggtggtggttgtggactcggtcactgcggtggtttccccacttctgggaggtcagcagagggaaggcttggccttgatgatgcagctggcccgagagctgaagaccctggcccgggaccttggcatggcagtggtggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacagccaacaggtttccaggagatggtagacattgggacctgggggacctcagagcagagtgccacattacagggtgatcagacatgacctgtgctgttgtttgggaaacagggaagcattggggacccctcccaacttttcttcccagtaacgcctgctgtttactgccacctggcactggtgactacagacgttctcaggctggccagaagagacatcttgggttccttggcctcactctctgtaagcatataaaccacaggcgaaagaggatgctgcattgcgaggacccagaaattcatactggtgccacgtttccttcccttatttctaacgtgtatgtttctggtggaaaccaagttcaccctggctgggagcatctctgatgaggcatgctggcgactggatggataatcctgtgcatcaccattgtgtcctgtgctccctcctagcgcagtggccaagccgggaaagcctctaacttgcctttgctgctgctgccttttttttcttttgtctctgcctttccatttgttagatgggggcccactcttccttagctctgtctctgagttactgggtggaaataagcttataaatgaaatactcttcttcatctctgttttgctcttaaaaatataaaaaggcaattccccgagccctagagccacctgatttccccttagaaggctgtttttcagtttcccccagtgaggcccaaagaacagtttattcctcctttcctcttgctgatttggtttcagacctgcctgcatcaccatgactaggtgagaacgtgtgggctcgctgcagttccagggatataatttaacagaaagggagggtatgacctgctcctggtgaatccagccactcatttaatatgcatggtgccctgtggggcccctccacagtacagcataaccagaggtgctgaaccatggccttgcccataaacagacagaggagaatttgcacagtaaatagagccagctgggaaaattgatgctgacgtaaataatacatggcaaatctagtcctttatgcagaaattcattgctggtggctccaagatgcaatataattacacctctcttcctgccagctgtaccacagctagtgccctagtgtatgaaataatccctctgtctttcaccagcactgtggccatccgtctgagagccatgaccctggctgggaggggacgaagacaccagggaatggaaaataaaaggaaaagtac

SEQ ID NO: 3496 - DNA, 2404 bp, Homo sapiens
ctggaacccggaagcggcagcgcggcgcgacccggcgggcgggctctgggcgcgggaatcccggcggatcccgggcgggcggatgacccccagccctacccttggtgccgcctcctcctctctcctttctcctccggcagccagcgcgcctgtgtcctctctaggaaggggtaggggaggggcgtctggagaggaccccccgcgaatgcccacgtgacgtgcagtccccctggggctgttccggcctgcggggaacatgggcgtgctcagggtcggactgtgccctggccttaccgaggagatgatccagcttctcaggagccacaggatcaagacagtggtggacctggtttctgcagacctggaagaggtagctcagaaatgtggcttgtcttacaaggccctggttgccctgaggcgggtgctgctggctcagttctcggctttccccgtgaatggcgctgatctctacgaggaactgaagacctccactgccatcctgtccactggcattggcagtcttgataaactgcttgatgctggtctctatactggagaagtgactgaaattgtaggaggcccaggtagcggcaaaactcaggtatgtctctgtatggcagcaaatgtggcccatggcctgcagcaaaacgtcctatatgtagattccaatggagggctgacagcttcccgcctcctccagctgcttcaggctaaaacccaggatgaggaggaacaggcagaagctctccggaggatccaggtggtgcatgcatttgacatcttccagatgctggatgtgctgcaggagctccgaggcactgtggcccagcaggtgactggttcttcaggaactgtgaaggtggtggttgtggactcggtcactgcggtggtttccccacttctgggaggtcagcagagggaaggcttggccttgatgatgcagctggcccgagagctgaagaccctggcccgggaccttggcatggcagtggtggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacagccaacaggtttccaggagatggtagacattgggacctgggggacctcagagcagagtgccacattacagggtgatcagacatgacctgtgctgttgtttgggaaacagggaagcattggggacccctcccaacttttcttcccagtaacgcctgctgtttactgccacctggcactggtgactacagacgttctcaggctggccagaagagacatcttgggttccttggcctcactctctgtaagcatataaaccacaggcgaaagaggatgctgcattgcgaggacccagaaattcatactggtgccacgtttccttcccttatttctaacgtgtatgtttctggtggaaaccaagttcaccctggctgggagcatctctgatgaggcatgctggcgactggatggataatcctgtgcatcaccattgtgtcctgtgctccctcctagcgcagtggccaagccgggaaagcctctaacttgcctttgctgctgctgccttttttttcttttgtctctgcctttccatttgttagatgggggcccactcttccttagctctgtctctgagttactgggtggaaataagcttataaatgaaatactcttcttcatctctgttttgctcttaaaaatataaaaaggcaattccccgagccctagagccacctgatttccccttagaaggctgtttttcagtttcccccagtgaggcccaaagaacagtttattcctcctttcctcttgctgatttggtttcagacctgcctgcatcaccatgactaggtgagaacgtgtgggctcgctgcagttccagggatataatttaacagaaagggagggtatgacctgctcctggtgaatccagccactcatttaatatgcatggtgccctgtggggcccctccacagtacagcataaccagaggtgctgaaccatggccttgcccataaacagacagaggagaatttgcacagtaaatagagccagctgggaaaattgatgctgacgtaaataatacatggcaaatctagtcctttatgcagaaattcattgctggtggctccaagatgcaatataattacacctctcttcctgccagctgtaccacagctagtgccctagtgtatgaaataatccctctgtctttcaccagcactgtggccatccgtctgagagccatgaccctggctgggaggggacgaagacaccagggaatggaaaataaaaggaaaagtacagaaa

SEQ ID NO: 3497 - DNA, 1327 bp, Homo sapiens
tgtgtcctctctaggaaggggtaggggaggggcgtctggagaggaccccccgcgaatgcccacgtgacgtgcagtccccctggggctgttccggcctgcggggaacatgggcgtgctcagggtcggactgtgccctggccttaccgaggagatgatccagcttctcaggagccacaggatcaagacagtggtggacctggtttctgcagacctggaagaggtagctcagaaatgtggcttgtcttacaaggcagaagctctccggaggatccaggtggtgcatgcatttgacatcttccagatgctggatgtgctgcaggagctccgaggcactgtggcccagcaggtgactggttcttcaggaactgtgaaggtggtggttgtggactcggtcactgcggtggtttccccacttctgggaggtcagcagagggaaggcttggccttgatgatgcagctggcccgagagctgaagaccctggcccgggaccttggcatggcagtggtggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacagccaacaggtttccaggagatggtagacattgggacctgggggacctcagagcagagtgccacattacagggtgatcagacatgacctgtgctgttgtttgggaaacagggaagcattggggacccctcccaacttttcttcccagtaacgcctgctgtttactgccacctggcactggtgactacagacgttctcaggctggccagaagagacatcttgggttccttggcctcactctctgtaagcatataaaccacaggcgaaagaggatgctgcattgcgaggacccagaaattcatactggtgccacgtttccttcccttatttctaacgtgtatgtttctggtggaaaccaagttcaccctggctgggagcatctctgatgaggcatgctggcgactggatggataatcctgtgcatcaccattgtgtcctgtgctccctcctagcgcagtggccaagccgggaaagcctctaacttgcctttgctgctgctgccttttttttcttttgtctctgcctttccatttgttagatgggggcccactcttccttagctctgtctctgagttactgggtggaaataagcttataaatgaaatactcttcttcatctctgttttgctcttaaaaatataaaaaggcaattccccg

SEQ ID NO: 3498 - DNA, 613 bp, Homo sapiens
ctggaacccggaagcggcagcgcggcgcgacccggcgggcgggctctgggcgcgggaatcccggcggatcccgggcgggcggatgacccccagccctacccttggtgccgcctcctcctctctcctttctcctccggcagccagcgcgcctgtgtcctctctaggaaggggtaggggaggggcgtctggagaggaccccccgcgaatgcccacgtgacgtgcagtccccctggggctgttccggcctgcggggaacatgggcgtgctcagggtcggactgtgccctggccttaccgaggagatgatccagcttctcaggagccacaggatcaagacagtggtggacctggtttctgcagacctggaagaggtagctcagaaatgtggcttgtcttacaaggccctggttgccctgaggcgggtgctgctggctcagttctcggctttccccgtgaatggcgctgatctctacgaggaactgaagacctccactgccatcctgtccactggcattggcagacatggagggcgcactcaagtgggaacctgggaggactgcagctgcctcaggtccccgcagggagatcgtggagtggggtcaggaatgctctga

SEQ ID NO: 3499 - DNA, 2264 bp, Homo sapiens
ctggaacccggaagcggcagcgcggcgcgacccggcgggcgggctctgggcgcgggaatcccggcggatcccgggcgggcggatgacccccagccctacccttggtgccgcctcctcctctctcctttctcctccggcagccagcgcgcctgtgtcctctctaggaaggggtaggggaggggcgtctggagaggaccccccgcgaatgcccacgtgacgtgcagtccccctggggctgttccggcctgcggggaacatgggcgtgctcagggtcggactgtgccctggccttaccgaggagatgatccagcttctcaggagccacaggatcaagacagtggtggacctggtttctgcagacctggaagaggtagctcagaaatgtggcttgtcttacaaggccctggttgccctgaggcgggtgctgctggctcagttctcggctttccccgtgaatggcgctgatctctacgaggaactgaagacctccactgccatcctgtccactggcattggcagtcttgataaactgcttgatgctggtctctatactggagaagtgactgaaattgtaggaggcccaggtagcggcaaaactcaggcagaagctctccggaggatccaggtggtgcatgcatttgacatcttccagatgctggatgtgctgcaggagctccgaggcactgtggcccagcaggtgactggttcttcaggaactgtgaaggtggtggttgtggactcggtcactgcggtggtttccccacttctgggaggtcagcagagggaaggcttggccttgatgatgcagctggcccgagagctgaagaccctggcccgggaccttggcatggcagtggtggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacagccaacaggtttccaggagatggtagacattgggacctgggggacctcagagcagagtgccacattacagggtgatcagacatgacctgtgctgttgtttgggaaacagggaagcattggggacccctcccaacttttcttcccagtaacgcctgctgtttactgccacctggcactggtgactacagacgttctcaggctggccagaagagacatcttgggttccttggcctcactctctgtaagcatataaaccacaggcgaaagaggatgctgcattgcgaggacccagaaattcatactggtgccacgtttccttcccttatttctaacgtgtatgtttctggtggaaaccaagttcaccctggctgggagcatctctgatgaggcatgctggcgactggatggataatcctgtgcatcaccattgtgtcctgtgctccctcctagcgcagtggccaagccgggaaagcctctaacttgcctttgctgctgctgccttttttttcttttgtctctgcctttccatttgttagatgggggcccactcttccttagctctgtctctgagttactgggtggaaataagcttataaatgaaatactcttcttcatctctgttttgctcttaaaaatataaaaaggcaattccccgagccctagagccacctgatttccccttagaaggctgtttttcagtttcccccagtgaggcccaaagaacagtttattcctcctttcctcttgctgatttggtttcagacctgcctgcatcaccatgactaggtgagaacgtgtgggctcgctgcagttccagggatataatttaacagaaagggagggtatgacctgctcctggtgaatccagccactcatttaatatgcatggtgccctgtggggcccctccacagtacagcataaccagaggtgctgaaccatggccttgcccataaacagacagaggagaatttgcacagtaaatagagccagctgggaaaattgatgctgacgtaaataatacatggcaaatctagtcctttatgcagaaattcattgctggtggctccaagatgcaatataattacacctctcttcctgccagctgtaccacagctagtgccctagtgtatgaaataatccctctgtctttcaccagcactgtggccatccgtctgagagccatgaccctggctgggaggggacgaagacaccagggaatggaaaataaaaggaaaagtac

SEQ ID NO: 3500 - DNA, 2459 bp, Homo sapiens
ctggaacccggaagcggcagcgcggcgcgacccggcgggcgggctctgggcgcgggaatcccggcggatcccgggcgggcggatgacccccagccctacccttggtgccgcctcctcctctctcctttctcctccggcagccagcgcgcctgtgtcctctctaggaaggggtaggggaggggcgtctggagaggaccccccgcgaatgcccacgtgacgtgcagtccccctggggctgttccggcctgcggggaacatgggcgtgctcagggtcggactgtgccctggccttaccgaggagatgatccagcttctcaggagccacaggatcaagacagtggtggacctggtttctgcagacctggaagaggtagctcagaaatgtggcttgtcttacaagacatggagggcgcactcaagtgggaacctgggaggactgcagctgcctcaggtccccgcagggagatcgtggagtggggtcaggaatgctctgaagaaggcaggacttgggcatggaggaacagatggactttcgctgaatgctttcgatgaacgaggcactgcggtcagcacttcacgtcttgataaactgcttgatgctggtctctatactggagaagtgactgaaattgtaggaggcccaggtagcggcaaaactcaggtatgtctctgtatggcagcaaatgtggcccatggcctgcagcaaaacgtcctatatgtagattccaatggagggctgacagcttcccgcctcctccagctgcttcaggctaaaacccaggatgaggaggaacaggcagaagctctccggaggatccaggtggtgcatgcatttgacatcttccagatgctggatgtgctgcaggagctccgaggcactgtggcccagcaggtgactggttcttcaggaactgtgaaggtggtggttgtggactcggtcactgcggtggtttccccacttctgggaggtcagcagagggaaggcttggccttgatgatgcagctggcccgagagctgaagaccctggcccgggaccttggcatggcagtggtggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacagccaacaggtttccaggagatggtagacattgggacctgggggacctcagagcagagtgccacattacagggtgatcagacatgacctgtgctgttgtttgggaaacagggaagcattggggacccctcccaacttttcttcccagtaacgcctgctgtttactgccacctggcactggtgactacagacgttctcaggctggccagaagagacatcttgggttccttggcctcactctctgtaagcatataaaccacaggcgaaagaggatgctgcattgcgaggacccagaaattcatactggtgccacgtttccttcccttatttctaacgtgtatgtttctggtggaaaccaagttcaccctggctgggagcatctctgatgaggcatgctggcgactggatggataatcctgtgcatcaccattgtgtcctgtgctccctcctagcgcagtggccaagccgggaaagcctctaacttgcctttgctgctgctgccttttttttcttttgtctctgcctttccatttgttagatgggggcccactcttccttagctctgtctctgagttactgggtggaaataagcttataaatgaaatactcttcttcatctctgttttgctcttaaaaatataaaaaggcaattccccgagccctagagccacctgatttccccttagaaggctgtttttcagtttcccccagtgaggcccaaagaacagtttattcctcctttcctcttgctgatttggtttcagacctgcctgcatcaccatgactaggtgagaacgtgtgggctcgctgcagttccagggatataatttaacagaaagggagggtatgacctgctcctggtgaatccagccactcatttaatatgcatggtgccctgtggggcccctccacagtacagcataaccagaggtgctgaaccatggccttgcccataaacagacagaggagaatttgcacagtaaatagagccagctgggaaaattgatgctgacgtaaataatacatggcaaatctagtcctttatgcagaaattcattgctggtggctccaagatgcaatataattacacctctcttcctgccagctgtaccacagctagtgccctagtgtatgaaataatccctctgtctttcaccagcactgtggccatccgtctgagagccatgaccctggctgggaggggacgaagacaccagggaatggaaaataaaaggaaaagtac

SEQ ID NO: 3501 - DNA, 986 bp, Homo sapiens
gatttgaggctactgctgccaggctagctatgtggctggccagaccaagggccagtgtgactgtgaagcagcatcatgagaggggtaaaaccaaggaacagactgcatgagcccttgggccccttccagctctaatactccatggtgatggcagccctgcccttctctgaagatctcaaaatgcctgacacctgtgtccttccgcactgccctgggaaggagaataaggatgtggtggacctggtttctgcagacctggaagaggtagctcagaaatgtggcttgtcttacaaggccctggttgccctgaggcgggtgctgctggctcagttctcggctttccccgtgaatggcgctgatctctacgaggaactgaagacctccactgccatcctgtccactggcattggcagtcttgataaactgcttgatgctggtctctatactggagaagtgactgaaattgtaggaggcccaggtagcggcaaaactcaggtatgtctctgtatggcagcaaatgtggcccatggcctgcagcaaaacgtcctatatgtagattccaatggagggctgacagcttcccgcctcctccagctgcttcaggctaaaacccaggatgaggaggaacaggcagaagctctccggaggatccaggtggtgcatgcatttgacatcttccagatgctggatgtgctgcaggagctccgaggcactgtggcccagcaggatggaattcccgagcacctaaatcacatacctcattgtttacatgttcatcttccctgctgaacagtaaagccccctgagtggaaggatcatgtcatatttatgtctgcattccccactagtttctaggggttaagaatctgagactaggagcggtggctcacgcctaaaatcccaatgctttggaaggccaaggcaggaggatcacttgagcccaggagttcaggaccagcctgggcagcatagcaagaccctgtctt

SEQ ID NO: 3502 - DNA, 847 bp, Homo sapiens
cggtgtgtgtgttgcggcagaagccagcgcgcctgtgtcctctctaggaaggggtaggggaggggcgtctggagaggaccccccgcgaatgcccacgtgacgtgcagtccccctggggctgttccggcctgcggggaacatgggcgtgctcagggtcggactgtgccctggccttaccgaggagatgatccagcttctcaggagccacaggatcaagacagtggtggacctggtttctgcagacctggaagaggtagctcagaaatgtggcttgtcttacaaggccctggttgccctgaggcgggtgctgctggctcagttctcggctttccccgtgaatggcgctgatctctacgaggaactgaagacctccactgccatcctgtccactggcattggcagtcttgataaactgcttgatgctggtctctatactggagaagtgactgaaattgtaggaggcccaggtagcggcaaaactcaggtatgtctctgtatggcagcaaatgtggcccatggcctgcagcaaaacgtcctatatgtagattccaatggagggctgacagcttcccgcctcctccagctgcttcaggctaaaacccaggatgaggaggaacaggcagaagctctccggaggatccaggtggtgcatgcatttgacatcttccagatgctggatgtgctgcaggagctccgaggcactgtggcccagcaggtgactggttcttcaggaactgtgaaggtggtggttgtggactcggtcactgcggtggtttccccacttctgggaggtcagcagagggaaggcttggccttgatgatgcagctggcccgagagctgaagacc

SEQ ID NO: 3503 - DNA, 1528 bp, Homo sapiens
aatcccggcggatcccgggcgggcggatgacccccagccctacccttggtgccgcctcctcctctctcctttctcctccggcagccagcgcgcctgtgtcctctctaggaaggggtaggggaggggcgtctggagaggaccccccgcgaatgcccacgtgacgtgcagtccccctggggctgttccggcctgcggggaacatgggcgtgctcagggtcggactgtgccctggccttaccgaggagatgatccagcttctcaggagccacaggatcaagacagtggtggacctggtttctgcagacctggaagaggtagctcagaaatgtggcttgtcttacaagacatggagggcgcactcaagtgggaacctgggaggactgcagctgcctcaggtccccgcagggagatcgtggagtggggtcaggaatgctctgaagaaggcaggacttgggcatggaggaacagatggactttcgctgaatgctttcgatgaacgaggcactgcggtcagcacttcacgtcttgataaactgcttgatgctggtctctatactggagaagtgactgaaattgtaggaggcccaggtagcggcaaaactcaggtatgtctctgtatggcagcaaatgtggcccatggcctgcagcaaaacgtcctatatgtagattccaatggagggctgacagcttcccgcctcctccagctgcttcaggctaaaacccaggatgaggaggaacaggcagaagctctccggaggatccaggtggtgcatgcatttgacatcttccagatgctggatgtgctgcaggagctccgaggcactgtggcccagcaggtgactggttcttcaggaactgtgaaggtggtggttgtggactcggtcactgcggtggtttccccacttctgggaggtcagcagagggaaggcttggccttgatgatgcagctggcccgagagctgaagaccctggcccgggaccttggcatggcagtggtggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacagccaacaggtttccaggagatggtagacattgggacctgggggacctcagagcagagtgccacattacagggtgatcagacatgacctgtgctgttgtttgggaaacagggaagcattggggacccctcccaacttttcttcccagtaacgcctgctgtttactgccacctggcactggtgactacagacgttctcaggctggccagaagagacatcttgggttccttggcctcactctctgtaagcatataaaccacaggcgaaagaggatgctgcattgcgaggacccagaaattcatactggtgccacgtttccttcccttatttctaacgtgtatgtttctggtggaaaccaagttcaccct

SEQ ID NO: 3504 - DNA, 2710 bp, Homo sapiens
ttcccagagacgctcgcgcacccttcccattctcctctgcgcggcctccatctaagatctcttccccttgtccatagcctagatcgagctccctgtgtgcaccgcgcgctgcccgaggcgcaggtcaaccagaatcaagatgtctgggactgaggaagcaattcttggaggacgtgacagccatcctgctgctggcggcggctcagtgttatgctttggacagtgccagtacacagcagaagagtaccaggccatccagaaggccctgaggcagaggctgggcccagaatacataagtagccgcatggctggcggaggccagaaggtgtgctacattgagggtcatcgggtaattaatctggccaatgagatgtttggttacaatggctgggcacactccatcacgcagcagaatgtggattttgttgacctcaacaatggcaagttctacgtgggagtctgtgcatttgtgagggtccagctgaaggatggttcatatcatgaagatgttggttatggtgttagtgagggcctcaagtccaaggctttatctttggagaaggcaaggaaggaggcggtgacagacgggctgaagcgagccctcaggagttttgggaatgcacttggaaactgtattctggacaaagactacctgagatcactaaataagcttccacgccagttgcctcttgaagtggatttaactaaagcgaagagacaagatcttgaaccgtctgtggaggaggcaagatacaacagctgccgaccgaacatggccctgggacacccacagctgcagcaggtgacctccccttccagacccagccatgctgtgataccggcggaccaggactgcagctcccgaagcctgagctcatccgccgtggagagcgaggccacgcaccagcggaagctccggcagaagcagctgcagcagcagttccgggagcggatggagaagcagcaggttcgagtctccacgccgtcagctgagaagagtgaggcagcgcctccggcccctcctgtgacgcacagcactcctgtaactgtctcagaaccactcctggagaaagacttccttgcaggagtgactcaagaattaatcaagactcttgaagacaactctgaaaagtgggctgtgactcccgatgcaggggatggtgtggtcaagccctcgtctagagcagacccagcccagacctctgacacattagccttgaacaaccagatggtgacccagaacaggactccacacagcgtttgccaccagaaaccacaagcaaaatctggatcttgggacctccaaacttatagcgctgaccaacgcacaacaggaaactgggaatctcataggaagagccaggacatgaagaaaaggaaatatgatccatcttaactgaggctcaggccacataattggactctgtcacaaagggactttggaaaactactttttggtcatgaaattgttcatcgctgctggagaatgaacgtcattgcgatttatcttgcttcattctgaaccttatcaagaggatctgactgagagcccactgcagttagagctgagcacttttgaaaagcttgtccatcactctagtagggagaggctctggacagatgaataccttttcttcggcttgtgaggcttcccactatttattactgaactattatgttaatgaagatggacattttaggaatcaccaatggctccttgccctcaagcaatataggccagacttggtcctaagcacctgcctcagcaattgtctacattcagttgttttgcataacgtctgccttctttcctttacggtccatgcctttaatgttgcccacattaagcactgtggatcacgacaggaaaaaggttggagcagtgcttttcactactttgtatcaatccaggctacaatcttcatttaatataaataatttatggatttatgacattacaatcctgcattgtttcaagactgacattttttcctaaggaaggaaataatcatctaagaccacgaaaaaaggctgttttttgtttttttttttttttttttttttgagacggggtctggctgtgttgccctgactggagttcagtggtgcaaacacagctctctccacaacctcttgggcccaagtgatactcccacctctgccttacaaaatacagggattactggtgtgagccactgtgtctggccagaaaaggcatttttgagaaagcaaatcgtataccttattaacaaaatagaatatatatatattgcttatctgaaatgcttgaaaccagaattgttttgcattttttgaatatttgtatacacataatgagaccttggggatgggacccaagtctgaacgtggaattcacctgtgtttcgtgtatatgcctcatacacataattttgtgcatgaaacagagtttttgtataagaagatacactgcagctgaagagggctgggtttttttttctcttagggtcgctgcataaactgttgtatgcctggtgctttgcgacttgtcacacgaggtcacgtgtggaattttccacttctggcatcacgtcagtgctcagaaattttctgatctcagagcatttcaattagggatgctcaaacgcaactgtttctacttccccatttcaggtgtgagatgtaacccaccttgaccataaattggcttttcatagtgctcagatgtttc

SEQ ID NO: 3505 - DNA, 2366 bp, Homo sapiens
gttccctcccaggatcgacatgcacttggatcattgcagtttctgggcctgctgtcatctcccccttcagtacttcccacatatgactaccaactgttagacgatgtgctgctgccagaccagcctttcatttcttggacatccggctatttacccaggaaaagtcatcctttgactatttttcatgacctttctcatctgactcgtgatctgcccatcttgttactccctagcagtgtggtaagaggtcaaccagaatcaagatgtctgggactgaggaagcaattcttggaggacgtgacagccatcctgctgctggcggcggctcagtgttatgctttggacagtgccagtacacagcagaagagtaccaggccatccagaaggccctgaggcagaggctgggcccagaatacataagtagccgcatggctggcggaggccagaaggtgtgctacattgagggtcatcgggtaattaatctggccaatgagatgtttggttacaatggctgggcacactccatcacgcagcagaatgtggattttgttgacctcaacaatggcaagttctacgtgggagtctgtgcatttgtgagggtccagctgaaggatggttcatatcatgaagatgttggttatggtgttagtgagggcctcaagtccaaggctttatctttggagaaggcaaggaaggaggcggtgacagacgggctgaagcgagccctcaggagttttgggaatgcacttggaaactgtattctggacaaagactacctgagatcactaaataagcttccacgccagttgcctcttgaagtggatttaactaaagcgaagagacaagatcttgaaccgtctgtggaggaggcaagatacaacagctgccgaccgaacatggccctgggacacccacagctgcagcaggtgacctccccttccagacccagccatgctgtgataccggcggaccaggactgcagctcccgaagcctgagctcatccgccgtggagagcgaggccacgcaccagcggaagctccggcagaagcagctgcagcagcagttccgggagcggatggagaagcagcaggttcgagtctccacgccgtcagctgagaagagtgaggcagcgcctccggcccctcctgtgacgcacagcactcctgtaactgtctcagaaccactcctggagaaagacttccttgcaggagtgactcaagaattaatcaagactcttgaagacaactctgaaaagtgggctgtgactcccgatgcaggggatggtgtggtcaagccctcgtctagagcagacccagcccagacctctgacacattagccttgaacaaccagatggtgacccagaacaggactccacacagcgtttgccaccagaaaccacaagcaaaatctggatcttgggacctccaaacttatagcgctgaccaacgcacaacaggaaactgggaatctcataggaagagccaggacatgaagaaaaggaaatatgatccatcttaactgaggctcaggccacataattggactctgtcacaaagggactttggaaaactactttttggtcatgaaattgttcatcgctgctggagaatgaacgtcattgcgatttatcttgcttcattctgaaccttatcaagaggatctgactgagagcccactgcagttagagctgagcacttttgaaaagcttgtccatcactctagtagggagaggctctggacagatgaataccttttcttcggcttgtgaggcttcccactatttattactgaactattatgttaatgaagatggacattttaggaatcaccaatggctccttgccctcaagcaatataggccagacttggtcctaagcacctgcctcagcaattgtctacattcagttgttttgcataacgtctgccttctttcctttacggtccatgcctttaatgttgcccacattaagcactgtggatcacgacaggaaaaaggttggagcagtgcttttcactactttgtatcaatccaggctacaatcttcatttaatataaataatttatggatttatgacattacaatcctgcattgtttcaagactgacattttttcctaaggaaggaaataatcatctaagaccacgaaaaaaggctgttttttgtttttttttttttttttttttttgagacggggtctggctgtgttgccctgactggagttcagtggtgcaaacacagctctctccacaacctcttgggcccaagtgatactcccacctctgccttacaaaatacagggattactggtgtgagccactgtgtctggccagaaaaggcatttttgagaaagcaaatcgtatacc

SEQ ID NO: 3506 - DNA, 1380 bp, Homo sapiens
aagatctcttccccttgtccatagcctagatcgagctccctgtgtgcaccgcgcgctgcccgaggcgcgtgtgctacattgagggtcatcgggtaattaatctggccaatgagatgtttggttacaatggctgggcacactccatcacgcagcagaatgtggattttgttgacctcaacaatggcaagttctacgtgggagtctgtgcatttgtgagggtccagctgaaggatggttcatatcatgaagatgttggttatggtgttagtgagggcctcaagtccaaggctttatctttggagaaggcaaggaaggaggcggtgacagacgggctgaagcgagccctcaggagttttgggaatgcacttggaaactgtattctggacaaagactacctgagatcactaaataagcttccacgccagttgcctcttgaagtggatttaactaaagcgaagagacaagatcttgaaccgtctgtggaggaggcaagatacaacagctgccgaccgaacatggccctgggacacccacagctgcagcaggtgacctccccttccagacccagccatgctgtgataccggcggaccaggactgcagctcccgaagcctgagctcatccgccgtggagagcgaggccacgcaccagcggaagctccggcagaagcagctgcagcagcagttccgggagcggatggagaagcagcaggttcgagtctccacgccgtcagctgagaagagtgaggcagcgcctccggcccctcctgtgacgcacagcactcctgtaactgtctcagaaccactcctggagaaagacttccttgcaggagtgactcaagaattaatcaagactcttgaagacaactctgaaaagtgggctgtgactcccgatgcaggggatggtgtggtcaagccctcgtctagagcagacccagcccagacctctgacacattagccttgaacaaccagatggtgacccagaacaggactccacacagcgtttgccaccagaaaccacaagcaaaatctggatcttgggacctccaaacttatagcgctgaccaacgcacaacaggaaactgggaatctcataggaagagccaggacatgaagaaaaggaaatatgatccatcttaactgaggctcaggccacataattggactctgtcacaaagggactttggaaaactactttttggtcatgaaattgttcatcgctgctggagaatgaacgtcattgcgatttatcttgcttcattctgaaccttatcaagaggatctgactgagagcccactgcagttagagctgagcacttttgaaaagcttgtccatcactctagtagggagaggctctggacagatgaataccttttcttc

SEQ ID NO: 3507 - DNA, 681 bp, Homo sapiens
atgtctgggactgaggaagcaattcttggaggacgtgacagccatcctgctgctggcggcggctcagtgttatgctttggacagtgccagtacacagcagaagagtaccaggccatccagaaggccctgaggcagaggctgggcccagaatacataagtagccgcatggctggcggaggccagaaggtgtgctacattgagggtcatcgggtaattaatctggccaatgagatgtttggttacaatggctgggcacactccatcacgcagcagaatgtggattttgttgacctcaacaatggcaagttctacgtgggagtctgtgcatttgtgagggtccagctgaaggatggttcatatcatgaagatgttggttatggtgttagtgagggcctcaagtccaaggctttatctttggagaaggcaaggaaggaggcggtgacagacgggctgaagcgagccctcaggcttcccttgctgggagtaagtggtagaatcctgtactctctcttctccgtgcactcagtcatgtgtgccggaggccttcccactcctactgcgagtgcacagacagcaccctcctctccgtgctcctcagcagtcctccgctacgcacaggagttttgggaatgcacttggaaactgtattctggacaaagactacctgagatcactaaataa

SEQ ID NO: 3508 - DNA, 3108 bp, Homo sapiens
ggtcttggcgggtcggtgagtcttggcggctgttaacgcgcgctttgggaacaggaaggttgagagagaggtgctggggtctgcgtctatctctgtcgctcttttcagcccctcctggtattcccctcctaacctgggttttttacacgcccgcgtggcttcctgctcgacctccctgagtctgatcctggtttccacctccagccctgggaaatttcctttctccagactcgccctccccacccgggcctcggactttcaccccagcttctctctcctggccagtgattacccacccccaatcccaccccgccccgccgcgcaactacctcctcccttcacccggactgggaccatcatccccactccactccgcccagtctgggactccacctgcctcctccccaatcccacactaatctctgcttggtctcttcctctttggcctaatctctcgtctcggcttattggggacggccactctcacagtttggttccaaacaccagttcctggatggattcccgccatccatgccccctctttaattagccggtcctctcaataatgtagcagccccctctacagattagaccctggtcctacactcttagccgctgcctgcttttgacctttggctcatgggtacttgacgttttaaactcctaggcccaggatgaggaggagcttggctcccagccagctggccaagagaaaacctgaaggcaggtcctgtgatgatgaagactggcaacctggcctagtgactcctaggaaacggaaatccagcagtgagacccagatccaggagtgtttcctgtctccttttcggaaacctttgagtcagctaaccaatcaaccaccttgtctggacagcagtcagcatgaagcatttattcgaagcattttgtcaaagcctttcaaagtccccattccaaattatcaaggtcctctgggctctcgagcattgggcctgaaaagggctggggtccgccgggccctccatgaccccctggaaaaagatgccttggttctgtatgagcctcccccgctgagcgctcatgaccagctgaagcttgacaaggagaaactccctgtccatgtggttgttgaccctattctcagtaaggttttgcggcctcatcagagagagggagtgaaattcctgtgggagtgtgtcaccagtcggcgcatccctggcagccatggctgcatcatggctgatgagatgggcctaggaaagacgctgcagtgcatcacattgatgtggacacttttacgccagagtccagagtgcaagccagaaattgacaaggcagtggtggtgtcgccttccagcctggtgaagaactggtacaatgaggttgggaaatggctcggagggaggatccaacctctggccatcgatggaggatctaaggatgaaatagaccaaaagctggaaggattcatgaaccagcgtggagccagggtgtcttctcccatcctcatcatttcctatgagaccttccgccttcatgttggagtcctccagaaaggaagtgttggtctggtcatatgtgacgagggacacaggctcaagaactctgagaatcagacttaccaagccctggacagcttgaacaccagccggcgggtgctcatctccggaactcccatccagaatgatctgcttgagtatttcagcttggtacattttgttaattccggcatcctagggactgcccatgaattcaagaagcattttgaattgccaattttgaagggtcgagacgctgctgctagtgaggcagacaggcagctaggagaggagcggctgcgggagctcaccagcattgtgaatagatgcctgatacggaggacttctgatatcctttctaaatatctgcctgtgaagattgagcaggtcgtttgttgtaggctgacaccccttcagactgagttatacaagaggtttctgagacaagccaaaccggcagaagaattgcttgagggcaagatgagtgtgtcttccctttcttccatcacctcgctaaagaagctttgtaatcatccagctctaatctatgataagtgtgtggaagaggaggatggctttgtgggtgccttggacctcttccctcctggttacagctctaaggccctggagccccagctgtcaggtaagatgctggtcctggattatattctggcggtgacccgaagccgtagcagtgacaaagtagtgctggtgtcgaattacacccagactttggatctctttgagaagctgtgccgtgcccgaaggtacttatacgtccgcctggatggcacgatgtccattaagaagcgagccaaggttgtagaacgcttcaatagtccatcgagccctgactttgtcttcatgctgagcagcaaagctgggggctgtggcctcaatctcattggggctaaccggctggtcatgtttgaccctgactggaacccagccaatgatgaacaagccatggcccgggtctggcgagatggtcaaaagaagacttgctatatctaccgcctgctgtctgcagggaccattgaggagaagatcttccagcgtcagagccacaagaaggcactgagcagctgtgtggtggatgaggagcaggatgtagagcgccacttctctctgggcgagttgaaggagctgtttatcctggatgaagctagcctcagtgacacacatgacaggttgcactgccgacgttgtgtcaacagccgtcagatccggccaccccctgatggttctgactgcacttcagacctggcagggtggaaccactgcactgataagtgggggctccgggatgaggtactccaggctgcctgggatgctgcctccactgccatcaccttcgtcttccaccagcgttctcatgaggagcagcggggcctccgctgataaccagctggtctgggtgtagctcttagaggaaggagatagggaaaaggggctccttgctccacagggccctgttgaattttgttctctgggagaaaatcatcaagaagggctgcatgatgtttgcccaaaatttattttataagaaaaacttttttggttaaaaaaaagaataaaggtatgaaagggt

SEQ ID NO: 3509 - DNA, 2549 bp, Homo sapiens
gatacgacggcagcgcggcgggaggttcgattgacccggtcttggcgggtcgccgctgcctgcttttgacctttggctcatgggtacttgacgttttaaactcctaggcccaggatgaggaggagcttggctcccagccagctggccaagagaaaacctgaaggcaggtcctgtgatgatgaagactggcaacctggcctagtgactcctaggaaacggaaatccagcagtgagacccagatccaggagtgtttcctgtctccttttcggaaacctttgagtcagctaaccaatcaaccaccttgtctggacagcagtcagcatgaagcatttattcgaagcattttgtcaaagcctttcaaagtccccattccaaattatcaaggtcctctgggctctcgagcattgggcctgaaaagggctggggtccgccgggccctccatgaccccctggaaaaagatgccttggttctgtatgagcctcccccgctgagcgctcatgaccagctgaagcttgacaaggagaaactccctgtccatgtggttgttgaccctattctcagtaaggttttgcggcctcatcagagagagggagtgaaattcctgtgggagtgtgtcaccagtcggcgcatccctggcagccatggctgcatcatggctgatgagatgggcctaggaaagacgctgcagtgcatcacattgatgtggacacttttacgccagagtccagagtgcaagccagaaattgacaaggcagtggtggtgtcgccttccagcctggtgaagaactggtacaatgaggttgggaaatggctcggagggaggatccaacctctggccatcgatggaggatctaaggatgaaatagaccaaaagctggaaggattcatgaaccagcgtggagccagggtgtcttctcccatcctcatcatttcctatgagaccttccgccttcatgttggagtcctccagaaaggaagtgttggtctggtcatatgtgacgagggacacaggctcaagaactctgagaatcagacttaccaagccctggacagcttgaacaccagccggcgggtgctcatctccggaactcccatccagaatgatctgcttgagtatttcagcttggtacattttgttaattccggcatcctagggactgcccatgaattcaagaagcattttgaattgccaattttgaagggtcgagacgctgctgctagtgaggcagacaggcagctaggagaggagcggctgcgggagctcaccagcattgtgaatagatgcctgatacggaggacttctgatatcctttctaaatatctgcctgtgaagattgagcaggtcgtttgttgtaggctgacaccccttcagactgagttatacaagaggtttctgagacaagccaaaccggcagaagaattgcttgagggcaagatgagtgtgtcttccctttcttccatcacctcgctaaagaagctttgtaatcatccagctctaatctatgataagtgtgtggaagaggaggatggctttgtgggtgccttggacctcttccctcctggttacagctctaaggccctggagccccagctgtcaggtaagatgctggtcctggattatattctggcggtgacccgaagccgtagcagtgacaaagtagtgctggtgtcgaattacacccagactttggatctctttgagaagctgtgccgtgcccgaaggtacttatacgtccgcctggatggcacgatgtccattaagaagcgagccaaggttgtagaacgcttcaatagtccatcgagccctgactttgtcttcatgctgagcagcaaagctgggggctgtggcctcaatctcattggggctaaccggctggtcatgtttgaccctgactggaacccagccaatgatgaacaagccatggcccgggtctggcgagatggtcaaaagaagacttgctatatctaccgcctgctgtctgcagggaccattgaggagaagatcttccagcgtcagagccacaagaaggcactgagcagctgtgtggtggatgaggagcaggatgtagagcgccacttctctctgggcgagttgaaggagctgtttatcctggatgaagctagcctcagtgacacacatgacaggttgcactgccgacgttgtgtcaacagccgtcagatccggccaccccctgatggttctgactgcacttcagacctggcagggtggaaccactgcactgataagtgggggctccgggatgaggtactccaggctgcctgggatgctgcctccactgccatcaccttcgtcttccaccagcgttctcatgaggagcagcggggcctccgctgataaccagctggtctgggtgtagctcttagaggaaggagatagggaaaaggggctccttgctccacagggccctgttgaattttgttctctgggagaaaatcatcaagaagggctgcatgatgtttgcccaaaatttattttataagaaaaacttttttggttaaaaaaaagaataaaggtatgaaagggtt

SEQ ID NO: 3510 - DNA, 2486 bp, Homo sapiens
gttaacgcgcgctttgggaacaggaaggttgagagagaggtgctggggtctgcgtctatctctgtcgctcttttcagcccctcctggtattcccctcctaacctgggttttttacacgcccgcgtggcttcctgctcgacctccctgagtctgatcctggtttccacctccagccctgggaaatttcctttctccagactcgccctccccacccgggcctcggactttcaccccagcttctctctcctggccagtgattacccacccccaatcccaccccgccccgccgcgcaactacctcctcccttcacccggactgggaccatcatccccactccactccgcccagtctgggactccacctgcctcctaaccaatcaaccaccttgtctggacagcagtcagcatgaagcatttattcgaagcattttgtcaaagcctttcaaagtccccattccaaattatcaaggtcctctgggctctcgagcattgggcctgaaaagggctggggtccgccgggccctccatgaccccctggaaaaagatgccttggttctgtatgagcctcccccgctgagcgctcatgaccagctgaagcttgacaaggagaaactccctgtccatgtggttgttgaccctattctcagtaaggttttgcggcctcatcagagagagggagtgaaattcctgtgggagtgtgtcaccagtcggcgcatccctggcagccatggctgcatcatggctgatgagatgggcctaggaaagacgctgcagtgcatcacattgatgtggacacttttacgccagagtccagagtgcaagccagaaattgacaaggcagtggtggtgtcgccttccagcctggtgaagaactggtacaatgaggttgggaaatggctcggagggaggatccaacctctggccatcgatggaggatctaaggatgaaatagaccaaaagctggaaggattcatgaaccagcgtggagccagggtgtcttctcccatcctcatcatttcctatgagaccttccgccttcatgttggagtcctccagaaaggaagtgttggtctggtcatatgtgacgagggacacaggctcaagaactctgagaatcagacttaccaagccctggacagcttgaacaccagccggcgggtgctcatctccggaactcccatccagaatgatctgcttgagtatttcagcttggtacattttgttaattccggcatcctagggactgcccatgaattcaagaagcattttgaattgccaattttgaagggtcgagacgctgctgctagtgaggcagacaggcagctaggagaggagcggctgcgggagctcaccagcattgtgaatagatgcctgatacggaggacttctgatatcctttctaaatatctgcctgtgaagattgagcaggtcgtttgttgtaggctgacaccccttcagactgagttatacaagaggtttctgagacaagccaaaccggcagaagaattgcttgagggcaagatgagtgtgtcttccctttcttccatcacctcgctaaagaagctttgtaatcatccagctctaatctatgataagtgtgtggaagaggaggatggctttgtgggtgccttggacctcttccctcctggttacagctctaaggccctggagccccagctgtcaggtaagatgctggtcctggattatattctggcggtgacccgaagccgtagcagtgacaaagtagtgctggtgtcgaattacacccagactttggatctctttgagaagctgtgccgtgcccgaaggtacttatacgtccgcctggatggcacgatgtccattaagaagcgagccaaggttgtagaacgcttcaatagtccatcgagccctgactttgtcttcatgctgagcagcaaagctgggggctgtggcctcaatctcattggggctaaccggctggtcatgtttgaccctgactggaacccagccaatgatgaacaagccatggcccgggtctggcgagatggtcaaaagaagacttgctatatctaccgcctgctgtctgcagggaccattgaggagaagatcttccagcgtcagagccacaagaaggcactgagcagctgtgtggtggatgaggagcaggatgtagagcgccacttctctctgggcgagttgaaggagctgtttatcctggatgaagctagcctcagtgacacacatgacaggttgcactgccgacgttgtgtcaacagccgtcagatccggccaccccctgatggttctgactgcacttcagacctggcagggtggaaccactgcactgataagtgggggctccgggatgaggtactccaggctgcctgggatgctgcctccactgccatcaccttcgtcttccaccagcgttctcatgaggagcagcggggcctccgctgataaccagctggtctgggtgtagctcttagaggaaggagataggg

SEQ ID NO: 3511 - DNA, 2119 bp, Homo sapiens
gggccggcaggggcggtgcgcgggaagggaccccggacccggaggtcgcggagagctgggcagtgttggccgctggcggagcgctggggcagcatgaagtgcctggtcacgggcggcaacgtgaaggtgctcggcaaggccgtccactccctgtcccgcatcggggacgagctctacctggaacccttggaggacgggctctccctccggacggtgaactcctcccgctctgcctatgcctgctttctctttgccccgctcttcttccagcaataccaggcagccacccctggtcaggacctgctgcgctgtaagatcctgatgaagtctttcctgtctgtcttccgctcactggcgatgctggagaagacggtggaaaaatgctgcatctccctgaatggccggagcagccgcctggtggtccagctgcattgcaagttcggggtgcggaagactcacaacctgtccttccaggactgtgagtccctgcaggccgtcttcgacccagcctcgtgcccccacatgctccgcgccccagcacgggttctgggggaggctgttctgcccttctctcctgcactggctgaagtgacgctgggcattggccgtggccgcagggtcatcctgcgcagctaccacgaggaggaggcagacagcactgccaaagccatggtgactgagatgtgccttggagaggaggatttccagcagctgcaggcccaggaaggggtggccatcactttctgcctcaaggaattccgggggctcctgagctttgcagagtcagcaaacttgaatcttagcattcattttgatgctccaggcaggcccgccatcttcaccatcaaggactctttgctggacggccactttgtcttggccacactctcagacaccgactcgcactcccaggacctgggctccccagagcgtcaccagccagtgcctcagctccaggctcacagcacaccccacccggacgactttgccaatgacgacattgactcttacatgatcgccatggaaaccactataggcaatgagggctcgcgggtgctgccctccatttccctttcacctggcccccagccccccaagagccccggtccccactccgaggaggaagatgaggctgagcccagtacagtgcctgggactcccccacccaagaagttccgctcactgttcttcggctccatcctggcccctgtacgctccccccagggccccagccctgtgctggcggaagacagtgagggtgaaggctgaaccaagaacctgaagcctgtacccagaggccttggactagacgaagccccagccagtggcagaactgggtctctcagccctggggatcagaaaggtgggcttgctggagctgagctgtttcactgcctctcgcaggccccagctggctgtcactgtaaagctgtcccacagcggtcgggcctgggccgttatctccccacaacccccagccaatcaggactttccagacttggccctgaactactgacgttcctacctcttatttctcattgagcctcaggctatactccagctggccaaggctggaaacctgtctccctcaggctcaccttcctaaggaaaatgtcatagtaggtgctgctggcccctggtgatccagcttctctgccaatcatgacctgttccttcctgaagtcctgggcatgcatctgggacccccgtggagctgacaagttttccttgctttcctgatactctttggcgctgacttggaattctaagagccttggacccgagtgtgtggctagggttgccctggctggggcccggtgccgagactcccaagcggctctgtgcagaagagctgccaggcagtgtcttagatgtgagacggaggccatggcgagaatccagctttgacctttattcaagagaccagatgggttgccccaggatccggctgccagccctgaggccaagcacggctggagacccacgacctggcctgccgttgccctgagctgcagcctcggccccaggatcctgctcacagtcaccgcaggtgcaggcaggaagcagccctgggggactggacgctgctattgattcattaaaaaaagaaaagaaaaat

SEQ ID NO: 3512 - DNA, 4491 bp, Homo sapiens
agcggcggcgttggcgctcagtccgcggcgcgaggacggccggccggcagggggaggcgggggggcgccgggcagccccgccttttcccgcggaggcgccgagcggccatattgcggagctgtctgcggtggcggcggcgcctctcgtctcccgcgggccagcgctcgcaccaccgcttctccctccctgtcgcagccgcgccgccgcgcagcgccccagccacacgccggcgggcagaagccgcccgctctccggaaagtgataacagaattcattgaagtggagaatttttaaagaaggtaacaaaaagagaaagaaaatgccgaaaccaatcaacgtaagagtaactacaatggatgctgagctggaatttgccattcagcccaatacaactggcaaacaactttttgaccaggtggtgaaaacagttggtttgcgtgaggtctggttttttgggctgcagtatgtagacagcaaaggttattctacatggcttaaactaaataaaaaggtaacacagcaggatgttaaaaaagagaatcctttacagttcaagtttagagctaaattctttcctgaagatgtttctgaggaattaattcaagaaataacccagagactcttcttcttgcaagttaaagaagccatcttaaatgatgagatatattgcccgccagaaactgcagttcttttggcttcctatgctgtccaagccaagtatggagattacaataaagagattcataagccaggctacctggctaatgatagactcctaccccagcgtgtattggaacaacacaaactaacaaaagaacagtgggaagaaagaatacagaactggcatgaagaacatagaggaatgttaagggaggattctatgatggaatacctgaagattgcacaagatctagaaatgtatggagtcaactattttgaaataaaaaataaaaaaggaactgaattgtggctaggtgttgatgctttgggtctgaatatttatgagcatgacgacaagttaacacctaaaattggttttccctggagtgaaatcagaaatatttcatttaatgacaaaaaatttgttataaagccaatcgacaaaaaggcacctgattttgtgttttatgcacctcgtctgagaatcaataagcggattttggccttatgtatgggaaaccatgaactatacatgcgaagaaggaagcctgatactattgaagtacaacagatgaaggctcaggctagggaggagaaacatcagaagcagttggaaagggcacaattagagaatgaaaagaagaaaagagaaatagcagaaaaggaaaaggaaagaatagaacgtgaaaaggaagagctaatggaacgtctaaaacaaattgaagagcagacaattaaagctcagaaagaactagaagaacagactcgaaaagctctagaactggatcaagaacgaaaacgagcaaaagaagaagcagaacgacttgaaaaggagcgtcgagctgctgaagaggcaaagtctgccatagcaaaacaagctgccgaccagatgaagaatcaggagcagctagcagcagaacttgctgaattcactgccaagattgcacttctagaggaagccaagaagaaaaaggaagaggaagctactgagtggcaacacaaagcttttgcagcccaggaagacttggaaaagaccaaagaagagttaaaaactgtgatgtctgccccccctccacctccaccaccaccagtcattcctccaacagaaaacgaacatgatgaacacgatgagaataatgctgaagctagtgctgaattatcaaatgaaggggtaatgaaccatagaagcgaggaagaacgtgtaaccgaaacacagaaaaatgagcgtgttaagaagcaacttcaggcattaagttcagaattagcccaagccagagatgaaaccaagaaaacacaaaatgatgttcttcatgctgagaatgttaaagcaggccgtgataagtacaagactctgcgacagattcgacaaggcaatacaaagcagcgtatcgatgagtttgaagcaatgtgagagctgttattttgcatatatgttcttcataagctgaaccaccaacagagaaaagcaggcctttgcagatatgatggaatgcatcccaccttgccaaagcacttacaccagtttgactgtgctagctaaaagacaaatttaaggggagctcttcaacattaaggcagtatgatatcatgcttggttttcttttttcttttggtccagggaatggagaatggtgttccattgcctcttttcacattttttttctttttcttttttttttctgttgaagattaacactaattatcacgtctgacaaatgtgtatgtgtggtttcagttctgtgtacattttaaaggataatggtgaacattttaatgggtttcccttgccctttccatatttaacctatttccacattctctctcactcacattttctcagtgtgcccttctcttatctgccatgtccatagccataattccaccatcatacagatcaggcagtgtttaaaatgatggtaggtagcacagtggacagtctttgatcatcatgtagaatatggctatgaatcaggaaagagattagaacatttaataatgtatgtacagctggtgcttagtttttttttaatctaaatttaattaccttattggatatttgatatttggttatttaatcacagtcatctttaacagcttacactgattggtgttttatctcctgtgatcctttgatggctttttttgcctaccatttcacagaggtttagacagcagtagtagctccctaggagagtttactgatgaaacagcctctgcaagattttaaaagttttgttcttttatagactgatttagaaaaacaaatgattagttaaaaaaagaaaatatacatttgttggtaactaatgttattttttaaaacctggaccttttctggaagggcagcatataaaaacatcagtcccgaggaggggacaacaatactacctcactactacatctgtgatgactggttgttcaaacacaatggagtgtgtaaggtatatgttttataattcataaccatagcctcgatcatcaagaaatactttcgaaatttcattttccttcagaatatcttaagagtgctaaatttttaactgcctttttgtcgagtcaaactgtgggattctgatttgtattaaaattgtaagctcctcactggtatactatcatcctggaggggtgttgtatggctgagcaagagagagagagaatgagagagagactgtgtgtgtgtgtgtgtgtgtgtgtgtgtgtactctgtgtgtgtatgagagagagaaatgctaaccttgtagcatgtgaagaatgtctgtaccttgatacgatagttacataatcagtatatttggtttctagatcactgtgcttattttgtttcaatctctgactaaaaatacttaaatttggtttgttaattcttattttagaaattataattttagtttatattaatttcggttatagcttactgaagaaatctttccagttagaaggaggttctaatattcacatgttctaatactttgtttattgtaaaacagctaaatttggagatacgtaaagccttgttttctctgtgtggttcagctactttccatttggtattacacagtcaaatttacatttatctattaaaattgccattttattaaacattttcatgcacagtagattcaagttgtgtctgaaaatatctcttgtgcttttttgattttgctgactttaaaaggattaatctgggcagacattatgtaaaagaaaggttgcgtttaatatattttttgaactttgtaggacaaaacatagctggttaaccttgaagtgactgttgtaccatggttgtgcacatgcttcagaatcctatggaagagaatattcctacttgcagtacatcaaaggaatggatggtggaccctactattcatgttttgagacataaatgttcactttaaagcaattgcataatagataaaaacctgaactttcattggatttttgttaattttcctcattttgaattatgtgcactaccatagctacatcagtttgatacagtattgaaaaattatcagttatattttgctgtttatgatctatttgtagattaggattaaaatggatttaatccatttttaaggctgtgtgaatttttctaaacaagaaccatttgcaatatggatttcttagagattaaaccaattataacttattagcagtcgcgagcacatgttcatatagtcaatgtaaaaatacactaatgagtatttggtaaatcccagtaggcttttaccattagcataattttgtgttgtacaattaagttacaattacatctctaattttggataatattcattggttaacaataaagtgacaaaagctca

SEQ ID NO: 3513 - DNA, 2761 bp, Homo sapiens
ttggcgctcagtccgcggcgcgaggacggccggccggcagggggaggcgggggggcgccgggcagccccgccttttcccgcggaggcgccgagcggccatattgcggagctgtctgcggtggcggcggcgcctctcgtctcccgcgggccagcgctcgcaccaccgcttctccctccctgtcgcagccgcgccgccgcgcagcgccccagccacacgccggcgggcagaagccgcccgctctccggaaagtgataacagaattcattgaagtggagaatttttaaagaaggtaacaaaaagagaaagaaaatgccgaaaccaatcaacgtaagagtaactacaatggatgctgagctggaatttgccattcagcccaatacaactggcaaacaactttttgaccaggtggtgaaaacagttggtttgcgtgaggtctggttttttgggctgcagtatgtagacagcaaaggttattctacatggcttaaactaaataaaaaggtaacacagcaggatgttaaaaaagagaatcctttacagttcaagtttagagctaaattctttcctgaagatgtttctgaggaattaattcaagaaataacccagagactcttcttcttgcaagttaaagaagccatcttaaatgatgagatatattgcccgccagaaactgcagttcttttggcttcctatgctgtccaagccaagtatggagattacaataaagagattcataagccaggctacctggctaatgatagactcctaccccagcgtgtattggaacaacacaaactaacaaaagaacagtgggaagaaagaatacagaactggcatgaagaacatagaggaatgttaagggaggattctatgatggaatacctgaagattgcacaagatctagaaatgtatggagtcaactattttgaaataaaaaataaaaaaggaactgaattgtggctaggtgttgatgctttgggtctgaatatttatgagcatgacgacaagttaacacctaaaattggttttccctggagtgaaatcagaaatatttcatttaatgacaaaaaatttgttataaagccaatcgacaaaaaggcacctgattttgtgttttatgcacctcgtctgagaatcaataagcggattttggccttatgtatgggaaaccatgaactatacatgcgaagaaggaagcctgatactattgaagtacaacagatgaaggctcaggctagggaggagaaacatcagaagcagttggaaagggcacaattagagaatgaaaagaagaaaagagaaatagcagaaaaggaaaaggaaagaatagaacgtgaaaaggaagagctaatggaacgtctaaaacaaattgaagagcagacaattaaagctcagaaagaactagaagaacagactcgaaaagctctagaactggatcaagaacgaaaacgagcaaaagaagaagcagaacgacttgaaaaggagcgtcgagctgctgaagaggcaaagtctgccatagcaaaacaagctgccgaccagatgaagaatcaggagcagctagcagcagaacttgctgaattcactgccaagattgcacttctagaggaagccaagaagaaaaaggaagaggaagctactgagtggcaacacaaagcttttgcagcccaggaagacttggaaaagaccaaagaagagttaaaaactgtgatgtctgccccccctccacctccaccaccaccagtcattcctccaacagaaaacgaacatgatgaacacgatgagaataatgctgaagctagtgctgaattatcaaatgaaggggtaatgaaccatagaagcgaggaagaacgtgtaaccgaaacacagaaaaatgagcgtgttaagaagcaacttcaggcattaagttcagaattagcccaagccagagatgaaaccaagaaaacacaaaatgatgttcttcatgctgagaatgttaaagcaggccgtgataagtacaagactctgcgacagattcgacaaggcaatacaaagcagcgtatcgatgagtttgaagcaatgtggggacccaaactgtatgcattgttccagatgcgctcttgccaaagcagcataaagcaaatgtaacccttaggaagaaggctccctccctcactaggcccctggctactgacttatgggaagctttaggataaggacatacctggtgttctgaatgtgtatatcccccaaagtctgcaatctcagctggaactggatggaccagtattccattacccagggccctggctcatggttctctcctcttctcagtttactgttggatttccctttcttgctattctctttctctccagacccctctcaattgcctttcctaaagacagaccttagcaagatgggccaggacttgggacttcgcacagcaccctgcagtcccaagccagcatctactgcaccccatcttcaggactctatcccccaaacatgctggaaggcatcagcttatgagaacccacttttttctgcatgactagcttgtaaggaagaatctatggacaggatttccaagaatttcccactttttcaaaaaatgtatgtgacttatatttggcttcaatccaagagcaaactcagtggtgaacagctccatttctgtgcacatgttggtggaatctgcagaaatcgatgcaacatttctttcctgtctgggctgtttgtataattgtatataaatgtagcaataaatatattctaacatca

SEQ ID NO: 3514 - DNA, 1017 bp, Homo sapiens
ccacacccaaagatcaacgtaagagtaactacaatggatgctgagctggaatttgccattcagcccaatacaactggcaaacaactttttgaccaggtggtgaaaacagttggtttgcgtgaggtctggttttttgggctgcagtatgtagacagcaaaggttattctacatggcttaaactaaataaaaaggtaacacagcaggatgttaaaaaagagaatcctttacagttcaagtttagagctaaattctttcctgaagatgtttctgaggaattaattcaagaaataacccagagactcttcttcttgcaagttaaagaagccatcttaaatgatgagatatattgcccgccagaaactgcagttcttttggcttcctatgctgtccaagccaagtatggagattacaataaagagattcataagccaggctacctggctaatgatagactcctaccccagcgtgtattggaacaacacaaactaacaaaagaacagtgggaagaaagaatacagaactggcatgaagaacatagaggaatgttaagggaggattctatgatggaatacctgaagattgcacaagatctagaaatgtatggagtcaactattttgaaataaaaaataaaaaaggaactgaattgtggctaggtgttgatgctttgggtctgaatatttatgagcatgacgacaagttaacacctaaaattggttttccctggagtgaaatcagaaatatttcatttaatgacaaaaaatttgttataaagccaatcgacaaaaaggcacctgattttgtgttttatgcacctcgtctgagaatcaataagcggattttggccttatgtatgggaaaccatgaactatacatgcgaagaaggaagcctgatactattgaagtacaacagatgaaggctcaggctagggaggagaaacatcagaagcagttggaaaggagtaggctatctaaaataaaaaaaaaaaaaagaaaaaagaaaaagaaaaagaaaaag

SEQ ID NO: 3515 - DNA, 2511 bp, Homo sapiens
ttggcgctcagtccgcggcgcgaggacggccggccggcagggggaggcgggggggcgccgggcagccccgccttttcccgcggaggcgccgagcggccatattgcggagctgtctgcggtggcggcggcgcctctcgtctcccgcgggccagcgctcgcaccaccgcttctccctccctgtcgcagccgcgccgccgcgcagcgccccagccacacgccggcgggcagaagccgcccgctctccggaaagtgataacagaattcattgaagtggagaatttttaaagaaggtaacaaaaagagaaagaaaatgccgaaaccaatcaacgtaagagtaactacaatggatgctgagctggaatttgccattcagcccaatacaactggcaaacaactttttgaccaggtggtgaaaacagttggtttgcgtgaggtctggttttttgggctgcagtatgtagacagcaaaggttattctacatggcttaaactaaataaaaaggtaacacagcaggatgttaaaaaagagaatcctttacagttcaagtttagagctaaattctttcctgaagatgtttctgaggaattaattcaagaaataacccagagactcttcttcttgcaagttaaagaagccatcttaaatgatgagatatattgcccgccagaaactgcagttcttttggcttcctatgctgtccaagccaagtatggagattacaataaagagattcataagccaggctacctggctaatgatagactcctaccccagcgtgtattggaacaacacaaactaacaaaagaacagtgggaagaaagaatacagaactggcatgaagaacatagaggaatgttaagggaggattctatgatggaatacctgaagattgcacaagatctagaaatgtatggagtcaactattttgaaataaaaaataaaaaaggaactgaattgtggctaggtgttgatgctttgggtctgaatatttatgagcatgacgacaagttaacacctaaaattggttttccctggagtgaaatcagaaatatttcatttaatgacaaaaaatttgttataaagccaatcgacaaaaaggcacctgattttgtgttttatgcacctcgtctgagaatcaataagcggattttggccttatgtatgggaaaccatgaactatacatgcgaagaaggaagcctgatactattgaagtacaacagatgaaggctcaggctagggaggagaaacatcagaagcagttggaaagggcacaattagagaatgaaaagaagaaaagagaaatagcagaaaaggaaaaggaaagaatagaacgtgaaaaggaagagctaatggaacgtctaaaacaaattgaagagcagacaattaaagctcagaaagaactagaagaacagactcgaaaagctctagaactggatcaagaacgaaaacgagcaaaagaagaagcagaacgacttgaaaaggagcgtcgagctgctgaagaggcaaagtctgccatagcaaaacaagctgccgaccagatgaagaatcaggagcagctagcagcagaacttgctgaattcactgccaagattgcacttctagaggaagccaagaagaaaaaggaagaggaagctactgagtggcaacacaaagcttttgcagcccaggaagacttggaaaagaccaaagaagagttaaaaactgtgatgtctgccccccctccacctccaccaccaccagtcattcctccaacagaaaacgaacatgatgaacacgatgagaataatgctgaagctagtgctgaattatcaaatgaaggggtaatgaaccatagaagcgaggaagaacgtgtaaccgaaacacagaaaaatgagcgtgttaagaagcaacttcaggcattaagttcagaattagcccaagccagagatgaaaccaagaaaacacaaaatgatgttcttcatgctgagaatgttaaagcaggccgtgataagtacaagactctgcgacagattcgacaaggcaatacaaagcagcgtatcgatgagtttgaagcaatgtggggacccaaactgtatgcattgttccagatgcgctcttgccaaagcagcataaagcaaatgtaacccttaggaagaaggctccctccctcactagggctacaaagaatgctagagtggagacaagagtccagactctgaaataacctcctttggacacagaagctaccactgttgcttatcagacgcagcgggccctgggtttttctggggccttaagcagtgaaccctggtcagctggcctgagtcccaacccaagcccatcaccacaagcctcaagacaggaagatctcagtgaaacctttcctctaatccaagtgacatcattgtcgcaggtgtttgtacatgaaagcagagtgatgaaggtgtgtgggtccacggaagaagtaaaaatacagcactagttcatatttttcctagtctctccctgttcccaggtaaagttatagcat

SEQ ID NO: 3516 - DNA, 1814 bp, Homo sapiens
ttggcgctcagtccgcggcgcgaggacggccggccggcagggggaggcgggggggcgccgggcagccccgccttttcccgcggaggcgccgagcggccatattgcggagctgtctgcggtggcggcggcgcctctcgtctcccgcgggccagcgctcgcaccaccgcttctccctccctgtcgcagccgcgccgccgcgcagcgccccagccacacgccggcgggcagaagccgcccgctctccggaaagtgataacagaattcattgaagtggagaatttttaaagaaggtaacaaaaagagaaagaaaatgccgaaaccaggcacaattagagaatgaaaagaagaaaagagaaatagcagaaaaggaaaaggaaagaatagaacgtgaaaaggaagagctaatggaacgtctaaaacaaattgaagagcagacaattaaagctcagaaagaactagaagaacagactcgaaaagctctagaactggatcaagaacgaaaacgagcaaaagaagaagcagaacgacttgaaaaggagcgtcgagctgctgaagaggcaaagtctgccatagcaaaacaagctgccgaccagatgaagaatcaggagcagctagcagcagaacttgctgaattcactgccaagattgcacttctagaggaagccaagaagaaaaaggaagaggaagctactgagtggcaacacaaagcttttgcagcccaggaagacttggaaaagaccaaagaagagttaaaaactgtgatgtctgccccccctccacctccaccaccaccagtcattcctccaacagaaaacgaacatgatgaacacgatgagaataatgctgaagctagtgctgaattatcaaatgaaggggtaatgaaccatagaagcgaggaagaacgtgtaaccgaaacacagaaaaatgagcgtgttaagaagcaacttcaggcattaagttcagaattagcccaagccagagatgaaaccaagaaaacacaaaatgatgttcttcatgctgagaatgttaaagcaggccgtgataagtacaagactctgcgacagattcgacaaggcaatacaaagcagcgtatcgatgagtttgaagcaatgtggggacccaaactgtatgcattgttccagatgcgctcttgccaaagcagcataaagcaaatgtaacccttaggaagaaggctccctccctcactaggcccctggctactgacttatgggaagctttaggataaggacatacctggtgttctgaatgtgtatatcccccaaagtctgcaatctcagctggaactggatggaccagtattccattacccagggccctggctcatggttctctcctcttctcagtttactgttggatttccctttcttgctattctctttctctccagacccctctcaattgcctttcctaaagacagaccttagcaagatgggccaggacttgggacttcgcacagcaccctgcagtcccaagccagcatctactgcaccccatcttcaggactctatcccccaaacatgctggaaggcatcagcttatgagaacccacttttttctgcatgactagcttgtaaggaagaatctatggacaggatttccaagaatttcccactttttcaaaaaatgtatgtgacttatatttggcttcaatccaagagcaaactcagtggtgaacagctccatttctgtgcacatgttggtggaatctgcagaaatcgatgcaacatttctttcctgtctgggctgtttgtataattgtatataaatgtagcaataaatatattctaacatca

SEQ ID NO: 3517 - DNA, 793 bp, Homo sapiens
ggcgggaggattgctcgagcccatgagttcgaggctgcagtgagcttctgcacttcagcctgggcaacagagcgagaccctgtctcaagaaaacaaagagaactagaagaacagactcgaaaagctctagaactggatcaagaacgaaaacgagcaaaagaagaagcagaacgacttgaaaaggagcgtcgagctgctgaagaggcaaagtctgccatagcaaaacaagctgccgaccagatgaagaatcaggagcagctagcagcagaacttgctgaattcactgccaagattgcacttctagaggaagccaagaagaaaaaggaagaggaagctactgagtggcaacacaaagcttttgcagcccaggaagacttggaaaagaccaaagaagagttaaaaactgtgatgtctgccccccctccacctccaccaccaccagtcattcctccaacagaaaacgaacatgatgaacacgatgagaataatgctgaagctagtgctgaattatcaaatgaaggggtaatgaaccatagaagcgaggaagaacgtgtaaccgaaacacagaaaaatgagcgtgttaagaagcaacttcaggcattaagttcagaattagcccaagccagagatgaaaccaagaaaacacaaaatgatgttcttcatgctgagaatgttaaagcaggccgtgataagtacaagactctgcgacagattcgacaaggcaatacaaagcagcgtatcgatgagtttgaagcaatgtgagagctgttattttgcatatatgttcttcata

SEQ ID NO: 3518 - DNA, 1549 bp, Homo sapiens
ttggcgctcagtccgcggcgcgaggacggccggccggcagggggaggcgggggggcgccgggcagccccgccttttcccgcggaggcgccgagcggccatattgcggagctgtctgcggtggcggcggcgcctctcgtctcccgcgggccagcgctcgcaccaccgcttctccctccctgtcgcagccgcgccgccgcgcagcgccccagccacacgccggcgggcagaagccgcccgctctccggaaagtgataacagaattcattgaagtggagaatttttaaagaaggtaacaaaaagagaaagaaaatgccgaaaccaatcaacgtaagagtaactacaatggatgctgagctggaatttgccattcagcccaatacaactggcaaacaactttttgaccaggtaacacagcaggatgttaaaaaagagaatcctttacagttcaagtttagagctaaattctttcctgaagatgtttctgaggaattaattcaagaaataacccagagactcttcttcttgcaagttaaagaagccatcttaaatgatgagatatattgcccgccagaaactgcagttcttttggcttcctatgctgtccaagccaagtatggagattacaataaagagattcataagccaggctacctggctaatgatagactcctaccccagcgtgtattggaacaacacaaactaacaaaagaacaagatgaaaccaagaaaacacaaaatgatgttcttcatgctgagaatgttaaagcaggccgtgataagtacaagactctgcgacagattcgacaaggcaatacaaagcagcgtatcgatgagtttgaagcaatgtggggacccaaactgtatgcattgttccagatgcgctcttgccaaagcagcataaagcaaatgtaacccttaggaagaaggctccctccctcactaggcccctggctactgacttatgggaagctttaggataaggacatacctggtgttctgaatgtgtatatcccccaaagtctgcaatctcagctggaactggatggaccagtattccattacccagggccctggctcatggttctctcctcttctcagtttactgttggatttccctttcttgctattctctttctctccagacccctctcaattgcctttcctaaagacagaccttagcaagatgggccaggacttgggacttcgcacagcaccctgcagtcccaagccagcatctactgcaccccatcttcaggactctatcccccaaacatgctggaaggcatcagcttatgagaacccacttttttctgcatgactagcttgtaaggaagaatctatggacaggatttccaagaatttcccactttttcaaaaaatgtatgtgacttatatttggcttcaatccaagagcaaactcagtggtgaacagctccatttctgtgcacatgttggtggaatctgcagaaatcgatgcaacatttctttcctgtctgggctgtttgtataattgtatataaatgtagcaataaatatattctaacatca

SEQ ID NO: 3519 - DNA, 2558 bp, Homo sapiens
ttggcgctcagtccgcggcgcgaggacggccggccggcagggggaggcgggggggcgccgggcagccccgccttttcccgcggaggcgccgagcggccatattgcggagctgtctgcggtggcggcggcgcctctcgtctcccgcgggccagcgctcgcaccaccgcttctccctccctgtcgcagccgcgccgccgcgcagcgccccagccacacgccggcgggcagaagccgcccgctctccggaaagtgataacagaattcattgaagtggagaatttttaaagaaggtaacaaaaagagaaagaaaatgccgaaaccaatcaacgtaagagtaactacaatggatgctgagctggaatttgccattcagcccaatacaactggcaaacaactttttgaccaggtggtgaaaacagttggtttgcgtgaggtctggttttttgggctgcagtatgtagacagcaaaggttattctacatggcttaaactaaataaaaaggtaacacagcaggatgttaaaaaagagaatcctttacagttcaagtttagagctaaattctttcctgaagatgtttctgaggaattaattcaagaaataacccagagactcttcttcttgcaagttaaagaagccatcttaaatgatgagatatattgcccgccagaaactgcagttcttttggcttcctatgctgtccaagccaagtatggagattacaataaagagattcataagccaggctacctggctaatgatagactcctaccccagcgtgtattggaacaacacaaactaacaaaagaacagtgggaagaaagaatacagaactggcatgaagaacatagaggaatgttaagggaggattctatgatggaatacctgaagattgcacaagatctagaaatgtatggagtcaactattttgaaataaaaaataaaaaaggaactgaattgtggctaggtgttgatgctttgggtctgaatatttatgagcatgacgacaagttaacacctaaaattggttttccctggagtgaaatcagaaatatttcatttaatgacaaaaaatttgttataaagccaatcgacaaaaaggcacctgattttgtgttttatgcacctcgtctgagaatcaataagcggattttggccttatgtatgggaaaccatgaactatacatgcgaagaaggaagcctgatactattgaagtacaacagatgaaggctcaggctagggaggagaaacatcagaagcagttggaaagggcacaattagagaatgaaaagaagaaaagagaaatagcagaaaaggaaaaggaaagaatagaacgtgaaaaggaagagctaatggaacgtctaaaacaaattgaagagcagacaattaaagctcagaaagaactagaagaacagactcgaaaagctctagaactggatcaagaacgaaaacgagcaaaagaagaagcagaacgacttgaaaaggagcgtcgagctgctgaagaggcaaagtctgccatagcaaaacaagctgccgaccagatgaagaatcaggagcagctagcagcagaacttgctgaattcactgccaagattgcacttctagaggaagccaagaagaaaaaggaagaggaagctactgagtggcaacacaaagcttttgcagcccaggaagacttggaaaagaccaaagaagagttaaaaactgtgatgtctgccccccctccacctccaccaccaccagtcattcctccaacagaaaacgaacatgatgaacacgatgagaataatgctgaagctagtgctgaattatcaaatgaaggggtaatgaaccatagaagcgaggaagaacgtgtaaccgaaacacagaaaaatgagcgtgttaagaagcaacttcaggcattaagttcagaattagcccaagccagagatgaaaccaagaaaacacaaaatgatgttcttcatgctgagaatgttaaagcaggccgtgataagtacaagactctgcgacagattcgacaaggcaatacaaagcagcgtatcgatgagtttgaagcaatgtggggacccaaactgtatgcattgttccagatgcgctcttgccaaagcagcataaagcaaatgtaacccttaggaagaaggctccctccctcactaggccactgctgcaggacagtgaagctgacttaaaatgcccctgccctgggctacaaagaatgctagagtggagacaagagtccagactctgaaataacctcctttggacacagaagctaccactgttgcttatcagacgcagcgggccctgggtttttctggggccttaagcagtgaaccctggtcagctggcctgagtcccaacccaagcccatcaccacaagcctcaagacaggaagatctcagtgaaacctttcctctaatccaagtgacatcattgtcgcaggtgtttgtacatgaaagcagagtgatgaaggtgtgtgggtccacggaagaagtaaaaatacagcactagttcatatttttcctagtctctccctgttcccaggtaaagttatagcat

SEQ ID NO: 3520 - DNA, 1725 bp, Homo sapiens
aagaaggtaacaaaaagagaaagaaaatgccgaaaccaatcaacgtaagagtaactacaatggatgctgagctggaatttgccattcagcccaatacaactggcaaacaactttttgaccagtgtattggaacaacacaaactaacaaaagaacagtgggaagaaagaatacagaactggcatgaagaacatagaggaatgttaagggaggattctatgatggaatacctgaagattgcacaagatctagaaatgtatggagtcaactattttgaaataaaaaataaaaaaggaactgaattgtggctaggtgttgatgctttgggtctgaatatttatgagcatgacgacaagttaacacctaaaattggttttccctggagtgaaatcagaaatatttcatttaatgacaaaaaatttgttataaagccaatcgacaaaaaggcacctgattttgtgttttatgcacctcgtctgagaatcaataagcggattttggccttatgtatgggaaaccatgaactatacatgcgaagaaggaagcctgatactattgaagtacaacagatgaaggctcaggctagggaggagaaacatcagaagcagttggaaagggcacaattagagaatgaaaagaagaaaagagaaatagcagaaaaggaaaaggaaagaatagaacgtgaaaaggaagagctaatggaacgtctaaaacaaattgaagagcagacaattaaagctcagaaagaactagaagaacagactcgaaaagctctagaactggatcaagaacgaaaacgagcaaaagaagaagcagaacgacttgaaaaggagcgtcgagctgctgaagaggcaaagtctgccatagcaaaacaagctgccgaccagatgaagaatcaggagcagctagcagcagaacttgctgaattcactgccaagattgcacttctagaggaagccaagaagaaaaaggaagaggaagctactgagtggcaacacaaagcttttgcagcccaggaagacttggaaaagaccaaagaagagttaaaaactgtgatgtctgccccccctccacctccaccaccaccagtcattcctccaacagaaaacgaacatgatgaacacgatgagaataatgctgaagctagtgctgaattatcaaatgaaggggtaatgaaccatagaagcgaggaagaacgtgtaaccgaaacacagaaaaatgagcgtgttaagaagcaacttcaggcattaagttcagaattagcccaagccagagatgaaaccaagaaaacacaaaatgatgttcttcatgctgagaatgttaaagcaggccgtgataagtacaagactctgcgacagattcgacaaggcaatacaaagcagcgtatcgatgagtttgaagcaatgtgagagctgttattttgcatatatgttcttcataagctgaaccaccaacagagaaaagcaggcctttgcagatatgatggaatgcatcccaccttgccaaagcacttacaccagtttgactgtgctagctaaaagacaaatttaaggggagctcttcaacattaaggcagtatgatatcatgcttggttttcttttttcttttggtccagggaatggagaatggtgttccattgcctcttttcacattttttttctttttcttttttttttctgttgaagattaacactaattatcacgtctgacaaatgtgtatgtgtgg

SEQ ID NO: 3521 - DNA, 6085 bp, Homo sapiens
ccttttctgggcaccgccttctgctagggggttgtagatgaaagtgcctgctcccagagaagcttgtctaacctagcacagtttctaagctacccaggctgccagaccgagcgaccgtgctgccatggacacagactctcagcgttctcatctctcttccttcaccatgaagctgatggacaaattccactcacccaaaatcaagagaacgccatcaaagaagggaaaaccagctgaggtgtccgtaaagattccagagaagcctgtgaacaaagaggcaacagacagatttctaccagagggctaccctctccccttggatctggagcagcaggcagtagaatttatgtccaccagtgctgtggcttccaggtctcaaaggcagaagaacctgagctggctggaggagaaagagaaggaagttgtcagtgccctgcgctactttaagaccattgtggacaaaatggcaattgataagaaggtactggagatgcttccagggtcagccagcaaggtgctggaggccatcttacccctggtgcagaacgatcctcgaattcagcacagctcagccctctcttcctgctatagccgagtgtaccaaagcctcgccaacctcattcgctggtctgaccaagtgatgctggaaggcgtgaactcagaagacaaggagatggtgacgactgtgaagggggtcatcaaggctgtgctggatggagtgaaggagctggtcaggctcaccatcgagaagcagggacgtccgtctccgacgagccccgtgaagcccagttcccctgccagcaagcctgatggcccagcagagctccccctgacagaccgcgaggtagagatcctaaacaagacgactgggatgtcacagtcaactgagctcctcccagatgccacggatgaagaggtcgcgccccccaagcctcctctgcctggcattcgggtggttgataatagtcctccaccagcattgccacccaagaaaagacagtcggcgccgtcccctacccgagtggctgtggtggcccccatgagccgagccaccagtggctccagtttgcctgttggaatcaataggcaggattttgatgttgactgttacgcacagaggcgactgtcaggaggcagccactcatatggtggagagtcgccccgcctctccccctgcagcagcataggcaagctcagcaagtcagacgagcagctgtcctctctggacagggacagtgggcagtgctcccggaacacaagctgtgaaacactagaccactatgatcccgactatgaattcctccagcaagacctctctaacgcagaccagatacctcagcagacggcctggaaccttagcccgttgccagagtctttgggggagtctgggtctccatttcttggccctcctttccagctgcctcttggcggccatccccagccagacggacctctggccccagggcagcagacagatacgccacctgctctccccgagaagaagcgcaggagcgcagcctcccagacggcggacggctctggctgcagggtgtcctacgagcggcatccctcgcagtatgacaacatctctggggaggacctgcagagcacagccccgatcccatccgtcccctacgcgccctttgctgctattctgccctttcagcatggaggttcctcagcccctgtcgaatttgtgggtgattttactgctcctgagtcaaccggtgacccagaaaaaccacctcctctaccagagaagaaaaacaaacacatgctggcctacatgcagttgctggaggactactcggagccgcagccctctatgttctaccagacgccacagaacgagcacatctaccagcagaagaacaagctcctcatggaggtatacggcttcagcgactccttcagtggggtggactccgtgcaggagctggccccgccgcccgccctaccccccaagcagcggcagctggagccaccggctgggaaagacggacatcccagagatccctcagcggtcagcggcgtccctgggaaggacagcagagacggcagtgagagggccccaaagtcaccagatgctctggagtcggctcagtcggaggaggaagtggacgagctgtccctcattgaccacaacgaaattatgtccaggctgacgctcaagcaggagggtgatgacgggccggacgtccgcggaggatctggggacatcttactggtccatgctactgagactgacaggaaagatttggtgttgtactgcgaggcattcctgaccacctacaggaccttcatctccccagaggagctcatcaagaagctgcagtacagatatgagaaattctctccctttgccgacacattcaagaagcgcgtcagcaagaacacgttcttcgtgctggtacgggtggtggatgagctctgcctggtggagttgacagaagagatcctgaagctgctgatggaactggtcttccgcctggtgtgcaatggggagctgagcctggcccgtgtgctccggaagaacatcctggacaaggtggaccagaagaagctactcaggtgtgccacctccagccagcccctggcagcccggggggtagcagccaggccggggaccttgcacgactttcacagccatgagatagcggagcagctaacgctgctggatgctgagctcttctataaaatagagattcctgaggttttgctttgggcaaaagagcagaatgaggagaagagccccaacttgacccagttcacggagcacttcaacaacatgtcctactgggtccggtccataatcatgttacaggaaaaggcccaggacagggaacggctgctcttgaagttcatcaagatcatgaagcacttgcggaagctgaataacttcaactcctacttggccatcctctctgccctggactcggcgcccatccgcaggctggagtggcagaagcagacttcagagggcctggccgagtactgcacactgatcgacagctcgtcctccttccgagcctaccgggccgccctctcggaggtggaaccgccgtgcatcccgtacctggggctgatcctgcaggacctgaccttcgttcacctgggaaacccagactacatcgacgggaaagtgaacttctccaagcggtggcagcagttcaacatcctcgacagcatgcgctgcttccagcaggcgcactatgacatgcggaggaacgacgacattataaacttcttcaatgacttcagtgaccacctggctgaggaggccctatgggaactgtctctgaaaattaaacccaggaacataacaaggagaaaaacagaccgggaagagaagacctaggagcagacgccgggatccaggagaatgctcgaggggcgcagagggcagctcccagaccggagaggaccttggacctgttaggcgcatggcaggagtcccggcctcggagccatgaggctggccagccctcagcggggccgggcgggagctggagcctgccagccgcttcctgcctccttcctctgtgggagcagacccgtgggcctcagggcagccagcaggcaggtcttgttgccaatttacaaaccggtggttttctggtttggttttgttttctgcttttacttccatctctcccctcttgaccttccacccactcccctccagggagagagcagcagagacctcatcagcagaccaaggaagtggtgggtgctccccctccctaagctccagggtccctgaatcttctgaaatctcaaatgagtggaggcctcctggggtggcctgtcctgcaggggccctggaatgggggcaagcagctgggtgggcagaatgcagagtagactcgggggaggatcctttcactttccgcttccccttctgatgcatggaggatggtgtgagcttttcagcaggcccggaaaggtacgcaggtgacgccttagcagccccgcagctggtgctctgccccgcggtactggcgccatcagggcctcccttgcccgcctgagagcagcagcagtctctgtcatcccgtcgccccttaccccccaccccaggccactgggcccctcccacaccacctggggagctgagaagaggaggctggagtaagggaggacttgatcatccaagaaatactttttattgctgggagtcttctgaacctcaccaaactgaggccagagctgagctcctgggggagttaattcagaggggagaggccagcacctccctcctccatcgctcgctgtgtgccttaaactccatctcatgtccctccccatcccctggctttccctccctccttgccccatcctgggccagccagcagggctcctcctctggctcttcagacctttcagccagtgctgtcagtgcccctgggagggaagggcatccctgaggcacccgaatggtccctcagggtgcagggaggcagaagcctggccacagaggagcctcctaaggcagcagctgcagcaagcgcaccctctccccactctccccacgccagagcggcttccagagcagatgctgtttccatcctcctcgtcaaaaccattctcgctgctgagcttgacaatctgggcaaggcttgtggggcgcttgacaaacagaatctgccctgtgccgcctggttccgtggcctccagcatgagcctgcaggcagggcgctgcgggaacccagttgtgctgccccagcccatgcctccgggtctgctgtgcatgaatgagtgctcacttgtcccgggtttaggacgtggtcaagtgaacagcagggtctaactgtgcttacttagcccagttcaaacagaacaaaggaaaaatatagaaagcaacatctgttgatcatttaggtttttttttaaaccaccatgtcactttgagtccttcatgggtttttgaacagcatttatcaagaagaaaatgtgggctttttcccctctcccgtgttttgtttgtcctgtagatagagggaggaaagccgtgcagtggcaggcgggaccccctctggtggcgggaccccctcttgcggtggtcttgcggggccagccgggacctgtcactttattatttaaggagtgtgtgtgtagagtcgctggcttattaacagtattgtgtgtgggttgggtttttagtttgttccttctttttgaagtcccttcatttcaatccttgactctctctccccttcccttgcccagctctgttgaatgctgctgtgcgcgtgtgagggccgctctgcacacagggcccttgggttgtgtgaactgaaattctccctgtatttgtgagactcgcaggagtccccatctgtagcacaggcaatgccagtgccatgctgcagcctcagaaaccaggcctctcactccagcagcaggcagaaccgtgtctgtggtcgggtgctgtccacagctctgtctgccttgttcttgggcttgagctggatagaggtggggtctcttcaccttccctgaattcagaacagaccctgtgcctggccccagtgtgcccaggcaattccccaggccctcactgggagcccttggtgttctgagcagcagggcccaggcagcacatgagcagtgcccaggggctccctgcgtgaggacggcaaggtgcgatgtatgtctaacttattgatggcaggcagccccctgtgccccctaagcctggccctggttattgctgagctctgtgctcagtgctgcggcctggccgtggctcgtctgttcctttggggggcccgggcgggttgtgggaatcagtcttcacagacagacgtgagccaggcggaggactcgttccttgcagaggtcagtcctcacctgcaggtgtcggggtgtgggggggcaaggaggggcaggcacacaccatgtctgacctgaacccgattctggggagcatcttcccgctccggccccacgacctccacagggttacattgtaatatatatgccccagctaacctgtctgatggtggcatcttcctgcagacatttcaaacatgtaacttttatatgaaaaaaaataaacacagatgaaagctgcccaatgcca

SEQ ID NO: 3522 - DNA, 6329 bp, Homo sapiens
gagattcctcaggcttcccttgtgaggctgcctgggttctgccgctgggtggtttgggatgtccaagagatatcccctttcagccagtgactcggtcctcagttgctgctccggaaagacgctggggctgggaagggccctgtgtcctctggctttaaaatgggcaatgctattgaaaaacagaagcccttgaaacgaagtcatctgtacccctggaaacaagactctcagcgttctcatctctcttccttcaccatgaagctgatggacaaattccactcacccaaaatcaagagaacgccatcaaagaagggaaaaccagctgaggtgtccgtaaagattccagagaagcctgtgaacaaagaggcaacagacagatttctaccagagggctaccctctccccttggatctggagcagcaggcagtagaatttatgtccaccagtgctgtggcttccaggtctcaaaggcagaagaacctgagctggctggaggagaaagagaaggaagttgtcagtgccctgcgctactttaagaccattgtggacaaaatggcaattgataagaaggtactggagatgcttccagggtcagccagcaaggtgctggaggccatcttacccctggtgcagaacgatcctcgaattcagcacagctcagccctctcttcctgctatagccgagtgtaccaaagcctcgccaacctcattcgctggtctgaccaagtgatgctggaaggcgtgaactcagaagacaaggagatggtgacgactgtgaagggggtcatcaaggctgtgctggatggagtgaaggagctggtcaggctcaccatcgagaagcagggacgtccgtctccgacgagccccgtgaagcccagttcccctgccagcaagcctgatggcccagcagagctccccctgacagaccgcgaggtagagatcctaaacaagacgactgggatgtcacagtcaactgagctcctcccagatgccacggatgaagaggtcgcgccccccaagcctcctctgcctggcattcgggtggttgataatagtcctccaccagcattgccacccaagaaaagacagtcggcgccgtcccctacccgagtggctgtggtggcccccatgagccgagccaccagtggctccagtttgcctgttggaatcaataggcaggattttgatgttgactgttacgcacagaggcgactgtcaggaggcagccactcatatggtggagagtcgccccgcctctccccctgcagcagcataggcaagctcagcaagtcagacgagcagctgtcctctctggacagggacagtgggcagtgctcccggaacacaagctgtgaaacactagaccactatgatcccgactatgaattcctccagcaagacctctctaacgcagaccagatacctcagcagacggcctggaaccttagcccgttgccagagtctttgggggagtctgggtctccatttcttggccctcctttccagctgcctcttggcggccatccccagccagacggacctctggccccagggcagcagacagatacgccacctgctctccccgagaagaagcgcaggagcgcagcctcccagacggcggacggctctggctgcagggtgtcctacgagcggcatccctcgcagtatgacaacatctctggggaggacctgcagagcacagccccgatcccatccgtcccctacgcgccctttgctgctattctgccctttcagcatggaggttcctcagcccctgtcgaatttgtgggtgattttactgctcctgagtcaaccggtgacccagaaaaaccacctcctctaccagagaagaaaaacaaacacatgctggcctacatgcagttgctggaggactactcggagccgcagccctctatgttctaccagacgccacagaacgagcacatctaccagcagaagaacaagctcctcatggaggtatacggcttcagcgactccttcagtggggtggactccgtgcaggagctggccccgccgcccgccctaccccccaagcagcggcagctggcctcctgtgctgcttcttccttctcctctgtctcccactgtgtccagcaaactaaagtggccttcacccccgaggacggcagtgccgctcagggcctcagtgtgtccgtctctaactcctttctcagccggcacggcagcttgcccgtgccctcggagccaccggctgggaaagacggacatcccagagatccctcagcggtcagcggcgtccctgggaaggacagcagagacggcagtgagagggccccaaagtcaccagatgctctggagtcggctcagtcggaggaggaagtggacgagctgtccctcattgaccacaacgaaattatgtccaggctgacgctcaagcaggagggtgatgacgggccggacgtccgcggaggatctggggacatcttactggtccatgctactgagactgacaggaaagatttggtgttgtactgcgaggcattcctgaccacctacaggaccttcatctccccagaggagctcatcaagaagctgcagtacagatatgagaaattctctccctttgccgacacattcaagaagcgcgtcagcaagaacacgttcttcgtgctggtacgggtggtggatgagctctgcctggtggagttgacagaagagatcctgaagctgctgatggaactggtcttccgcctggtgtgcaatggggagctgagcctggcccgtgtgctccggaagaacatcctggacaaggtggaccagaagaagctactcaggtgtgccacctccagccagcccctggcagcccggggggtagcagccaggccggggaccttgcacgactttcacagccatgagatagcggagcagctaacgctgctggatgctgagctcttctataaaatagagattcctgaggttttgctttgggcaaaagagcagaatgaggagaagagccccaacttgacccagttcacggagcacttcaacaacatgtcctactgggtccggtccataatcatgttacaggaaaaggcccaggacagggaacggctgctcttgaagttcatcaagatcatgaagcacttgcggaagctgaataacttcaactcctacttggccatcctctctgccctggactcggcgcccatccgcaggctggagtggcagaagcagacttcagagggcctggccgagtactgcacactgatcgacagctcgtcctccttccgagcctaccgggccgccctctcggaggtggaaccgccgtgcatcccgtacctggggctgatcctgcaggacctgaccttcgttcacctgggaaacccagactacatcgacgggaaagtgaacttctccaagcggtggcagcagttcaacatcctcgacagcatgcgctgcttccagcaggcgcactatgacatgcggaggaacgacgacattataaacttcttcaatgacttcagtgaccacctggctgaggaggccctatgggaactgtctctgaaaattaaacccaggaacataacaaggagaaaaacagaccgggaagagaagacctaggagcagacgccgggatccaggagaatgctcgaggggcgcagagggcagctcccagaccggagaggaccttggacctgttaggcgcatggcaggagtcccggcctcggagccatgaggctggccagccctcagcggggccgggcgggagctggagcctgccagccgcttcctgcctccttcctctgtgggagcagacccgtgggcctcagggcagccagcaggcaggtcttgttgccaatttacaaaccggtggttttctggtttggttttgttttctgcttttacttccatctctcccctcttgaccttccacccactcccctccagggagagagcagcagagacctcatcagcagaccaaggaagtggtgggtgctccccctccctaagctccagggtccctgaatcttctgaaatctcaaatgagtggaggcctcctggggtggcctgtcctgcaggggccctggaatgggggcaagcagctgggtgggcagaatgcagagtagactcgggggaggatcctttcactttccgcttccccttctgatgcatggaggatggtgtgagcttttcagcaggcccggaaaggtacgcaggtgacgccttagcagccccgcagctggtgctctgccccgcggtactggcgccatcagggcctcccttgcccgcctgagagcagcagcagtctctgtcatcccgtcgccccttaccccccaccccaggccactgggcccctcccacaccacctggggagctgagaagaggaggctggagtaagggaggacttgatcatccaagaaatactttttattgctgggagtcttctgaacctcaccaaactgaggccagagctgagctcctgggggagttaattcagaggggagaggccagcacctccctcctccatcgctcgctgtgtgccttaaactccatctcatgtccctccccatcccctggctttccctccctccttgccccatcctgggccagccagcagggctcctcctctggctcttcagacctttcagccagtgctgtcagtgcccctgggagggaagggcatccctgaggcacccgaatggtccctcagggtgcagggaggcagaagcctggccacagaggagcctcctaaggcagcagctgcagcaagcgcaccctctccccactctccccacgccagagcggcttccagagcagatgctgtttccatcctcctcgtcaaaaccattctcgctgctgagcttgacaatctgggcaaggcttgtggggcgcttgacaaacagaatctgccctgtgccgcctggttccgtggcctccagcatgagcctgcaggcagggcgctgcgggaacccagttgtgctgccccagcccatgcctccgggtctgctgtgcatgaatgagtgctcacttgtcccgggtttaggacgtggtcaagtgaacagcagggtctaactgtgcttacttagcccagttcaaacagaacaaaggaaaaatatagaaagcaacatctgttgatcatttaggtttttttttaaaccaccatgtcactttgagtccttcatgggtttttgaacagcatttatcaagaagaaaatgtgggctttttcccctctcccgtgttttgtttgtcctgtagatagagggaggaaagccgtgcagtggcaggcgggaccccctctggtggcgggaccccctcttgcggtggtcttgcggggccagccgggacctgtcactttattatttaaggagtgtgtgtgtagagtcgctggcttattaacagtattgtgtgtgggttgggtttttagtttgttccttctttttgaagtcccttcatttcaatccttgactctctctccccttcccttgcccagctctgttgaatgctgctgtgcgcgtgtgagggccgctctgcacacagggcccttgggttgtgtgaactgaaattctccctgtatttgtgagactcgcaggagtccccatctgtagcacaggcaatgccagtgccatgctgcagcctcagaaaccaggcctctcactccagcagcaggcagaaccgtgtctgtggtcgggtgctgtccacagctctgtctgccttgttcttgggcttgagctggatagaggtggggtctcttcaccttccctgaattcagaacagaccctgtgcctggccccagtgtgcccaggcaattccccaggccctcactgggagcccttggtgttctgagcagcagggcccaggcagcacatgagcagtgcccaggggctccctgcgtgaggacggcaaggtgcgatgtatgtctaacttattgatggcaggcagccccctgtgccccctaagcctggccctggttattgctgagctctgtgctcagtgctgcggcctggccgtggctcgtctgttcctttggggggcccgggcgggttgtgggaatcagtcttcacagacagacgtgagccaggcggaggactcgttccttgcagaggtcagtcctcacctgcaggtgtcggggtgtgggggggcaaggaggggcaggcacacaccatgtctgacctgaacccgattctggggagcatcttcccgctccggccccacgacctccacagggttacattgtaatatatatgccccagctaacctgtctgatggtggcatcttcctgcagacatttcaaacatgtaacttttatatgaaaaaaaataaacacagatgaaagctgcccaatgcc

SEQ ID NO: 3523 - DNA, 6019 bp, Homo sapiens
cccggcccgggcccgatgagcggcggcctcggcctccggcgcagcccggaaatgtccggcaagatcgagaaagcagactctcagcgttctcatctctcttccttcaccatgaagctgatggacaaattccactcacccaaaatcaagagaacgccatcaaagaagggaaaaccagctgaggtgtccgtaaagattccagagaagcctgtgaacaaagaggcaacagacagatttctaccagagggctaccctctccccttggatctggagcagcaggcagtagaatttatgtccaccagtgctgtggcttccaggtctcaaaggcagaagaacctgagctggctggaggagaaagagaaggaagttgtcagtgccctgcgctactttaagaccattgtggacaaaatggcaattgataagaaggtactggagatgcttccagggtcagccagcaaggtgctggaggccatcttacccctggtgcagaacgatcctcgaattcagcacagctcagccctctcttcctgctatagccgagtgtaccaaagcctcgccaacctcattcgctggtctgaccaagtgatgctggaaggcgtgaactcagaagacaaggagatggtgacgactgtgaagggggtcatcaaggctgtgctggatggagtgaaggagctggtcaggctcaccatcgagaagcagggacgtccgtctccgacgagccccgtgaagcccagttcccctgccagcaagcctgatggcccagcagagctccccctgacagaccgcgaggtagagatcctaaacaagacgactgggatgtcacagtcaactgagctcctcccagatgccacggatgaagaggtcgcgccccccaagcctcctctgcctggcattcgggtggttgataatagtcctccaccagcattgccacccaagaaaagacagtcggcgccgtcccctacccgagtggctgtggtggcccccatgagccgagccaccagtggctccagtttgcctgttggaatcaataggcaggattttgatgttgactgttacgcacagaggcgactgtcaggaggcagccactcatatggtggagagtcgccccgcctctccccctgcagcagcataggcaagctcagcaagtcagacgagcagctgtcctctctggacagggacagtgggcagtgctcccggaacacaagctgtgaaacactagaccactatgatcccgactatgaattcctccagcaagacctctctaacgcagaccagatacctcagcagacggcctggaaccttagcccgttgccagagtctttgggggagtctgggtctccatttcttggccctcctttccagctgcctcttggcggccatccccagccagacggacctctggccccagggcagcagacagatacgccacctgctctccccgagaagaagcgcaggagcgcagcctcccagacggcggacggctctggctgcagggtgtcctacgagcggcatccctcgcagtatgacaacatctctggggaggacctgcagagcacagccccgatcccatccgtcccctacgcgccctttgctgctattctgccctttcagcatggaggttcctcagcccctgtcgaatttgtgggtgattttactgctcctgagtcaaccggtgacccagaaaaaccacctcctctaccagagaagaaaaacaaacacatgctggcctacatgcagttgctggaggactactcggagccgcagccctctatgttctaccagacgccacagaacgagcacatctaccagcagaagaacaagctcctcatggaggtatacggcttcagcgactccttcagtggggtggactccgtgcaggagctggccccgccgcccgccctaccccccaagcagcggcagctggagccaccggctgggaaagacggacatcccagagatccctcagcggtcagcggcgtccctgggaaggacagcagagacggcagtgagagggccccaaagtcaccagatgctctggagtcggctcagtcggaggaggaagtggacgagctgtccctcattgaccacaacgaaattatgtccaggctgacgctcaagcaggagggtgatgacgggccggacgtccgcggaggatctggggacatcttactggtccatgctactgagactgacaggaaagatttggtgttgtactgcgaggcattcctgaccacctacaggaccttcatctccccagaggagctcatcaagaagctgcagtacagatatgagaaattctctccctttgccgacacattcaagaagcgcgtcagcaagaacacgttcttcgtgctggtacgggtggtggatgagctctgcctggtggagttgacagaagagatcctgaagctgctgatggaactggtcttccgcctggtgtgcaatggggagctgagcctggcccgtgtgctccggaagaacatcctggacaaggtggaccagaagaagctactcaggtgtgccacctccagccagcccctggcagcccggggggtagcagccaggccggggaccttgcacgactttcacagccatgagatagcggagcagctaacgctgctggatgctgagctcttctataaaatagagattcctgaggttttgctttgggcaaaagagcagaatgaggagaagagccccaacttgacccagttcacggagcacttcaacaacatgtcctactgggtccggtccataatcatgttacaggaaaaggcccaggacagggaacggctgctcttgaagttcatcaagatcatgaagcacttgcggaagctgaataacttcaactcctacttggccatcctctctgccctggactcggcgcccatccgcaggctggagtggcagaagcagacttcagagggcctggccgagtactgcacactgatcgacagctcgtcctccttccgagcctaccgggccgccctctcggaggtggaaccgccgtgcatcccgtacctggggctgatcctgcaggacctgaccttcgttcacctgggaaacccagactacatcgacgggaaagtgaacttctccaagcggtggcagcagttcaacatcctcgacagcatgcgctgcttccagcaggcgcactatgacatgcggaggaacgacgacattataaacttcttcaatgacttcagtgaccacctggctgaggaggccctatgggaactgtctctgaaaattaaacccaggaacataacaaggagaaaaacagaccgggaagagaagacctaggagcagacgccgggatccaggagaatgctcgaggggcgcagagggcagctcccagaccggagaggaccttggacctgttaggcgcatggcaggagtcccggcctcggagccatgaggctggccagccctcagcggggccgggcgggagctggagcctgccagccgcttcctgcctccttcctctgtgggagcagacccgtgggcctcagggcagccagcaggcaggtcttgttgccaatttacaaaccggtggttttctggtttggttttgttttctgcttttacttccatctctcccctcttgaccttccacccactcccctccagggagagagcagcagagacctcatcagcagaccaaggaagtggtgggtgctccccctccctaagctccagggtccctgaatcttctgaaatctcaaatgagtggaggcctcctggggtggcctgtcctgcaggggccctggaatgggggcaagcagctgggtgggcagaatgcagagtagactcgggggaggatcctttcactttccgcttccccttctgatgcatggaggatggtgtgagcttttcagcaggcccggaaaggtacgcaggtgacgccttagcagccccgcagctggtgctctgccccgcggtactggcgccatcagggcctcccttgcccgcctgagagcagcagcagtctctgtcatcccgtcgccccttaccccccaccccaggccactgggcccctcccacaccacctggggagctgagaagaggaggctggagtaagggaggacttgatcatccaagaaatactttttattgctgggagtcttctgaacctcaccaaactgaggccagagctgagctcctgggggagttaattcagaggggagaggccagcacctccctcctccatcgctcgctgtgtgccttaaactccatctcatgtccctccccatcccctggctttccctccctccttgccccatcctgggccagccagcagggctcctcctctggctcttcagacctttcagccagtgctgtcagtgcccctgggagggaagggcatccctgaggcacccgaatggtccctcagggtgcagggaggcagaagcctggccacagaggagcctcctaaggcagcagctgcagcaagcgcaccctctccccactctccccacgccagagcggcttccagagcagatgctgtttccatcctcctcgtcaaaaccattctcgctgctgagcttgacaatctgggcaaggcttgtggggcgcttgacaaacagaatctgccctgtgccgcctggttccgtggcctccagcatgagcctgcaggcagggcgctgcgggaacccagttgtgctgccccagcccatgcctccgggtctgctgtgcatgaatgagtgctcacttgtcccgggtttaggacgtggtcaagtgaacagcagggtctaactgtgcttacttagcccagttcaaacagaacaaaggaaaaatatagaaagcaacatctgttgatcatttaggtttttttttaaaccaccatgtcactttgagtccttcatgggtttttgaacagcatttatcaagaagaaaatgtgggctttttcccctctcccgtgttttgtttgtcctgtagatagagggaggaaagccgtgcagtggcaggcgggaccccctctggtggcgggaccccctcttgcggtggtcttgcggggccagccgggacctgtcactttattatttaaggagtgtgtgtgtagagtcgctggcttattaacagtattgtgtgtgggttgggtttttagtttgttccttctttttgaagtcccttcatttcaatccttgactctctctccccttcccttgcccagctctgttgaatgctgctgtgcgcgtgtgagggccgctctgcacacagggcccttgggttgtgtgaactgaaattctccctgtatttgtgagactcgcaggagtccccatctgtagcacaggcaatgccagtgccatgctgcagcctcagaaaccaggcctctcactccagcagcaggcagaaccgtgtctgtggtcgggtgctgtccacagctctgtctgccttgttcttgggcttgagctggatagaggtggggtctcttcaccttccctgaattcagaacagaccctgtgcctggccccagtgtgcccaggcaattccccaggccctcactgggagcccttggtgttctgagcagcagggcccaggcagcacatgagcagtgcccaggggctccctgcgtgaggacggcaaggtgcgatgtatgtctaacttattgatggcaggcagccccctgtgccccctaagcctggccctggttattgctgagctctgtgctcagtgctgcggcctggccgtggctcgtctgttcctttggggggcccgggcgggttgtgggaatcagtcttcacagacagacgtgagccaggcggaggactcgttccttgcagaggtcagtcctcacctgcaggtgtcggggtgtgggggggcaaggaggggcaggcacacaccatgtctgacctgaacccgattctggggagcatcttcccgctccggccccacgacctccacagggttacattgtaatatatatgccccagctaacctgtctgatggtggcatcttcctgcagacatttcaaacatgtaacttttatatgaaaaaaaataaacacagatgaaagctgcc

SEQ ID NO: 3524 - DNA, 6084 bp, Homo sapiens
ccttttctgggcaccgccttctgctagggggttgtagatgaaagtgcctgctcccagagaagcttgtctaacctagcacagtttctaagctacccaggctgccagaccgagcgaccgtgctgccatggacacagactctcagcgttctcatctctcttccttcaccatgaagctgatggacaaattccactcacccaaaatcaagagaacgccatcaaagaagggaaaaccagctgaggtgtccgtaaagattccagagaagcctgtgaacaaagaggcaacagacagatttctaccagagggctaccctctccccttggatctggagcagcaggcagtagaatttatgtccaccagtgctgtggcttccaggtctcaaaggcagaagaacctgagctggctggaggagaaagagaaggaagttgtcagtgccctgcgctactttaagaccattgtggacaaaatggcaattgataagaaggtactggagatgcttccagggtcagccagcaaggtgctggaggccatcttacccctggtgcagaacgatcctcgaattcagcacagctcagccctctcttcctgctatagccgagtgtaccaaagcctcgccaacctcattcgctggtctgaccaagtgatgctggaaggcgtgaactcagaagacaaggagatggtgacgactgtgaagggggtcatcaaggctgtgctggatggagtgaaggagctggtcaggctcaccatcgagaagcagggacgtccgtctccgacgagccccgtgaagcccagttcccctgccagcaagcctgatggcccagcagagctccccctgacagaccgcgaggtagagatcctaaacaagacgactgggatgtcacagtcaactgagctcctcccagatgccacggatgaagaggtcgcgccccccaagcctcctctgcctggcattcgggtggttgataatagtcctccaccagcattgccacccaagaaaagacagtcggcgccgtcccctacccgagtggctgtggtggcccccatgagccgagccaccagtggctccagtttgcctgttggaatcaataggcaggattttgatgttgactgttacgcacagaggcgactgtcaggaggcagccactcatatggtggagagtcgccccgcctctccccctgcagcagcataggcaagctcagcaagtcagacgagcagctgtcctctctggacagggacagtgggcagtgctcccggaacacaagctgtgaaacactagaccactatgatcccgactatgaattcctccagcaagacctctctaacgcagaccagatacctcagcagacggcctggaaccttagcccgttgccagagtctttgggggagtctgggtctccatttcttggccctcctttccagctgcctcttggcggccatccccagccagacggacctctggccccagggcagcagacagatacgccacctgctctccccgagaagaagcgcaggagcgcagcctcccagacggcggacggctctggctgcagggtgtcctacgagcggcatccctcgcagtatgacaacatctctggggaggacctgcagagcacagccccgatcccatccgtcccctacgcgccctttgctgctattctgccctttcagcatggaggttcctcagcccctgtcgaatttgtgggtgattttactgctcctgagtcaaccggtgacccagaaaaaccacctcctctaccagagaagaaaaacaaacacatgctggcctacatgcagttgctggaggactactcggagccgcagccctctatgttctaccagacgccacagaacgagcacatctaccagcagaagaacaagctcctcatggaggtatacggcttcagcgactccttcagtggggtggactccgtgcaggagctggccccgccgcccgccctaccccccaagcagcggcagctggagccaccggctgggaaagacggacatcccagagatccctcagcggtcagcggcgtccctgggaaggacagcagagacggcagtgagagggccccaaagtcaccagatgctctggagtcggctcagtcggaggaggaagtggacgagctgtccctcattgaccacaacgaaattatgtccaggctgacgctcaagcaggagggtgatgacgggccggacgtccgcggaggatctggggacatcttactggtccatgctactgagactgacaggaaagatttggtgttgtactgcgaggcattcctgaccacctacaggaccttcatctccccagaggagctcatcaagaagctgcagtacagatatgagaaattctctccctttgccgacacattcaagaagcgcgtcagcaagaacacgttcttcgtgctggtacgggtggtggatgagctctgcctggtggagttgacagaagagatcctgaagctgctgatggaactggtcttccgcctggtgtgcaatggggagctgagcctggcccgtgtgctccggaagaacatcctggacaaggtggaccagaagaagctactcaggtgtgccacctccagccagcccctggcagcccggggggtagcagccaggccggggaccttgcacgactttcacagccatgagatagcggagcagctaacgctgctggatgctgagctcttctataaaatagagattcctgaggttttgctttgggcaaaagagcagaatgaggagaagagccccaacttgacccagttcacggagcacttcaacaacatgtcctactgggtccggtccataatcatgttacaggaaaaggcccaggacagggaacggctgctcttgaagttcatcaagatcatgaagcacttgcggaagctgaataacttcaactcctacttggccatcctctctgccctggactcggcgcccatccgcaggctggagtggcagaagcagacttcagagggcctggccgagtactgcacactgatcgacagctcgtcctccttccgagcctaccgggccgccctctcggaggtggaaccgccgtgcatcccgtacctggggctgatcctgcaggacctgaccttcgttcacctgggaaacccagactacatcgacgggaaagtgaacttctccaagcggtggcagcagttcaacatcctcgacagcatgcgctgcttccagcaggcgcactatgacatgcggaggaacgacgacattataaacttcttcaatgacttcagtgaccacctggctgaggaggccctatgggaactgtctctgaaaattaaacccaggaacataacaaggagaaaaacagaccgggaagagaagacctaggagcagacgccgggatccaggagaatgctcgaggggcgcagagggcagctcccagaccggagaggaccttggacctgttaggcgcatggcaggagtcccggcctcggagccatgaggctggccagccctcagcggggccgggcgggagctggagcctgccagccgcttcctgcctccttcctctgtgggagcagacccgtgggcctcagggcagccagcaggcaggtcttgttgccaatttacaaaccggtggttttctggtttggttttgttttctgcttttacttccatctctcccctcttgaccttccacccactcccctccagggagagagcagcagagacctcatcagcagaccaaggaagtggtgggtgctccccctccctaagctccagggtccctgaatcttctgaaatctcaaatgagtggaggcctcctggggtggcctgtcctgcaggggccctggaatgggggcaagcagctgggtgggcagaatgcagagtagactcgggggaggatcctttcactttccgcttccccttctgatgcatggaggatggtgtgagcttttcagcaggcccggaaaggtacgcaggtgacgccttagcagccccgcagctggtgctctgccccgcggtactggcgccatcagggcctcccttgcccgcctgagagcagcagcagtctctgtcatcccgtcgccccttaccccccaccccaggccactgggcccctcccacaccacctggggagctgagaagaggaggctggagtaagggaggacttgatcatccaagaaatactttttattgctgggagtcttctgaacctcaccaaactgaggccagagctgagctcctgggggagttaattcagaggggagaggccagcacctccctcctccatcgctcgctgtgtgccttaaactccatctcatgtccctccccatcccctggctttccctccctccttgccccatcctgggccagccagcagggctcctcctctggctcttcagacctttcagccagtgctgtcagtgcccctgggagggaagggcatccctgaggcacccgaatggtccctcagggtgcagggaggcagaagcctggccacagaggagcctcctaaggcagcagctgcagcaagcgcaccctctccccactctccccacgccagagcggcttccagagcagatgctgtttccatcctcctcgtcaaaaccattctcgctgctgagcttgacaatctgggcaaggcttgtggggcgcttgacaaacagaatctgccctgtgccgcctggttccgtggcctccagcatgagcctgcaggcagggcgctgcgggaacccagttgtgctgccccagcccatgcctccgggtctgctgtgcatgaatgagtgctcacttgtcccgggtttaggacgtggtcaagtgaacagcagggtctaactgtgcttacttagcccagttcaaacagaacaaaggaaaaatatagaaagcaacatctgttgatcatttaggtttttttttaaaccaccatgtcactttgagtccttcatgggtttttgaacagcatttatcaagaagaaaatgtgggctttttcccctctcccgtgttttgtttgtcctgtagatagagggaggaaagccgtgcagtggcaggcgggaccccctctggtggcgggaccccctcttgcggtggtcttgcggggccagccgggacctgtcactttattatttaaggagtgtgtgtgtagagtcgctggcttattaacagtattgtgtgtgggttgggtttttagtttgttccttctttttgaagtcccttcatttcaatccttgactctctctccccttcccttgcccagctctgttgaatgctgctgtgcgcgtgtgagggccgctctgcacacagggcccttgggttgtgtgaactgaaattctccctgtatttgtgagactcgcaggagtccccatctgtagcacaggcaatgccagtgccatgctgcagcctcagaaaccaggcctctcactccagcagcaggcagaaccgtgtctgtggtcgggtgctgtccacagctctgtctgccttgttcttgggcttgagctggatagaggtggggtctcttcaccttccctgaattcagaacagaccctgtgcctggccccagtgtgcccaggcaattccccaggccctcactgggagcccttggtgttctgagcagcagggcccaggcagcacatgagcagtgcccaggggctccctgcgtgaggacggcaaggtgcgatgtatgtctaacttattgatggcaggcagccccctgtgccccctaagcctggccctggttattgctgagctctgtgctcagtgctgcggcctggccgtggctcgtctgttcctttggggggcccgggcgggttgtgggaatcagtcttcacagacagacgtgagccaggcggaggactcgttccttgcagaggtcagtcctcacctgcaggtgtcggggtgtgggggggcaaggaggggcaggcacacaccatgtctgacctgaacccgattctggggagcatcttcccgctccggccccacgacctccacagggttacattgtaatatatatgccccagctaacctgtctgatggtggcatcttcctgcagacatttcaaacatgtaacttttatatgaaaaaaaataaacacagatgaaagctgcccaatgcc

SEQ ID NO: 3525 - DNA, 6173 bp, Homo sapiens
gagattcctcaggcttcccttgtgaggctgcctgggttctgccgctgggtggtttgggatgtccaagagatatcccctttcagccagtgactcggtcctcagttgctgctccggaaagacgctggggctgggaagggccctgtgtcctctggctttaaaatgggcaatgctattgaaaaacagaagcccttgaaacgaagtcatctgtacccctggaaacaagactctcagcgttctcatctctcttccttcaccatgaagctgatggacaaattccactcacccaaaatcaagagaacgccatcaaagaagggaaaaccagctgaggtgtccgtaaagattccagagaagcctgtgaacaaagaggcaacagacagatttctaccagagggctaccctctccccttggatctggagcagcaggcagtagaatttatgtccaccagtgctgtggcttccaggtctcaaaggcagaagaacctgagctggctggaggagaaagagaaggaagttgtcagtgccctgcgctactttaagaccattgtggacaaaatggcaattgataagaaggtactggagatgcttccagggtcagccagcaaggtgctggaggccatcttacccctggtgcagaacgatcctcgaattcagcacagctcagccctctcttcctgctatagccgagtgtaccaaagcctcgccaacctcattcgctggtctgaccaagtgatgctggaaggcgtgaactcagaagacaaggagatggtgacgactgtgaagggggtcatcaaggctgtgctggatggagtgaaggagctggtcaggctcaccatcgagaagcagggacgtccgtctccgacgagccccgtgaagcccagttcccctgccagcaagcctgatggcccagcagagctccccctgacagaccgcgaggtagagatcctaaacaagacgactgggatgtcacagtcaactgagctcctcccagatgccacggatgaagaggtcgcgccccccaagcctcctctgcctggcattcgggtggttgataatagtcctccaccagcattgccacccaagaaaagacagtcggcgccgtcccctacccgagtggctgtggtggcccccatgagccgagccaccagtggctccagtttgcctgttggaatcaataggcaggattttgatgttgactgttacgcacagaggcgactgtcaggaggcagccactcatatggtggagagtcgccccgcctctccccctgcagcagcataggcaagctcagcaagtcagacgagcagctgtcctctctggacagggacagtgggcagtgctcccggaacacaagctgtgaaacactagaccactatgatcccgactatgaattcctccagcaagacctctctaacgcagaccagatacctcagcagacggcctggaaccttagcccgttgccagagtctttgggggagtctgggtctccatttcttggccctcctttccagctgcctcttggcggccatccccagccagacggacctctggccccagggcagcagacagatacgccacctgctctccccgagaagaagcgcaggagcgcagcctcccagacggcggacggctctggctgcagggtgtcctacgagcggcatccctcgcagtatgacaacatctctggggaggacctgcagagcacagccccgatcccatccgtcccctacgcgccctttgctgctattctgccctttcagcatggaggttcctcagcccctgtcgaatttgtgggtgattttactgctcctgagtcaaccggtgacccagaaaaaccacctcctctaccagagaagaaaaacaaacacatgctggcctacatgcagttgctggaggactactcggagccgcagccctctatgttctaccagacgccacagaacgagcacatctaccagcagaagaacaagctcctcatggaggtatacggcttcagcgactccttcagtggggtggactccgtgcaggagctggccccgccgcccgccctaccccccaagcagcggcagctggagccaccggctgggaaagacggacatcccagagatccctcagcggtcagcggcgtccctgggaaggacagcagagacggcagtgagagggccccaaagtcaccagatgctctggagtcggctcagtcggaggaggaagtggacgagctgtccctcattgaccacaacgaaattatgtccaggctgacgctcaagcaggagggtgatgacgggccggacgtccgcggaggatctggggacatcttactggtccatgctactgagactgacaggaaagatttggtgttgtactgcgaggcattcctgaccacctacaggaccttcatctccccagaggagctcatcaagaagctgcagtacagatatgagaaattctctccctttgccgacacattcaagaagcgcgtcagcaagaacacgttcttcgtgctggtacgggtggtggatgagctctgcctggtggagttgacagaagagatcctgaagctgctgatggaactggtcttccgcctggtgtgcaatggggagctgagcctggcccgtgtgctccggaagaacatcctggacaaggtggaccagaagaagctactcaggtgtgccacctccagccagcccctggcagcccggggggtagcagccaggccggggaccttgcacgactttcacagccatgagatagcggagcagctaacgctgctggatgctgagctcttctataaaatagagattcctgaggttttgctttgggcaaaagagcagaatgaggagaagagccccaacttgacccagttcacggagcacttcaacaacatgtcctactgggtccggtccataatcatgttacaggaaaaggcccaggacagggaacggctgctcttgaagttcatcaagatcatgaagcacttgcggaagctgaataacttcaactcctacttggccatcctctctgccctggactcggcgcccatccgcaggctggagtggcagaagcagacttcagagggcctggccgagtactgcacactgatcgacagctcgtcctccttccgagcctaccgggccgccctctcggaggtggaaccgccgtgcatcccgtacctggggctgatcctgcaggacctgaccttcgttcacctgggaaacccagactacatcgacgggaaagtgaacttctccaagcggtggcagcagttcaacatcctcgacagcatgcgctgcttccagcaggcgcactatgacatgcggaggaacgacgacattataaacttcttcaatgacttcagtgaccacctggctgaggaggccctatgggaactgtctctgaaaattaaacccaggaacataacaaggagaaaaacagaccgggaagagaagacctaggagcagacgccgggatccaggagaatgctcgaggggcgcagagggcagctcccagaccggagaggaccttggacctgttaggcgcatggcaggagtcccggcctcggagccatgaggctggccagccctcagcggggccgggcgggagctggagcctgccagccgcttcctgcctccttcctctgtgggagcagacccgtgggcctcagggcagccagcaggcaggtcttgttgccaatttacaaaccggtggttttctggtttggttttgttttctgcttttacttccatctctcccctcttgaccttccacccactcccctccagggagagagcagcagagacctcatcagcagaccaaggaagtggtgggtgctccccctccctaagctccagggtccctgaatcttctgaaatctcaaatgagtggaggcctcctggggtggcctgtcctgcaggggccctggaatgggggcaagcagctgggtgggcagaatgcagagtagactcgggggaggatcctttcactttccgcttccccttctgatgcatggaggatggtgtgagcttttcagcaggcccggaaaggtacgcaggtgacgccttagcagccccgcagctggtgctctgccccgcggtactggcgccatcagggcctcccttgcccgcctgagagcagcagcagtctctgtcatcccgtcgccccttaccccccaccccaggccactgggcccctcccacaccacctggggagctgagaagaggaggctggagtaagggaggacttgatcatccaagaaatactttttattgctgggagtcttctgaacctcaccaaactgaggccagagctgagctcctgggggagttaattcagaggggagaggccagcacctccctcctccatcgctcgctgtgtgccttaaactccatctcatgtccctccccatcccctggctttccctccctccttgccccatcctgggccagccagcagggctcctcctctggctcttcagacctttcagccagtgctgtcagtgcccctgggagggaagggcatccctgaggcacccgaatggtccctcagggtgcagggaggcagaagcctggccacagaggagcctcctaaggcagcagctgcagcaagcgcaccctctccccactctccccacgccagagcggcttccagagcagatgctgtttccatcctcctcgtcaaaaccattctcgctgctgagcttgacaatctgggcaaggcttgtggggcgcttgacaaacagaatctgccctgtgccgcctggttccgtggcctccagcatgagcctgcaggcagggcgctgcgggaacccagttgtgctgccccagcccatgcctccgggtctgctgtgcatgaatgagtgctcacttgtcccgggtttaggacgtggtcaagtgaacagcagggtctaactgtgcttacttagcccagttcaaacagaacaaaggaaaaatatagaaagcaacatctgttgatcatttaggtttttttttaaaccaccatgtcactttgagtccttcatgggtttttgaacagcatttatcaagaagaaaatgtgggctttttcccctctcccgtgttttgtttgtcctgtagatagagggaggaaagccgtgcagtggcaggcgggaccccctctggtggcgggaccccctcttgcggtggtcttgcggggccagccgggacctgtcactttattatttaaggagtgtgtgtgtagagtcgctggcttattaacagtattgtgtgtgggttgggtttttagtttgttccttctttttgaagtcccttcatttcaatccttgactctctctccccttcccttgcccagctctgttgaatgctgctgtgcgcgtgtgagggccgctctgcacacagggcccttgggttgtgtgaactgaaattctccctgtatttgtgagactcgcaggagtccccatctgtagcacaggcaatgccagtgccatgctgcagcctcagaaaccaggcctctcactccagcagcaggcagaaccgtgtctgtggtcgggtgctgtccacagctctgtctgccttgttcttgggcttgagctggatagaggtggggtctcttcaccttccctgaattcagaacagaccctgtgcctggccccagtgtgcccaggcaattccccaggccctcactgggagcccttggtgttctgagcagcagggcccaggcagcacatgagcagtgcccaggggctccctgcgtgaggacggcaaggtgcgatgtatgtctaacttattgatggcaggcagccccctgtgccccctaagcctggccctggttattgctgagctctgtgctcagtgctgcggcctggccgtggctcgtctgttcctttggggggcccgggcgggttgtgggaatcagtcttcacagacagacgtgagccaggcggaggactcgttccttgcagaggtcagtcctcacctgcaggtgtcggggtgtgggggggcaaggaggggcaggcacacaccatgtctgacctgaacccgattctggggagcatcttcccgctccggccccacgacctccacagggttacattgtaatatatatgccccagctaacctgtctgatggtggcatcttcctgcagacatttcaaacatgtaacttttatatgaaaaaaaataaacacagatgaaagctgcccaatgcc

SEQ ID NO: 3526 - DNA, 6590 bp, Homo sapiens
gagattcctcaggcttcccttgtgaggctgcctgggttctgccgctgggtggtttgggatgtccaagagatatcccctttcagccagtgactcggtcctcagttgctgctccggaaagacgctggggctgggaagggccctgtgtcctctggctttaaaatgggcaatgctattgaaaaacagaagcccttgaaacgaagtcatctgtacccctggaaacaagactctcagcgttctcatctctcttccttcaccatgaagctgatggacaaattccactcacccaaaatcaagagaacgccatcaaagaagggaaaaccagctgaggtgtccgtaaagattccagagaagcctgtgaacaaagaggcaacagacagatttctaccagagggctaccctctccccttggatctggagcagcaggcagtagaatttatgtccaccagtgctgtggcttccaggtctcaaaggcagaagaacctgagctggctggaggagaaagagaaggaagttgtcagtgccctgcgctactttaagaccattgtggacaaaatggcaattgataagaaggtactggagatgcttccagggtcagccagcaaggtgctggaggccatcttacccctggtgcagaacgatcctcgaattcagcacagctcagccctctcttcctgctatagccgagtgtaccaaagcctcgccaacctcattcgctggtctgaccaagtgatgctggaaggcgtgaactcagaagacaaggagatggtgacgactgtgaagggggtcatcaaggctgtgctggatggagtgaaggagctggtcaggctcaccatcgagaagcagggacgtccgtctccgacgagccccgtgaagcccagttcccctgccagcaagcctgatggcccagcagagctccccctgacagaccgcgaggtagagatcctaaacaagacgactgggatgtcacagtcaactgagctcctcccagatgccacggatgaagaggtcgcgccccccaagcctcctctgcctggcattcgggtggttgataatagtcctccaccagcattgccacccaagaaaagacagtcggcgccgtcccctacccgagtggctgtggtggcccccatgagccgagccaccagtggctccagtttgcctgttggaatcaataggcaggattttgatgttgactgttacgcacagaggcgactgtcaggaggcagccactcatatggtggagagtcgccccgcctctccccctgcagcagcataggcaagctcagcaagtcagacgagcagctgtcctctctggacagggacagtgggcagtgctcccggaacacaagctgtgaaacactagaccactatgatcccgactatgaattcctccagcaagacctctctaacgcagaccagatacctcagcagacggcctggaaccttagcccgttgccagagtctttgggggagtctgggtctccatttcttggccctcctttccagctgcctcttggcggccatccccagccagacggacctctggccccagggcagcagacagatacgccacctgctctccccgagaagaagcgcaggagcgcagcctcccagacggcggacggctctggctgcagggtgtcctacgagcggcatccctcgcagtatgacaacatctctggggaggacctgcagagcacagccccgatcccatccgtcccctacgcgccctttgctgctattctgccctttcagcatggaggttcctcagcccctgtcgaatttgtgggtgattttactgctcctgagtcaaccggtgacccagaaaaaccacctcctctaccagagaagaaaaacaaacacatgctggcctacatgcagttgctggaggactactcggagccgcagccctctatgttctaccagacgccacagaacgagcacatctaccagcagaagaacaagctcctcatggaggtatacggcttcagcgactccttcagtggggtggactccgtgcaggagctggccccgccgcccgccctaccccccaagcagcggcagctgcaggcctcctgtgctgcttcttccttctcctctgtctcccactgtgtccagcaaactaaagtggccttcacccccgaggacggcagtgccgctcagggcctcagtgtgtccgtctctaactcctttctcagccggcacggcagcttgcccgtgccctcgtataagtctgtgtttaggtcctactcccaggatttcgtgcctcaccaccaagcttccgttccgcctttccttccgcctacctcctcttcctctccacatttcccacctgcccaccagtctcagagctctgacttagccgtgccaaccatggccggtccacctcccagcaccgtggacgggcctctctcggcttctcaggagagcagctttcatgggaatactgtctgccttccttccgaaacctctttcactgactcggagccaccggctgggaaagacggacatcccagagatccctcagcggtcagcggcgtccctgggaaggacagcagagacggcagtgagagggccccaaagtcaccagatgctctggagtcggctcagtcggaggaggaagtggacgagctgtccctcattgaccacaacgaaattatgtccaggctgacgctcaagcaggagggtgatgacgggccggacgtccgcggaggatctggggacatcttactggtccatgctactgagactgacaggaaagatttggtgttgtactgcgaggcattcctgaccacctacaggaccttcatctccccagaggagctcatcaagaagctgcagtacagatatgagaaattctctccctttgccgacacattcaagaagcgcgtcagcaagaacacgttcttcgtgctggtacgggtggtggatgagctctgcctggtggagttgacagaagagatcctgaagctgctgatggaactggtcttccgcctggtgtgcaatggggagctgagcctggcccgtgtgctccggaagaacatcctggacaaggtggaccagaagaagctactcaggtgtgccacctccagccagcccctggcagcccggggggtagcagccaggccggggaccttgcacgactttcacagccatgagatagcggagcagctaacgctgctggatgctgagctcttctataaaatagagattcctgaggttttgctttgggcaaaagagcagaatgaggagaagagccccaacttgacccagttcacggagcacttcaacaacatgtcctactgggtccggtccataatcatgttacaggaaaaggcccaggacagggaacggctgctcttgaagttcatcaagatcatgaagcacttgcggaagctgaataacttcaactcctacttggccatcctctctgccctggactcggcgcccatccgcaggctggagtggcagaagcagacttcagagggcctggccgagtactgcacactgatcgacagctcgtcctccttccgagcctaccgggccgccctctcggaggtggaaccgccgtgcatcccgtacctggggctgatcctgcaggacctgaccttcgttcacctgggaaacccagactacatcgacgggaaagtgaacttctccaagcggtggcagcagttcaacatcctcgacagcatgcgctgcttccagcaggcgcactatgacatgcggaggaacgacgacattataaacttcttcaatgacttcagtgaccacctggctgaggaggccctatgggaactgtctctgaaaattaaacccaggaacataacaaggagaaaaacagaccgggaagagaagacctaggagcagacgccgggatccaggagaatgctcgaggggcgcagagggcagctcccagaccggagaggaccttggacctgttaggcgcatggcaggagtcccggcctcggagccatgaggctggccagccctcagcggggccgggcgggagctggagcctgccagccgcttcctgcctccttcctctgtgggagcagacccgtgggcctcagggcagccagcaggcaggtcttgttgccaatttacaaaccggtggttttctggtttggttttgttttctgcttttacttccatctctcccctcttgaccttccacccactcccctccagggagagagcagcagagacctcatcagcagaccaaggaagtggtgggtgctccccctccctaagctccagggtccctgaatcttctgaaatctcaaatgagtggaggcctcctggggtggcctgtcctgcaggggccctggaatgggggcaagcagctgggtgggcagaatgcagagtagactcgggggaggatcctttcactttccgcttccccttctgatgcatggaggatggtgtgagcttttcagcaggcccggaaaggtacgcaggtgacgccttagcagccccgcagctggtgctctgccccgcggtactggcgccatcagggcctcccttgcccgcctgagagcagcagcagtctctgtcatcccgtcgccccttaccccccaccccaggccactgggcccctcccacaccacctggggagctgagaagaggaggctggagtaagggaggacttgatcatccaagaaatactttttattgctgggagtcttctgaacctcaccaaactgaggccagagctgagctcctgggggagttaattcagaggggagaggccagcacctccctcctccatcgctcgctgtgtgccttaaactccatctcatgtccctccccatcccctggctttccctccctccttgccccatcctgggccagccagcagggctcctcctctggctcttcagacctttcagccagtgctgtcagtgcccctgggagggaagggcatccctgaggcacccgaatggtccctcagggtgcagggaggcagaagcctggccacagaggagcctcctaaggcagcagctgcagcaagcgcaccctctccccactctccccacgccagagcggcttccagagcagatgctgtttccatcctcctcgtcaaaaccattctcgctgctgagcttgacaatctgggcaaggcttgtggggcgcttgacaaacagaatctgccctgtgccgcctggttccgtggcctccagcatgagcctgcaggcagggcgctgcgggaacccagttgtgctgccccagcccatgcctccgggtctgctgtgcatgaatgagtgctcacttgtcccgggtttaggacgtggtcaagtgaacagcagggtctaactgtgcttacttagcccagttcaaacagaacaaaggaaaaatatagaaagcaacatctgttgatcatttaggtttttttttaaaccaccatgtcactttgagtccttcatgggtttttgaacagcatttatcaagaagaaaatgtgggctttttcccctctcccgtgttttgtttgtcctgtagatagagggaggaaagccgtgcagtggcaggcgggaccccctctggtggcgggaccccctcttgcggtggtcttgcggggccagccgggacctgtcactttattatttaaggagtgtgtgtgtagagtcgctggcttattaacagtattgtgtgtgggttgggtttttagtttgttccttctttttgaagtcccttcatttcaatccttgactctctctccccttcccttgcccagctctgttgaatgctgctgtgcgcgtgtgagggccgctctgcacacagggcccttgggttgtgtgaactgaaattctccctgtatttgtgagactcgcaggagtccccatctgtagcacaggcaatgccagtgccatgctgcagcctcagaaaccaggcctctcactccagcagcaggcagaaccgtgtctgtggtcgggtgctgtccacagctctgtctgccttgttcttgggcttgagctggatagaggtggggtctcttcaccttccctgaattcagaacagaccctgtgcctggccccagtgtgcccaggcaattccccaggccctcactgggagcccttggtgttctgagcagcagggcccaggcagcacatgagcagtgcccaggggctccctgcgtgaggacggcaaggtgcgatgtatgtctaacttattgatggcaggcagccccctgtgccccctaagcctggccctggttattgctgagctctgtgctcagtgctgcggcctggccgtggctcgtctgttcctttggggggcccgggcgggttgtgggaatcagtcttcacagacagacgtgagccaggcggaggactcgttccttgcagaggtcagtcctcacctgcaggtgtcggggtgtgggggggcaaggaggggcaggcacacaccatgtctgacctgaacccgattctggggagcatcttcccgctccggccccacgacctccacagggttacattgtaatatatatgccccagctaacctgtctgatggtggcatcttcctgcagacatttcaaacatgtaacttttatatgaaaaaaaataaacacagatgaaagctgcccaatgcc

SEQ ID NO: 3527 - DNA, 6256 bp, Homo sapiens
cgctgcgctgcggccggctcgcgggccgggggagcggcggcgggcgcgcgggaggcggagcggcggcggcgggcgcggcgggagcggctgggcccgggcgggctggagcgcggtcgccgagcgcagggccgcggccgcgcggagcccgccatgccggcgcgggtctgaggcgtggcgagccagggccgaggcgagcggcgggcgcgccgcccctgtcgccccgcggcggcccggcccgggcccgatgagcggcggcctcggcctccggcgcagcccggaaatgtccggcaagatcgagaaagcagactctcagcgttctcatctctcttccttcaccatgaagctgatggacaaattccactcacccaaaatcaagagaacgccatcaaagaagggaaaaccagctgaggtgtccgtaaagattccagagaagcctgtgaacaaagaggcaacagacagatttctaccagagggctaccctctccccttggatctggagcagcaggcagtagaatttatgtccaccagtgctgtggcttccaggtctcaaaggcagaagaacctgagctggctggaggagaaagagaaggaagttgtcagtgccctgcgctactttaagaccattgtggacaaaatggcaattgataagaaggtactggagatgcttccagggtcagccagcaaggtgctggaggccatcttacccctggtgcagaacgatcctcgaattcagcacagctcagccctctcttcctgctatagccgagtgtaccaaagcctcgccaacctcattcgctggtctgaccaagtgatgctggaaggcgtgaactcagaagacaaggagatggtgacgactgtgaagggggtcatcaaggctgtgctggatggagtgaaggagctggtcaggctcaccatcgagaagcagggacgtccgtctccgacgagccccgtgaagcccagttcccctgccagcaagcctgatggcccagcagagctccccctgacagaccgcgaggtagagatcctaaacaagacgactgggatgtcacagtcaactgagctcctcccagatgccacggatgaagaggtcgcgccccccaagcctcctctgcctggcattcgggtggttgataatagtcctccaccagcattgccacccaagaaaagacagtcggcgccgtcccctacccgagtggctgtggtggcccccatgagccgagccaccagtggctccagtttgcctgttggaatcaataggcaggattttgatgttgactgttacgcacagaggcgactgtcaggaggcagccactcatatggtggagagtcgccccgcctctccccctgcagcagcataggcaagctcagcaagtcagacgagcagctgtcctctctggacagggacagtgggcagtgctcccggaacacaagctgtgaaacactagaccactatgatcccgactatgaattcctccagcaagacctctctaacgcagaccagatacctcagcagacggcctggaaccttagcccgttgccagagtctttgggggagtctgggtctccatttcttggccctcctttccagctgcctcttggcggccatccccagccagacggacctctggccccagggcagcagacagatacgccacctgctctccccgagaagaagcgcaggagcgcagcctcccagacggcggacggctctggctgcagggtgtcctacgagcggcatccctcgcagtatgacaacatctctggggaggacctgcagagcacagccccgatcccatccgtcccctacgcgccctttgctgctattctgccctttcagcatggaggttcctcagcccctgtcgaatttgtgggtgattttactgctcctgagtcaaccggtgacccagaaaaaccacctcctctaccagagaagaaaaacaaacacatgctggcctacatgcagttgctggaggactactcggagccgcagccctctatgttctaccagacgccacagaacgagcacatctaccagcagaagaacaagctcctcatggaggtatacggcttcagcgactccttcagtggggtggactccgtgcaggagctggccccgccgcccgccctaccccccaagcagcggcagctggagccaccggctgggaaagacggacatcccagagatccctcagcggtcagcggcgtccctgggaaggacagcagagacggcagtgagagggccccaaagtcaccagatgctctggagtcggctcagtcggaggaggaagtggacgagctgtccctcattgaccacaacgaaattatgtccaggctgacgctcaagcaggagggtgatgacgggccggacgtccgcggaggatctggggacatcttactggtccatgctactgagactgacaggaaagatttggtgttgtactgcgaggcattcctgaccacctacaggaccttcatctccccagaggagctcatcaagaagctgcagtacagatatgagaaattctctccctttgccgacacattcaagaagcgcgtcagcaagaacacgttcttcgtgctggtacgggtggtggatgagctctgcctggtggagttgacagaagagatcctgaagctgctgatggaactggtcttccgcctggtgtgcaatggggagctgagcctggcccgtgtgctccggaagaacatcctggacaaggtggaccagaagaagctactcaggtgtgccacctccagccagcccctggcagcccggggggtagcagccaggccggggaccttgcacgactttcacagccatgagatagcggagcagctaacgctgctggatgctgagctcttctataaaatagagattcctgaggttttgctttgggcaaaagagcagaatgaggagaagagccccaacttgacccagttcacggagcacttcaacaacatgtcctactgggtccggtccataatcatgttacaggaaaaggcccaggacagggaacggctgctcttgaagttcatcaagatcatgaagcacttgcggaagctgaataacttcaactcctacttggccatcctctctgccctggactcggcgcccatccgcaggctggagtggcagaagcagacttcagagggcctggccgagtactgcacactgatcgacagctcgtcctccttccgagcctaccgggccgccctctcggaggtggaaccgccgtgcatcccgtacctggggctgatcctgcaggacctgaccttcgttcacctgggaaacccagactacatcgacgggaaagtgaacttctccaagcggtggcagcagttcaacatcctcgacagcatgcgctgcttccagcaggcgcactatgacatgcggaggaacgacgacattataaacttcttcaatgacttcagtgaccacctggctgaggaggccctatgggaactgtctctgaaaattaaacccaggaacataacaaggagaaaaacagaccgggaagagaagacctaggagcagacgccgggatccaggagaatgctcgaggggcgcagagggcagctcccagaccggagaggaccttggacctgttaggcgcatggcaggagtcccggcctcggagccatgaggctggccagccctcagcggggccgggcgggagctggagcctgccagccgcttcctgcctccttcctctgtgggagcagacccgtgggcctcagggcagccagcaggcaggtcttgttgccaatttacaaaccggtggttttctggtttggttttgttttctgcttttacttccatctctcccctcttgaccttccacccactcccctccagggagagagcagcagagacctcatcagcagaccaaggaagtggtgggtgctccccctccctaagctccagggtccctgaatcttctgaaatctcaaatgagtggaggcctcctggggtggcctgtcctgcaggggccctggaatgggggcaagcagctgggtgggcagaatgcagagtagactcgggggaggatcctttcactttccgcttccccttctgatgcatggaggatggtgtgagcttttcagcaggcccggaaaggtacgcaggtgacgccttagcagccccgcagctggtgctctgccccgcggtactggcgccatcagggcctcccttgcccgcctgagagcagcagcagtctctgtcatcccgtcgccccttaccccccaccccaggccactgggcccctcccacaccacctggggagctgagaagaggaggctggagtaagggaggacttgatcatccaagaaatactttttattgctgggagtcttctgaacctcaccaaactgaggccagagctgagctcctgggggagttaattcagaggggagaggccagcacctccctcctccatcgctcgctgtgtgccttaaactccatctcatgtccctccccatcccctggctttccctccctccttgccccatcctgggccagccagcagggctcctcctctggctcttcagacctttcagccagtgctgtcagtgcccctgggagggaagggcatccctgaggcacccgaatggtccctcagggtgcagggaggcagaagcctggccacagaggagcctcctaaggcagcagctgcagcaagcgcaccctctccccactctccccacgccagagcggcttccagagcagatgctgtttccatcctcctcgtcaaaaccattctcgctgctgagcttgacaatctgggcaaggcttgtggggcgcttgacaaacagaatctgccctgtgccgcctggttccgtggcctccagcatgagcctgcaggcagggcgctgcgggaacccagttgtgctgccccagcccatgcctccgggtctgctgtgcatgaatgagtgctcacttgtcccgggtttaggacgtggtcaagtgaacagcagggtctaactgtgcttacttagcccagttcaaacagaacaaaggaaaaatatagaaagcaacatctgttgatcatttaggtttttttttaaaccaccatgtcactttgagtccttcatgggtttttgaacagcatttatcaagaagaaaatgtgggctttttcccctctcccgtgttttgtttgtcctgtagatagagggaggaaagccgtgcagtggcaggcgggaccccctctggtggcgggaccccctcttgcggtggtcttgcggggccagccgggacctgtcactttattatttaaggagtgtgtgtgtagagtcgctggcttattaacagtattgtgtgtgggttgggtttttagtttgttccttctttttgaagtcccttcatttcaatccttgactctctctccccttcccttgcccagctctgttgaatgctgctgtgcgcgtgtgagggccgctctgcacacagggcccttgggttgtgtgaactgaaattctccctgtatttgtgagactcgcaggagtccccatctgtagcacaggcaatgccagtgccatgctgcagcctcagaaaccaggcctctcactccagcagcaggcagaaccgtgtctgtggtcgggtgctgtccacagctctgtctgccttgttcttgggcttgagctggatagaggtggggtctcttcaccttccctgaattcagaacagaccctgtgcctggccccagtgtgcccaggcaattccccaggccctcactgggagcccttggtgttctgagcagcagggcccaggcagcacatgagcagtgcccaggggctccctgcgtgaggacggcaaggtgcgatgtatgtctaacttattgatggcaggcagccccctgtgccccctaagcctggccctggttattgctgagctctgtgctcagtgctgcggcctggccgtggctcgtctgttcctttggggggcccgggcgggttgtgggaatcagtcttcacagacagacgtgagccaggcggaggactcgttccttgcagaggtcagtcctcacctgcaggtgtcggggtgtgggggggcaaggaggggcaggcacacaccatgtctgacctgaacccgattctggggagcatcttcccgctccggccccacgacctccacagggttacattgtaatatatatgccccagctaacctgtctgatggtggcatcttcctgcagacatttcaaacatgtaacttttatatgaaaaaaaataaacacagatgaaagctgcccaatgcca

SEQ ID NO: 3528 - DNA, 6266 bp, Homo sapiens
gagattcctcaggcttcccttgtgaggctgcctgggttctgccgctgggtggtttgggatgtccaagagatatcccctttcagccagtgactcggtcctcagttgctgctccggaaagacgctggggctgggaagggccctgtgtcctctggctttaaaatgggcaatgctattgaaaaacagaagcccttgaaacgaagtcatctgtacccctggaaacaagactctcagcgttctcatctctcttccttcaccatgaagctgatggacaaattccactcacccaaaatcaagagaacgccatcaaagaagggaaaaccagctgaggtgtccgtaaagattccagagaagcctgtgaacaaagaggcaacagacagatttctaccagagggctaccctctccccttggatctggagcagcaggcagtagaatttatgtccaccagtgctgtggcttccaggtctcaaaggcagaagaacctgagctggctggaggagaaagagaaggaagttgtcagtgccctgcgctactttaagaccattgtggacaaaatggcaattgataagaaggtactggagatgcttccagggtcagccagcaaggtgctggaggccatcttacccctggtgcagaacgatcctcgaattcagcacagctcagccctctcttcctgctatagccgagtgtaccaaagcctcgccaacctcattcgctggtctgaccaagtgatgctggaaggcgtgaactcagaagacaaggagatggtgacgactgtgaagggggtcatcaaggctgtgctggatggagtgaaggagctggtcaggctcaccatcgagaagcagggacgtccgtctccgacgagccccgtgaagcccagttcccctgccagcaagcctgatggcccagcagagctccccctgacagaccgcgaggtagagatcctaaacaagacgactgggatgtcacagtcaactgagctcctcccagatgccacggatgaagaggtcgcgccccccaagcctcctctgcctggcattcgggtggttgataatagtcctccaccagcattgccacccaagaaaagacagtcggcgccgtcccctacccgagtggctgtggtggcccccatgagccgagccaccagtggctccagtttgcctgttggaatcaataggcaggattttgatgttgactgttacgcacagaggcgactgtcaggaggcagccactcatatggtggagagtcgccccgcctctccccctgcagcagcataggcaagctcagcaagtcagacgagcagctgtcctctctggacagggacagtgggcagtgctcccggaacacaagctgtgaaacactagaccactatgatcccgactatgaattcctccagcaagacctctctaacgcagaccagatacctcagcagacggcctggaaccttagcccgttgccagagtctttgggggagtctgggtctccatttcttggccctcctttccagctgcctcttggcggccatccccagccagacggacctctggccccagggcagcagacagatacgccacctgctctccccgagaagaagcgcaggagcgcagcctcccagacggcggacggctctggctgcagggtgtcctacgagcggcatccctcgcagtatgacaacatctctggggaggacctgcagagcacagccccgatcccatccgtcccctacgcgccctttgctgctattctgccctttcagcatggaggttcctcagcccctgtcgaatttgtgggtgattttactgctcctgagtcaaccggtgacccagaaaaaccacctcctctaccagagaagaaaaacaaacacatgctggcctacatgcagttgctggaggactactcggagccgcagccctctatgttctaccagacgccacagaacgagcacatctaccagcagaagaacaagctcctcatggaggtatacggcttcagcgactccttcagtggggtggactccgtgcaggagctggccccgccgcccgccctaccccccaagcagcggcagctgagtgaaaacgccagtgaggaagctggtgagggtgaatatgtcaatctgtattcctctggccagagcagcgaggagctggctccctctcgaggagagccaccggctgggaaagacggacatcccagagatccctcagcggtcagcggcgtccctgggaaggacagcagagacggcagtgagagggccccaaagtcaccagatgctctggagtcggctcagtcggaggaggaagtggacgagctgtccctcattgaccacaacgaaattatgtccaggctgacgctcaagcaggagggtgatgacgggccggacgtccgcggaggatctggggacatcttactggtccatgctactgagactgacaggaaagatttggtgttgtactgcgaggcattcctgaccacctacaggaccttcatctccccagaggagctcatcaagaagctgcagtacagatatgagaaattctctccctttgccgacacattcaagaagcgcgtcagcaagaacacgttcttcgtgctggtacgggtggtggatgagctctgcctggtggagttgacagaagagatcctgaagctgctgatggaactggtcttccgcctggtgtgcaatggggagctgagcctggcccgtgtgctccggaagaacatcctggacaaggtggaccagaagaagctactcaggtgtgccacctccagccagcccctggcagcccggggggtagcagccaggccggggaccttgcacgactttcacagccatgagatagcggagcagctaacgctgctggatgctgagctcttctataaaatagagattcctgaggttttgctttgggcaaaagagcagaatgaggagaagagccccaacttgacccagttcacggagcacttcaacaacatgtcctactgggtccggtccataatcatgttacaggaaaaggcccaggacagggaacggctgctcttgaagttcatcaagatcatgaagcacttgcggaagctgaataacttcaactcctacttggccatcctctctgccctggactcggcgcccatccgcaggctggagtggcagaagcagacttcagagggcctggccgagtactgcacactgatcgacagctcgtcctccttccgagcctaccgggccgccctctcggaggtggaaccgccgtgcatcccgtacctggggctgatcctgcaggacctgaccttcgttcacctgggaaacccagactacatcgacgggaaagtgaacttctccaagcggtggcagcagttcaacatcctcgacagcatgcgctgcttccagcaggcgcactatgacatgcggaggaacgacgacattataaacttcttcaatgacttcagtgaccacctggctgaggaggccctatgggaactgtctctgaaaattaaacccaggaacataacaaggagaaaaacagaccgggaagagaagacctaggagcagacgccgggatccaggagaatgctcgaggggcgcagagggcagctcccagaccggagaggaccttggacctgttaggcgcatggcaggagtcccggcctcggagccatgaggctggccagccctcagcggggccgggcgggagctggagcctgccagccgcttcctgcctccttcctctgtgggagcagacccgtgggcctcagggcagccagcaggcaggtcttgttgccaatttacaaaccggtggttttctggtttggttttgttttctgcttttacttccatctctcccctcttgaccttccacccactcccctccagggagagagcagcagagacctcatcagcagaccaaggaagtggtgggtgctccccctccctaagctccagggtccctgaatcttctgaaatctcaaatgagtggaggcctcctggggtggcctgtcctgcaggggccctggaatgggggcaagcagctgggtgggcagaatgcagagtagactcgggggaggatcctttcactttccgcttccccttctgatgcatggaggatggtgtgagcttttcagcaggcccggaaaggtacgcaggtgacgccttagcagccccgcagctggtgctctgccccgcggtactggcgccatcagggcctcccttgcccgcctgagagcagcagcagtctctgtcatcccgtcgccccttaccccccaccccaggccactgggcccctcccacaccacctggggagctgagaagaggaggctggagtaagggaggacttgatcatccaagaaatactttttattgctgggagtcttctgaacctcaccaaactgaggccagagctgagctcctgggggagttaattcagaggggagaggccagcacctccctcctccatcgctcgctgtgtgccttaaactccatctcatgtccctccccatcccctggctttccctccctccttgccccatcctgggccagccagcagggctcctcctctggctcttcagacctttcagccagtgctgtcagtgcccctgggagggaagggcatccctgaggcacccgaatggtccctcagggtgcagggaggcagaagcctggccacagaggagcctcctaaggcagcagctgcagcaagcgcaccctctccccactctccccacgccagagcggcttccagagcagatgctgtttccatcctcctcgtcaaaaccattctcgctgctgagcttgacaatctgggcaaggcttgtggggcgcttgacaaacagaatctgccctgtgccgcctggttccgtggcctccagcatgagcctgcaggcagggcgctgcgggaacccagttgtgctgccccagcccatgcctccgggtctgctgtgcatgaatgagtgctcacttgtcccgggtttaggacgtggtcaagtgaacagcagggtctaactgtgcttacttagcccagttcaaacagaacaaaggaaaaatatagaaagcaacatctgttgatcatttaggtttttttttaaaccaccatgtcactttgagtccttcatgggtttttgaacagcatttatcaagaagaaaatgtgggctttttcccctctcccgtgttttgtttgtcctgtagatagagggaggaaagccgtgcagtggcaggcgggaccccctctggtggcgggaccccctcttgcggtggtcttgcggggccagccgggacctgtcactttattatttaaggagtgtgtgtgtagagtcgctggcttattaacagtattgtgtgtgggttgggtttttagtttgttccttctttttgaagtcccttcatttcaatccttgactctctctccccttcccttgcccagctctgttgaatgctgctgtgcgcgtgtgagggccgctctgcacacagggcccttgggttgtgtgaactgaaattctccctgtatttgtgagactcgcaggagtccccatctgtagcacaggcaatgccagtgccatgctgcagcctcagaaaccaggcctctcactccagcagcaggcagaaccgtgtctgtggtcgggtgctgtccacagctctgtctgccttgttcttgggcttgagctggatagaggtggggtctcttcaccttccctgaattcagaacagaccctgtgcctggccccagtgtgcccaggcaattccccaggccctcactgggagcccttggtgttctgagcagcagggcccaggcagcacatgagcagtgcccaggggctccctgcgtgaggacggcaaggtgcgatgtatgtctaacttattgatggcaggcagccccctgtgccccctaagcctggccctggttattgctgagctctgtgctcagtgctgcggcctggccgtggctcgtctgttcctttggggggcccgggcgggttgtgggaatcagtcttcacagacagacgtgagccaggcggaggactcgttccttgcagaggtcagtcctcacctgcaggtgtcggggtgtgggggggcaaggaggggcaggcacacaccatgtctgacctgaacccgattctggggagcatcttcccgctccggccccacgacctccacagggttacattgtaatatatatgccccagctaacctgtctgatggtggcatcttcctgcagacatttcaaacatgtaacttttatatgaaaaaaaataaacacagatgaaagctgcccaatgcc

SEQ ID NO: 3529 - DNA, 6059 bp, Homo sapiens
gagattcctcaggcttcccttgtgaggctgcctgggttctgccgctgggtggtttgggatgtccaagagatatcccctttcagccagtgactcggtcctcagttgctgctccggaaagacgctggggctgggaagggccctgtgtcctctggctttaaaatgggcaatgctattgaaaaacagaagcccttgaaacgaagtcatctgtacccctggaaacaagactctcagcgttctcatctctcttccttcaccatgaagctgatggacaaattccactcacccaaaatcaagagaacgccatcaaagaagggaaaaccagctgaggtgtccgtaaagattccagagaagcctgtgaacaaaaacctgagctggctggaggagaaagagaaggaagttgtcagtgccctgcgctactttaagaccattgtggacaaaatggcaattgataagaaggtactggagatgcttccagggtcagccagcaaggtgctggaggccatcttacccctggtgcagaacgatcctcgaattcagcacagctcagccctctcttcctgctatagccgagtgtaccaaagcctcgccaacctcattcgctggtctgaccaagtgatgctggaaggcgtgaactcagaagacaaggagatggtgacgactgtgaagggggtcatcaaggctgtgctggatggagtgaaggagctggtcaggctcaccatcgagaagcagggacgtccgtctccgacgagccccgtgaagcccagttcccctgccagcaagcctgatggcccagcagagctccccctgacagaccgcgaggtagagatcctaaacaagacgactgggatgtcacagtcaactgagctcctcccagatgccacggatgaagaggtcgcgccccccaagcctcctctgcctggcattcgggtggttgataatagtcctccaccagcattgccacccaagaaaagacagtcggcgccgtcccctacccgagtggctgtggtggcccccatgagccgagccaccagtggctccagtttgcctgttggaatcaataggcaggattttgatgttgactgttacgcacagaggcgactgtcaggaggcagccactcatatggtggagagtcgccccgcctctccccctgcagcagcataggcaagctcagcaagtcagacgagcagctgtcctctctggacagggacagtgggcagtgctcccggaacacaagctgtgaaacactagaccactatgatcccgactatgaattcctccagcaagacctctctaacgcagaccagatacctcagcagacggcctggaaccttagcccgttgccagagtctttgggggagtctgggtctccatttcttggccctcctttccagctgcctcttggcggccatccccagccagacggacctctggccccagggcagcagacagatacgccacctgctctccccgagaagaagcgcaggagcgcagcctcccagacggcggacggctctggctgcagggtgtcctacgagcggcatccctcgcagtatgacaacatctctggggaggacctgcagagcacagccccgatcccatccgtcccctacgcgccctttgctgctattctgccctttcagcatggaggttcctcagcccctgtcgaatttgtgggtgattttactgctcctgagtcaaccggtgacccagaaaaaccacctcctctaccagagaagaaaaacaaacacatgctggcctacatgcagttgctggaggactactcggagccgcagccctctatgttctaccagacgccacagaacgagcacatctaccagcagaagaacaagctcctcatggaggtatacggcttcagcgactccttcagtggggtggactccgtgcaggagctggccccgccgcccgccctaccccccaagcagcggcagctggagccaccggctgggaaagacggacatcccagagatccctcagcggtcagcggcgtccctgggaaggacagcagagacggcagtgagagggccccaaagtcaccagatgctctggagtcggctcagtcggaggaggaagtggacgagctgtccctcattgaccacaacgaaattatgtccaggctgacgctcaagcaggagggtgatgacgggccggacgtccgcggaggatctggggacatcttactggtccatgctactgagactgacaggaaagatttggtgttgtactgcgaggcattcctgaccacctacaggaccttcatctccccagaggagctcatcaagaagctgcagtacagatatgagaaattctctccctttgccgacacattcaagaagcgcgtcagcaagaacacgttcttcgtgctggtacgggtggtggatgagctctgcctggtggagttgacagaagagatcctgaagctgctgatggaactggtcttccgcctggtgtgcaatggggagctgagcctggcccgtgtgctccggaagaacatcctggacaaggtggaccagaagaagctactcaggtgtgccacctccagccagcccctggcagcccggggggtagcagccaggccggggaccttgcacgactttcacagccatgagatagcggagcagctaacgctgctggatgctgagctcttctataaaatagagattcctgaggttttgctttgggcaaaagagcagaatgaggagaagagccccaacttgacccagttcacggagcacttcaacaacatgtcctactgggtccggtccataatcatgttacaggaaaaggcccaggacagggaacggctgctcttgaagttcatcaagatcatgaagcacttgcggaagctgaataacttcaactcctacttggccatcctctctgccctggactcggcgcccatccgcaggctggagtggcagaagcagacttcagagggcctggccgagtactgcacactgatcgacagctcgtcctccttccgagcctaccgggccgccctctcggaggtggaaccgccgtgcatcccgtacctggggctgatcctgcaggacctgaccttcgttcacctgggaaacccagactacatcgacgggaaagtgaacttctccaagcggtggcagcagttcaacatcctcgacagcatgcgctgcttccagcaggcgcactatgacatgcggaggaacgacgacattataaacttcttcaatgacttcagtgaccacctggctgaggaggccctatgggaactgtctctgaaaattaaacccaggaacataacaaggagaaaaacagaccgggaagagaagacctaggagcagacgccgggatccaggagaatgctcgaggggcgcagagggcagctcccagaccggagaggaccttggacctgttaggcgcatggcaggagtcccggcctcggagccatgaggctggccagccctcagcggggccgggcgggagctggagcctgccagccgcttcctgcctccttcctctgtgggagcagacccgtgggcctcagggcagccagcaggcaggtcttgttgccaatttacaaaccggtggttttctggtttggttttgttttctgcttttacttccatctctcccctcttgaccttccacccactcccctccagggagagagcagcagagacctcatcagcagaccaaggaagtggtgggtgctccccctccctaagctccagggtccctgaatcttctgaaatctcaaatgagtggaggcctcctggggtggcctgtcctgcaggggccctggaatgggggcaagcagctgggtgggcagaatgcagagtagactcgggggaggatcctttcactttccgcttccccttctgatgcatggaggatggtgtgagcttttcagcaggcccggaaaggtacgcaggtgacgccttagcagccccgcagctggtgctctgccccgcggtactggcgccatcagggcctcccttgcccgcctgagagcagcagcagtctctgtcatcccgtcgccccttaccccccaccccaggccactgggcccctcccacaccacctggggagctgagaagaggaggctggagtaagggaggacttgatcatccaagaaatactttttattgctgggagtcttctgaacctcaccaaactgaggccagagctgagctcctgggggagttaattcagaggggagaggccagcacctccctcctccatcgctcgctgtgtgccttaaactccatctcatgtccctccccatcccctggctttccctccctccttgccccatcctgggccagccagcagggctcctcctctggctcttcagacctttcagccagtgctgtcagtgcccctgggagggaagggcatccctgaggcacccgaatggtccctcagggtgcagggaggcagaagcctggccacagaggagcctcctaaggcagcagctgcagcaagcgcaccctctccccactctccccacgccagagcggcttccagagcagatgctgtttccatcctcctcgtcaaaaccattctcgctgctgagcttgacaatctgggcaaggcttgtggggcgcttgacaaacagaatctgccctgtgccgcctggttccgtggcctccagcatgagcctgcaggcagggcgctgcgggaacccagttgtgctgccccagcccatgcctccgggtctgctgtgcatgaatgagtgctcacttgtcccgggtttaggacgtggtcaagtgaacagcagggtctaactgtgcttacttagcccagttcaaacagaacaaaggaaaaatatagaaagcaacatctgttgatcatttaggtttttttttaaaccaccatgtcactttgagtccttcatgggtttttgaacagcatttatcaagaagaaaatgtgggctttttcccctctcccgtgttttgtttgtcctgtagatagagggaggaaagccgtgcagtggcaggcgggaccccctctggtggcgggaccccctcttgcggtggtcttgcggggccagccgggacctgtcactttattatttaaggagtgtgtgtgtagagtcgctggcttattaacagtattgtgtgtgggttgggtttttagtttgttccttctttttgaagtcccttcatttcaatccttgactctctctccccttcccttgcccagctctgttgaatgctgctgtgcgcgtgtgagggccgctctgcacacagggcccttgggttgtgtgaactgaaattctccctgtatttgtgagactcgcaggagtccccatctgtagcacaggcaatgccagtgccatgctgcagcctcagaaaccaggcctctcactccagcagcaggcagaaccgtgtctgtggtcgggtgctgtccacagctctgtctgccttgttcttgggcttgagctggatagaggtggggtctcttcaccttccctgaattcagaacagaccctgtgcctggccccagtgtgcccaggcaattccccaggccctcactgggagcccttggtgttctgagcagcagggcccaggcagcacatgagcagtgcccaggggctccctgcgtgaggacggcaaggtgcgatgtatgtctaacttattgatggcaggcagccccctgtgccccctaagcctggccctggttattgctgagctctgtgctcagtgctgcggcctggccgtggctcgtctgttcctttggggggcccgggcgggttgtgggaatcagtcttcacagacagacgtgagccaggcggaggactcgttccttgcagaggtcagtcctcacctgcaggtgtcggggtgtgggggggcaaggaggggcaggcacacaccatgtctgacctgaacccgattctggggagcatcttcccgctccggccccacgacctccacagggttacattgtaatatatatgccccagctaacctgtctgatggtggcatcttcctgcagacatttcaaacatgtaacttttatatgaaaaaaaataaacacagatgaaagctgcccaatgcc

SEQ ID NO: 3530 - DNA, 957 bp, Homo sapiens
gctggccccgccgcccgccctaccccccaagcagcggcagctgagtgaaaacgccagtgaggaagctggtgagggtgaatatgtcaatctgtattcctctggccagagcagcgaggagctggctccctctcgaggagagccaccggctgggaaagacggacatcccagagatccctcagcggtcagcggcgtccctgggaaggacagcagagacggcagtgagagggccccaaagtcaccagatgctctggagtcggctcagtcggaggaggaagtggacgagctgtccctcattgaccacaacgaaattatgtccaggctgacgctcaagcaggagggtgatgacgggccggacgtccgcggaggatctggggacatcttactggtccatgctactgagactgacaggaaagatttggtgttgtactgcgaggcattcctgaccacctacaggaccttcatctccccagaggagctcatcaagaagctgcagtacagatatgagaaattctctccctttgccgacacattcaagaagcgcgtcagcaagaacacgttcttcgtgctggtacgggtggtggatgagctctgcctggtggagttgacagaagagatcctgaagctgctgatggaactggtcttccgcctggtgtgcaatggggagctgagcctggcccgtgtgctccggaagaacatcctggacaaggtggaccagaagaagctactcaggtgtgccacctccagccagcccctggcagcccggggggtagcagccaggccggggaccttgcacgactttcacagccatgagatagcggagcagctaacgctgctggatgctgagctcttctataaaatagagattcctgaggttttgctttgggcaaaagagcagaatgaggagaagagccccaacttgacccagttcacggagcacttcaacaacatgtcctactg

SEQ ID NO: 3531 - DNA, 683 bp, Homo sapiens
ctctaccagagaagaaaaacaaacacatgctggcctacatgcagttgctggaggactactcggagccgcagccctctatgttctaccagacgccacagaacgagcacatctaccagcagaagaacaagctcctcatggaggtatacggcttcagcgactccttcagtggggtggactccgtgcaggagctggccccgccgcccgccctaccccccaagcagcggcagctgcaggcctcctgtgctgcttcttccttctcctctgtctcccactgtgtccagcaaactaaagtggccttcacccccgaggacggcagtgccgctcagggcctcagtgtgtccgtctctaactcctttctcagccggcacggcagcttgcccgtgccctcgtataagtctgtgtttaggtcctactcccaggatttcgtgcctcaccaccaagcttccgttccgcctttccttccgcctacctcctcttcctctccacatttcccacctgcccaccagtctcagagctctgacttagccgtgccaaccatggccggtccacctcccagcaccgtggacgggcctctctcggcttctcaggagagcagctttcatgggaatactgtctgccttccttccgaaacctctttcactgactcggagccaccggctgggaaagacggacatcccagagat

SEQ ID NO: 3532 - DNA, 739 bp, Homo sapiens
gagattcctcaggcttcccttgtgaggctgcctgggttctgccgctgggtggtttgggatgtccaagagatatcccctttcagccagtgactcggtcctcagttgctgctccggaaagacgctggggctgggaagggccctgtgtcctctggctttaaaatgggcaatgctattgaaaaacagaagcccttgaaacgaagtcatctgtacccctggaaacaagactctcagcgttctcatctctcttccttcaccatgaagctgatggacaaattccactcacccaaaatcaagagaacgccatcaaagaagggaaaaccagctgaggtgtccgtaaagattccagagaagcctgtgaacaaagaggcaacagacagatttctaccagagggctaccctctccccttggatctggagcagcaggcagtagaatttatgtccaccagtgctgtggcttccaggtctcaaaggcagaagaacctgagctggctggaggagaaagagaaggaagttgtcagtgccctgcgctactttaagaccattgtggacaaaatggcaattgataagaaggtactggagatgcttccagggtcagccagcaaggtgctggaggccatcttacccctggtgcagaacgatcctcgaattcagcacagctcagccctctcttcctgctatagccgagtgtaccaaagcctcgccaacctcattcgctggtctgaccaagtgatgctggaag

SEQ ID NO: 3533 - DNA, 5799 bp, Homo sapiens
tttaagaccattgtggacaaaatggcaattgataagaaggtactggagatgcttccagggtcagccagcaaggtgctggaggccatcttacccctggtgcagaacgatcctcgaattcagcacagctcagccctctcttcctgctatagccgagtgtaccaaagcctcgccaacctcattcgctggtctgaccaagtgatgctggaaggcgtgaactcagaagacaaggagatggtgacgactgtgaagggggtcatcaaggctgtgctggatggagtgaaggagctggtcaggctcaccatcgagaagcagggacgtccgtctccgacgagccccgtgaagcccagttcccctgccagcaagcctgatggcccagcagagctccccctgacagaccgcgaggtagagatcctaaacaagacgactgggatgtcacagtcaactgagctcctcccagatgccacggatgaagaggtcgcgccccccaagcctcctctgcctggcattcgggtggttgataatagtcctccaccagcattgccacccaagaaaagacagtcggcgccgtcccctacccgagtggctgtggtggcccccatgagccgagccaccagtggctccagtttgcctgttggaatcaataggcaggattttgatgttgactgttacgcacagaggcgactgtcaggaggcagccactcatatggtggagagtcgccccgcctctccccctgcagcagcataggcaagctcagcaagtcagacgagcagctgtcctctctggacagggacagtgggcagtgctcccggaacacaagctgtgaaacactagaccactatgatcccgactatgaattcctccagcaagacctctctaacgcagaccagatacctcagcagacggcctggaaccttagcccgttgccagagtctttgggggagtctgggtctccatttcttggccctcctttccagctgcctcttggcggccatccccagccagacggacctctggccccagggcagcagacagatacgccacctgctctccccgagaagaagcgcaggagcgcagcctcccagacggcggacggctctggctgcagggtgtcctacgagcggcatccctcgcagtatgacaacatctctggggaggacctgcagagcacagccccgatcccatccgtcccctacgcgccctttgctgctattctgccctttcagcatggaggttcctcagcccctgtcgaatttgtgggtgattttactgctcctgagtcaaccggtgacccagaaaaaccacctcctctaccagagaagaaaaacaaacacatgctggcctacatgcagttgctggaggactactcggagccgcagccctctatgttctaccagacgccacagaacgagcacatctaccagcagaagaacaagctcctcatggaggtatacggcttcagcgactccttcagtggggtggactccgtgcaggagctggccccgccgcccgccctaccccccaagcagcggcagctggcctcctgtgctgcttcttccttctcctctgtctcccactgtgtccagcaaactaaagtggccttcacccccgaggacggcagtgccgctcagggcctcagtgtgtccgtctctaactcctttctcagccggcacggcagcttgcccgtgccctcggagccaccggctgggaaagacggacatcccagagatccctcagcggtcagcggcgtccctgggaaggacagcagagacggcagtgagagggccccaaagtcaccagatgctctggagtcggctcagtcggaggaggaagtggacgagctgtccctcattgaccacaacgaaattatgtccaggctgacgctcaagcaggagggtgatgacgggccggacgtccgcggaggatctggggacatcttactggtccatgctactgagactgacaggaaagatttggtgttgtactgcgaggcattcctgaccacctacaggaccttcatctccccagaggagctcatcaagaagctgcagtacagatatgagaaattctctccctttgccgacacattcaagaagcgcgtcagcaagaacacgttcttcgtgctggtacgggtggtggatgagctctgcctggtggagttgacagaagagatcctgaagctgctgatggaactggtcttccgcctggtgtgcaatggggagctgagcctggcccgtgtgctccggaagaacatcctggacaaggtggaccagaagaagctactcaggtgtgccacctccagccagcccctggcagcccggggggtagcagccaggccggggaccttgcacgactttcacagccatgagatagcggagcagctaacgctgctggatgctgagctcttctataaaatagagattcctgaggttttgctttgggcaaaagagcagaatgaggagaagagccccaacttgacccagttcacggagcacttcaacaacatgtcctactgggtccggtccataatcatgttacaggaaaaggcccaggacagggaacggctgctcttgaagttcatcaagatcatgaagcacttgcggaagctgaataacttcaactcctacttggccatcctctctgccctggactcggcgcccatccgcaggctggagtggcagaagcagacttcagagggcctggccgagtactgcacactgatcgacagctcgtcctccttccgagcctaccgggccgccctctcggaggtggaaccgccgtgcatcccgtacctggggctgatcctgcaggacctgaccttcgttcacctgggaaacccagactacatcgacgggaaagtgaacttctccaagcggtggcagcagttcaacatcctcgacagcatgcgctgcttccagcaggcgcactatgacatgcggaggaacgacgacattataaacttcttcaatgacttcagtgaccacctggctgaggaggccctatgggaactgtctctgaaaattaaacccaggaacataacaaggagaaaaacagaccgggaagagaagacctaggagcagacgccgggatccaggagaatgctcgaggggcgcagagggcagctcccagaccggagaggaccttggacctgttaggcgcatggcaggagtcccggcctcggagccatgaggctggccagccctcagcggggccgggcgggagctggagcctgccagccgcttcctgcctccttcctctgtgggagcagacccgtgggcctcagggcagccagcaggcaggtcttgttgccaatttacaaaccggtggttttctggtttggttttgttttctgcttttacttccatctctcccctcttgaccttccacccactcccctccagggagagagcagcagagacctcatcagcagaccaaggaagtggtgggtgctccccctccctaagctccagggtccctgaatcttctgaaatctcaaatgagtggaggcctcctggggtggcctgtcctgcaggggccctggaatgggggcaagcagctgggtgggcagaatgcagagtagactcgggggaggatcctttcactttccgcttccccttctgatgcatggaggatggtgtgagcttttcagcaggcccggaaaggtacgcaggtgacgccttagcagccccgcagctggtgctctgccccgcggtactggcgccatcagggcctcccttgcccgcctgagagcagcagcagtctctgtcatcccgtcgccccttaccccccaccccaggccactgggcccctcccacaccacctggggagctgagaagaggaggctggagtaagggaggacttgatcatccaagaaatactttttattgctgggagtcttctgaacctcaccaaactgaggccagagctgagctcctgggggagttaattcagaggggagaggccagcacctccctcctccatcgctcgctgtgtgccttaaactccatctcatgtccctccccatcccctggctttccctccctccttgccccatcctgggccagccagcagggctcctcctctggctcttcagacctttcagccagtgctgtcagtgcccctgggagggaagggcatccctgaggcacccgaatggtccctcagggtgcagggaggcagaagcctggccacagaggagcctcctaaggcagcagctgcagcaagcgcaccctctccccactctccccacgccagagcggcttccagagcagatgctgtttccatcctcctcgtcaaaaccattctcgctgctgagcttgacaatctgggcaaggcttgtggggcgcttgacaaacagaatctgccctgtgccgcctggttccgtggcctccagcatgagcctgcaggcagggcgctgcgggaacccagttgtgctgccccagcccatgcctccgggtctgctgtgcatgaatgagtgctcacttgtcccgggtttaggacgtggtcaagtgaacagcagggtctaactgtgcttacttagcccagttcaaacagaacaaaggaaaaatatagaaagcaacatctgttgatcatttaggtttttttttaaaccaccatgtcactttgagtccttcatgggtttttgaacagcatttatcaagaagaaaatgtgggctttttcccctctcccgtgttttgtttgtcctgtagatagagggaggaaagccgtgcagtggcaggcgggaccccctctggtggcgggaccccctcttgcggtggtcttgcggggccagccgggacctgtcactttattatttaaggagtgtgtgtgtagagtcgctggcttattaacagtattgtgtgtgggttgggtttttagtttgttccttctttttgaagtcccttcatttcaatccttgactctctctccccttcccttgcccagctctgttgaatgctgctgtgcgcgtgtgagggccgctctgcacacagggcccttgggttgtgtgaactgaaattctccctgtatttgtgagactcgcaggagtccccatctgtagcacaggcaatgccagtgccatgctgcagcctcagaaaccaggcctctcactccagcagcaggcagaaccgtgtctgtggtcgggtgctgtccacagctctgtctgccttgttcttgggcttgagctggatagaggtggggtctcttcaccttccctgaattcagaacagaccctgtgcctggccccagtgtgcccaggcaattccccaggccctcactgggagcccttggtgttctgagcagcagggcccaggcagcacatgagcagtgcccaggggctccctgcgtgaggacggcaaggtgcgatgtatgtctaacttattgatggcaggcagccccctgtgccccctaagcctggccctggttattgctgagctctgtgctcagtgctgcggcctggccgtggctcgtctgttcctttggggggcccgggcgggttgtgggaatcagtcttcacagacagacgtgagccaggcggaggactcgttccttgcagaggtcagtcctcacctgcaggtgtcggggtgtgggggggcaaggaggggcaggcacacaccatgtctgacctgaacccgattctggggagcatcttcccgctccggccccacgacctccacagggttacattgtaatatatatgccccagctaacctgtctgatggtggcatcttcctgcagacatttcaaacatgtaacttttatatgaaaaaaaataaacacagatgaaagctgcccaatgcca

SEQ ID NO: 3534 - DNA, 4322 bp, Homo sapiens
ccttttctgggcaccgccttctgctagggggttgtagatgaaagtgcctgctcccagagaagcttgtctaacctagcacagtttctaagctacccaggctgccagaccgagcgaccgtgctgccatggacacagactctcagcgttctcatctctcttccttcaccatgaagctgatggacaaattccactcacccaaaatcaagagaacgccatcaaagaagggaaaaccagctgaggtgtccgtaaagattccagagaagcctgtgaacaaagaggcaacagacagatttctaccagagggctaccctctccccttggatctggagcagcaggcagtagaatttatgtccaccagtgctgtggcttccaggtctcaaaggcagaagaacctgagctggctggaggagaaagagaaggaagttgtcagtgccctgcgctactttaagaccattgtggacaaaatggcaattgataagaaggtactggagatgcttccagggtcagccagcaaggtgctggaggccatcttacccctggtgcagaacgatcctcgaattcagcacagctcagccctctcttcctgctatagccgagtgtaccaaagcctcgccaacctcattcgctggtctgaccaagtgatgctggaaggcgtgaactcagaagacaaggagatggtgacgactgtgaagggggtcatcaaggctgtgctggatggagtgaaggagctggtcaggctcaccatcgagaagcagggacgtccgtctccgacgagccccgtgaagcccagttcccctgccagcaagcctgatggcccagcagagctccccctgacagaccgcgaggtagagatcctaaacaagacgactgggatgtcacagtcaactgagctcctcccagatgccacggatgaagaggtcgcgccccccaagcctcctctgcctggcattcgggtggttgataatagtcctccaccagcattgccacccaagaaaagacagtcggcgccgtcccctacccgagtggctgtggtggcccccatgagccgagccaccagtggctccagtttgcctgttggaatcaataggcaggattttgatgttgactgttacgcacagaggcgactgtcaggaggcagccactcatatggtggagagtcgccccgcctctccccctgcagcagcataggcaagctcagcaagtcagacgagcagctgtcctctctggacagggacagtgggcagtgctcccggaacacaagctgtgaaacactagaccactatgatcccgactatgaattcctccagcaagacctctctaacgcagaccagatacctcagcagacggcctggaaccttagcccgttgccagagtctttgggggagtctgggtctccatttcttggccctcctttccagctgcctcttggcggccatccccagccagacggacctctggccccagggcagcagacagatacgccacctgctctccccgagaagaagcgcaggagcgcagcctcccagacggcggacggctctggctgcagggtgtcctacgagcggcatccctcgcagtatgacaacatctctggggaggacctgcagagcacagccccgatcccatccgtcccctacgcgccctttgctgctattctgccctttcagcatggaggttcctcagcccctgtcgaatttgtgggtgattttactgctcctgagtcaaccggtgacccagaaaaaccacctcctctaccagagaagaaaaacaaacacatgctggcctacatgcagttgctggaggactactcggagccgcagccctctatgttctaccagacgccacagaacgagcacatctaccagcagaagaacaagctcctcatggaggtatacggcttcagcgactccttcagtggggtggactccgtgcaggagctggccccgccgcccgccctaccccccaagcagcggcagctgtataagtctgtgtttaggtcctactcccaggatttcgtgcctcaccaccaagcttccgttccgcctttccttccgcctacctcctcttcctctccacatttcccacctgcccaccagtctcagagctctgacttagccgtgccaaccatggccggtccacctcccagcaccgtggacgggcctctctcggcttctcaggagagcagctttcatgggaatactgtctgccttccttccgaaacctctttcactgactcggagccaccggctgggaaagacggacatcccagagatccctcagcggtcagcggcgtccctgggaaggacagcagagacggcagtgagagggccccaaagtcaccagatgctctggagtcggctcagtcggaggaggaagtggacgagctgtccctcattgaccacaacgaaattatgtccaggctgacgctcaagcaggagggtgatgacgggccggacgtccgcggaggatctggggacatcttactggtccatgctactgagactgacaggaaagatttggtgttgtactgcgaggcattcctgaccacctacaggaccttcatctccccagaggagctcatcaagaagctgcagtacagatatgagaaattctctccctttgccgacacattcaagaagcgcgtcagcaagaacacgttcttcgtgctggtacgggtggtggatgagctctgcctggtggagttgacagaagagatcctgaagctgctgatggaactggtcttccgcctggtgtgcaatggggagctgagcctggcccgtgtgctccggaagaacatcctggacaaggtggaccagaagaagctactcaggtgtgccacctccagccagcccctggcagcccggggggtagcagccaggccggggaccttgcacgactttcacagccatgagatagcggagcagctaacgctgctggatgctgagctcttctataaaatagagattcctgaggttttgctttgggcaaaagagcagaatgaggagaagagccccaacttgacccagttcacggagcacttcaacaacatgtcctactgggtccggtccataatcatgttacaggaaaaggcccaggacagggaacggctgctcttgaagttcatcaagatcatgaagcacttgcggaagctgaataacttcaactcctacttggccatcctctctgccctggactcggcgcccatccgcaggctggagtggcagaagcagacttcagagggcctggccgagtactgcacactgatcgacagctcgtcctccttccgagcctaccgggccgccctctcggaggtggaaccgccgtgcatcccgtacctggggctgatcctgcaggacctgaccttcgttcacctgggaaacccagactacatcgacgggaaagtgaacttctccaagcggtggcagcagttcaacatcctcgacagcatgcgctgcttccagcaggcgcactatgacatgcggaggaacgacgacattataaacttcttcaatgacttcagtgaccacctggctgaggaggccctatgggaactgtctctgaaaattaaacccaggaacataacaaggagaaaaacagaccgggaagagaagacctaggagcagacgccgggatccaggagaatgctcgaggggcgcagagggcagctcccagaccggagaggaccttggacctgttaggcgcatggcaggagtcccggcctcggagccatgaggctggccagccctcagcggggccgggcgggagctggagcctgccagccgcttcctgcctccttcctctgtgggagcagacccgtgggcctcagggcagccagcaggcaggtcttgttgccaatttacaaaccggtggttttctggtttggttttgttttctgcttttacttccatctctcccctcttgaccttccacccactcccctccagggagagagcagcagagacctcatcagcagaccaaggaagtggtgggtgctccccctccctaagctccagggtccctgaatcttctgaaatctcaaatgagtggaggcctcctggggtggcctgtcctgcaggggccctggaatgggggcaagcagctgggtgggcagaatgcagagtagactcgggggaggatcctttcactttccgcttccccttctgatgcatggaggatggtgtgagcttttcagcaggcccggaaaggtacgcaggtgacgccttagcagccccgcagctggtgctctgccccgcggtactggcgccatcagggcctcccttgcccgcctgagagcagcagcagtctctgtcatcccgtcgcccc

SEQ ID NO: 3535 - DNA, 6683 bp, Homo sapiens
gagattcctcaggcttcccttgtgaggctgcctgggttctgccgctgggtggtttgggatgtccaagagatatcccctttcagccagtgactcggtcctcagttgctgctccggaaagacgctggggctgggaagggccctgtgtcctctggctttaaaatgggcaatgctattgaaaaacagaagcccttgaaacgaagtcatctgtacccctggaaacaagactctcagcgttctcatctctcttccttcaccatgaagctgatggacaaattccactcacccaaaatcaagagaacgccatcaaagaagggaaaaccagctgaggtgtccgtaaagattccagagaagcctgtgaacaaagaggcaacagacagatttctaccagagggctaccctctccccttggatctggagcagcaggcagtagaatttatgtccaccagtgctgtggcttccaggtctcaaaggcagaagaacctgagctggctggaggagaaagagaaggaagttgtcagtgccctgcgctactttaagaccattgtggacaaaatggcaattgataagaaggtactggagatgcttccagggtcagccagcaaggtgctggaggccatcttacccctggtgcagaacgatcctcgaattcagcacagctcagccctctcttcctgctatagccgagtgtaccaaagcctcgccaacctcattcgctggtctgaccaagtgatgctggaaggcgtgaactcagaagacaaggagatggtgacgactgtgaagggggtcatcaaggctgtgctggatggagtgaaggagctggtcaggctcaccatcgagaagcagggacgtccgtctccgacgagccccgtgaagcccagttcccctgccagcaagcctgatggcccagcagagctccccctgacagaccgcgaggtagagatcctaaacaagacgactgggatgtcacagtcaactgagctcctcccagatgccacggatgaagaggtcgcgccccccaagcctcctctgcctggcattcgggtggttgataatagtcctccaccagcattgccacccaagaaaagacagtcggcgccgtcccctacccgagtggctgtggtggcccccatgagccgagccaccagtggctccagtttgcctgttggaatcaataggcaggattttgatgttgactgttacgcacagaggcgactgtcaggaggcagccactcatatggtggagagtcgccccgcctctccccctgcagcagcataggcaagctcagcaagtcagacgagcagctgtcctctctggacagggacagtgggcagtgctcccggaacacaagctgtgaaacactagaccactatgatcccgactatgaattcctccagcaagacctctctaacgcagaccagatacctcagcagacggcctggaaccttagcccgttgccagagtctttgggggagtctgggtctccatttcttggccctcctttccagctgcctcttggcggccatccccagccagacggacctctggccccagggcagcagacagatacgccacctgctctccccgagaagaagcgcaggagcgcagcctcccagacggcggacggctctggctgcagggtgtcctacgagcggcatccctcgcagtatgacaacatctctggggaggacctgcagagcacagccccgatcccatccgtcccctacgcgccctttgctgctattctgccctttcagcatggaggttcctcagcccctgtcgaatttgtgggtgattttactgctcctgagtcaaccggtgacccagaaaaaccacctcctctaccagagaagaaaaacaaacacatgctggcctacatgcagttgctggaggactactcggagccgcagccctctatgttctaccagacgccacagaacgagcacatctaccagcagaagaacaagctcctcatggaggtatacggcttcagcgactccttcagtggggtggactccgtgcaggagctggccccgccgcccgccctaccccccaagcagcggcagctgcaggcctcctgtgctgcttcttccttctcctctgtctcccactgtgtccagcaaactaaagtggccttcacccccgaggacggcagtgccgctcagggcctcagtgtgtccgtctctaactcctttctcagccggcacggcagcttgcccgtgccctcgtataagtctgtgtttaggtcctactcccaggatttcgtgcctcaccaccaagcttccgttccgcctttccttccgcctacctcctcttcctctccacatttcccacctgcccaccagtctcagagctctgacttagccgtgccaaccatggccggtccacctcccagcaccgtggacgggcctctctcggcttctcaggagagcagctttcatgggaatactgtctgccttccttccgaaacctctttcactgactcgagtgaaaacgccagtgaggaagctggtgagggtgaatatgtcaatctgtattcctctggccagagcagcgaggagctggctccctctcgaggagagccaccggctgggaaagacggacatcccagagatccctcagcggtcagcggcgtccctgggaaggacagcagagacggcagtgagagggccccaaagtcaccagatgctctggagtcggctcagtcggaggaggaagtggacgagctgtccctcattgaccacaacgaaattatgtccaggctgacgctcaagcaggagggtgatgacgggccggacgtccgcggaggatctggggacatcttactggtccatgctactgagactgacaggaaagatttggtgttgtactgcgaggcattcctgaccacctacaggaccttcatctccccagaggagctcatcaagaagctgcagtacagatatgagaaattctctccctttgccgacacattcaagaagcgcgtcagcaagaacacgttcttcgtgctggtacgggtggtggatgagctctgcctggtggagttgacagaagagatcctgaagctgctgatggaactggtcttccgcctggtgtgcaatggggagctgagcctggcccgtgtgctccggaagaacatcctggacaaggtggaccagaagaagctactcaggtgtgccacctccagccagcccctggcagcccggggggtagcagccaggccggggaccttgcacgactttcacagccatgagatagcggagcagctaacgctgctggatgctgagctcttctataaaatagagattcctgaggttttgctttgggcaaaagagcagaatgaggagaagagccccaacttgacccagttcacggagcacttcaacaacatgtcctactgggtccggtccataatcatgttacaggaaaaggcccaggacagggaacggctgctcttgaagttcatcaagatcatgaagcacttgcggaagctgaataacttcaactcctacttggccatcctctctgccctggactcggcgcccatccgcaggctggagtggcagaagcagacttcagagggcctggccgagtactgcacactgatcgacagctcgtcctccttccgagcctaccgggccgccctctcggaggtggaaccgccgtgcatcccgtacctggggctgatcctgcaggacctgaccttcgttcacctgggaaacccagactacatcgacgggaaagtgaacttctccaagcggtggcagcagttcaacatcctcgacagcatgcgctgcttccagcaggcgcactatgacatgcggaggaacgacgacattataaacttcttcaatgacttcagtgaccacctggctgaggaggccctatgggaactgtctctgaaaattaaacccaggaacataacaaggagaaaaacagaccgggaagagaagacctaggagcagacgccgggatccaggagaatgctcgaggggcgcagagggcagctcccagaccggagaggaccttggacctgttaggcgcatggcaggagtcccggcctcggagccatgaggctggccagccctcagcggggccgggcgggagctggagcctgccagccgcttcctgcctccttcctctgtgggagcagacccgtgggcctcagggcagccagcaggcaggtcttgttgccaatttacaaaccggtggttttctggtttggttttgttttctgcttttacttccatctctcccctcttgaccttccacccactcccctccagggagagagcagcagagacctcatcagcagaccaaggaagtggtgggtgctccccctccctaagctccagggtccctgaatcttctgaaatctcaaatgagtggaggcctcctggggtggcctgtcctgcaggggccctggaatgggggcaagcagctgggtgggcagaatgcagagtagactcgggggaggatcctttcactttccgcttccccttctgatgcatggaggatggtgtgagcttttcagcaggcccggaaaggtacgcaggtgacgccttagcagccccgcagctggtgctctgccccgcggtactggcgccatcagggcctcccttgcccgcctgagagcagcagcagtctctgtcatcccgtcgccccttaccccccaccccaggccactgggcccctcccacaccacctggggagctgagaagaggaggctggagtaagggaggacttgatcatccaagaaatactttttattgctgggagtcttctgaacctcaccaaactgaggccagagctgagctcctgggggagttaattcagaggggagaggccagcacctccctcctccatcgctcgctgtgtgccttaaactccatctcatgtccctccccatcccctggctttccctccctccttgccccatcctgggccagccagcagggctcctcctctggctcttcagacctttcagccagtgctgtcagtgcccctgggagggaagggcatccctgaggcacccgaatggtccctcagggtgcagggaggcagaagcctggccacagaggagcctcctaaggcagcagctgcagcaagcgcaccctctccccactctccccacgccagagcggcttccagagcagatgctgtttccatcctcctcgtcaaaaccattctcgctgctgagcttgacaatctgggcaaggcttgtggggcgcttgacaaacagaatctgccctgtgccgcctggttccgtggcctccagcatgagcctgcaggcagggcgctgcgggaacccagttgtgctgccccagcccatgcctccgggtctgctgtgcatgaatgagtgctcacttgtcccgggtttaggacgtggtcaagtgaacagcagggtctaactgtgcttacttagcccagttcaaacagaacaaaggaaaaatatagaaagcaacatctgttgatcatttaggtttttttttaaaccaccatgtcactttgagtccttcatgggtttttgaacagcatttatcaagaagaaaatgtgggctttttcccctctcccgtgttttgtttgtcctgtagatagagggaggaaagccgtgcagtggcaggcgggaccccctctggtggcgggaccccctcttgcggtggtcttgcggggccagccgggacctgtcactttattatttaaggagtgtgtgtgtagagtcgctggcttattaacagtattgtgtgtgggttgggtttttagtttgttccttctttttgaagtcccttcatttcaatccttgactctctctccccttcccttgcccagctctgttgaatgctgctgtgcgcgtgtgagggccgctctgcacacagggcccttgggttgtgtgaactgaaattctccctgtatttgtgagactcgcaggagtccccatctgtagcacaggcaatgccagtgccatgctgcagcctcagaaaccaggcctctcactccagcagcaggcagaaccgtgtctgtggtcgggtgctgtccacagctctgtctgccttgttcttgggcttgagctggatagaggtggggtctcttcaccttccctgaattcagaacagaccctgtgcctggccccagtgtgcccaggcaattccccaggccctcactgggagcccttggtgttctgagcagcagggcccaggcagcacatgagcagtgcccaggggctccctgcgtgaggacggcaaggtgcgatgtatgtctaacttattgatggcaggcagccccctgtgccccctaagcctggccctggttattgctgagctctgtgctcagtgctgcggcctggccgtggctcgtctgttcctttggggggcccgggcgggttgtgggaatcagtcttcacagacagacgtgagccaggcggaggactcgttccttgcagaggtcagtcctcacctgcaggtgtcggggtgtgggggggcaaggaggggcaggcacacaccatgtctgacctgaacccgattctggggagcatcttcccgctccggccccacgacctccacagggttacattgtaatatatatgccccagctaacctgtctgatggtggcatcttcctgcagacatttcaaacatgtaacttttatatgaaaaaaaataaacacagatgaaagctgcccaatgcc

SEQ ID NO: 3536 - DNA, 588 bp, Homo sapiens
gcggccgcgcggagcccgccatgccggcgcgggtctgaggcgtggcgagccagggccgaggcgagcggcgggcgcgccgcccctgtcgccccgcggcggcccggcccgggcccgatgagcggcggcctcggcctccggcgcagcccggaaatgtccggcaagatcgagaaagcagactctcagcgttctcatctctcttccttcaccatgaagctgatggacaaattccactcacccaaaatcaagagaacgccatcaaagaagggaaaaccagctgaggtgtccgtaaagattccagagaagcctgtgaacaaaaacctgagctggctggaggagaaagagaaggaagttgtcagtgccctgcgctactttaagaccattgtggacaaaatggcaattgataagaaggtactggagatgcttccagggtcagccagcaaggtgctggaggccatcttacccctggtgcagaacgatcctcgaattcagcacagctcagccctctcttcctgctatagccgagtgtaccaaagcctcgccaacctcattcgctggtctgaccaagtgatgctggaaggcgtgaactca

SEQ ID NO: 3537 - DNA, 563 bp, Homo sapiens
acaacatctctggggaggacctgcagagcacagccccgatcccatccgtcccctacgcgccctttgctgctattctgccctttcagcatggaggttcctcagcccctgtcgaatttgtgggtgattttactgctcctgagtcaaccggtgacccagaaaaaccacctcctctaccagagaagaaaaacaaacacatgctggcctacatgcagttgctggaggactactcggagccgcagccctctatgttctaccagacgccacagaacgagcacatctaccagcagaagaacaagctcctcatggaggtatacggcttcagcgactccttcagtggggtggactccgtgcaggagctggccccgccgcccgccctaccccccaagcagcggcagctggagccaccggctgggaaagacggacatcccagagatccctcagcggtcagcggcgtccctgggaaggacagcagagacggcagtgagagcggaatcacttccgtgtacagatggaacatccagaggcagcagcgactgtcctatggccacacagccagtcagtag

SEQ ID NO: 3538 - DNA, 10180 bp, Homo sapiens
tgagtaaacagccggagctgggaaagtcgagctctggcagcgtctgggtgctgaggggcagaggcggagagaaccctgtcctgatcttcctaggtgggataaatatcggggtgacagtggtaggccgcggggaaccctcagtctgcccaccctccgccccctcgcggcgagatgcctcgttccccgggcttctcccgccctccgccgatctcctccctctgttgaaagctgcccgggaaagtggtggcgggagcgggcccaggcccgaatgtggcgtgggctcaggtgtctggtgtcgggcgccggaggaggttcgcgctggggtttggtgattcggaggcctggggtgcagacgcggcgtggctgtgaggcccgggcgggcgtgcgggtgtgagggccggactcacactgggccgccgcggggctgtttccatcggtcactggattttctcctcttccggttcgggcctcagggtggccgacatgacggccaggggtcagagccccctcgcgccgctgttggagactttggaagacccttctgcctcccatggagggcagactgacgcttacctgactctgaccagtcgtatgactggagaagaaggaaaagaagtaattacagaaattgagaaaaaacttcctcggctgtacaaagttttaaagactcacatttccagtcaaaactcggagctgagtagtgctgctctacaagccctggggttttgcttatataatcccaaaattacctcagaattatcagaggcaaatgctctagaattgctttcaaaattgaatgataccattaagaattcagacaaaaatgtacgtactagagcactttgggtgatatctaagcagacatttccctctgaagtggttggcaaaatggtatccagtataattgattcattagaaatactgtttaacaaaggagagacgcattctgctgttgttgattttgaagcattaaatgttatcgtaaggctaattgaacaagccccaattcaaatgggagaagaggcagtgaggtgggcaaaactggtcatacctttagtggttcattcagcacaaaaggtacatttgcggggagcaactgctctggagatgggaatgccattattgcttcagaaacagcaagaaatagcatctattacggagcagcttatgactactaaattaatctcagaacttcagaagctatttatgagtaaaaatgagacttacgtgttaaaattatggcctttgtttgtcaaactacttggaaggaccttgcatcgaagtgggagtttcatcaattctctcttgcaactagaagaacttggatttcgtagtggagcacccatgattaaaaagatagcttttattgcttggaagagtttaatagataattttgctttaaatccagatatactatgtagtgcaaaaagactcaagttgttaatgcagcctttgagttccatccatgtgagaacagaaactctagcattaacaaaactagaagtctggtggtatttactgatgagacttggacctcatcttcctgctaattttgaacaggtttgtgtgcctctgattcaaagtacaataagcattgattctaatgcctcacctcagggcaattcgtgtcatgtagctacatctccaggtttaaatcctatgactcctgtacacaaaggtgcttcctccccgtacggagccccgggaactccccgaatgaacctgagttcgaatttaggtggaatggccacaatcccatccattcaacttttgggacttgaaatgttgcttcatttcttgttgggtccagaagccttgagttttgctaagcaaaataaacttgtgctgagcttagagccattggaacatccgttaatcagcagcccttcctttttttccaaacatgcaaatacacttatcactgctgttcatgatagctttgttgcagttggaaaagatgcccccgatgtggttgtcagtgctatctggaaggagctaattagcttggtgaagtcagttactgaatcaggtaacaaaaaagagaaaccaggttctgaagttttgactctcttattaaagtctttggaaagcatagtaaagtctgaagtatttcctgtatcaaaaacgctggtcctcatggaaattacaattaaaggacttcctcagaaagtattaggttcaccagcatatcaggttgctaatatggatattcttaatggaactccagctttgttcttaattcaattaattttcaacaatttcttggaatgtggtgtatcagatgaaaggttctttctcagtttggaatcacttgtaggctgtgttctttctggtccaacttcaccactagctttcagtgactcagttttaaatgttattaatcaaaatgcaaagcagttggaaaataaggagcatctctggaaaatgtggagtgttatagtcaccccattaactgaattgattaatcagaccaatgaagtaaatcaaggtgatgccttagaacataattttagtgccatctatggtgcattgactttaccagtaaaccacattttttcagaacagagatttccagtggccaccatgaagactttgcttagaacttggtcagaattatatagagcatttgctcgttgtgctgctttggtggcaacagcagaagagaacttgtgctgtgaggaactttcttccaagataatgtccagtttggaagatgaaggcttttctaatttgttgttcgtggatagaattatttatattattactgtaatggttgattgcattgacttctcaccatataatattaaatatcagcccaaagttaaatcaccacagagaccttcagattggtccaaaaagaagaatgagcccctagggaaattgacttctttatttaaacttattgtgaaagtgatctattctttccacacactgagcttcaaggaagcacattctgataccctcttcactattggcaactcaatcaccggcattatttccagtgtacttgggcatatttctttgccttctatgatccgaaaaatatttgcaactttaacaagacctctggcattattttatgaaaactcaaagcttgatgaagttcctaaagtatatagttgtctgaacaacaagttagaaaagctactgggagaaattattgcttgtctgcaattcagctacaccggaacttatgatagtgaacttcttgaacaactctccccactattatgcataatatttctgcacaagaataaacagattcgaaaacagagtgctcagttctggaatgccacttttgccaaagtgatgatgttggtttatcctgaagagttaaaaccagtactaacacaagccaaacaaaaatttctgctcctgttgcctggtttggaaactgttgaaatgatggaggaatccagtggaccatattctgatggaacagaaaattcacaactaaatgtgaagataagtggcatggagagaaaatcaaatggaaaaagagattcatttttggcacaaacaaagaataaaaaagaaaatatgaaaccagcagccaaactgaaacttgaatcttcgtctttaaaagtaaagggtgaaattcttttggaagaggaaaagtctactgactttgtgtttatacctccagaaggaaaagatgcaaaggaaagaatattaactgatcatcaaaaagaagttctcaaaacaaagcggtgtgatattcctgccatgtataataatctggatgtttcccaagataccttatttactcagtatagtcaggaagagcctatggaaattcctactttaaccagaaaaccaaaggaggattctaagatgatgattacggaggagcaaatggacagtgacattgtcattcctcaagatgtcacggaagactgtggtatggctgaacatcttgaaaagtcctccctttcgaataatgagtgtggttctcttgacaaaaccagtccagaaatgtcaaacagtaataatgatgaaagaaaaaaagctttaatttcatcaaggaaaacatcaactgaatgtgcatctagtacagaaaattctttcgttgtcagcagtagttcagtttctaataccactgttgctggaactcccccataccctacaagtcggaggcaaacctttattactttggagaagtttgatggttcagaaaatagaccttttagtccatcccccttgaataatatttcatcaactgttacagtgaaaaataaccaggaaaccatgattaaaacagattttctaccaaaagcaaagcaaagagaagggactttttcaaaatctgattctgaaaaaatagtgaatggaactaagagatcaagccggagagctggtaaagctgaacaaacagggaataaaaggtctaagcccttaatgagatctgagccggagaaaaatactgaggaatctgttgaaggcattgtagtcttagaaaataacccacctggtttgcttaatcaaacagaatgtgtgtcagataatcaggttcatctttctgaatctacaatggagcatgacaatacaaagcttaaagcagcaacagtggaaaatgctgtattattggaaactaatactgtagaggagaaaaatgtagaaattaatttggaatccaaagagaatacacccccagtagtaatatcagcagatcaaatggtaaatgaggatagtcaggttcagataactccaaatcagaaaacccttagacggtcttcaaggcgacgttcagaagtagtagagtctaccactgaaagccaagataaggaaaatagtcatcaaaaaaaggaacgacgtaaggaagaagaaaaacctcttcagaagagtccattgcatataaaagatgatgtgttacctaaacaaaaactgattgctgaacaaactctacaggagaatttaattgagaaaggaagtaatttacatgagaagactcttggggaaactagtgctaatgcagaaactgaacaaaataaaaaaaaggcagaccctgagaacattaagtctgagggggatggtacccaggacattgtagataagtcctctgagaaactagtcagaggccgaacacggtatcaaactagaagagcatctcagggtttgctttccagcattgaaaactcagaatctgatagttcggaggcaaaagaagaaggttctaggaagaagagatctggaaaatggaaaaacaaaagcaatgaaagtgttgacattcaagatcaagaagagaaagtggtgaaacaggaatgtataaaagctgaaaatcagtcacatgattataaagcaacttctgaagaagatgtaagcataaaatctccgatttgcgaaaaacaagatgaaagtaatactgtaatatgtcaggattctacagtaacttcagatttgttgcaagttcctgatgatttaccaaatgtgtgtgaggaaaaaaatgaaactagcaaatatgcagaatattcctttacaagtctacctgtgccagaatcaaatctaaggactagaaatgccattaagagattacataagcgagactcttttgataattgtagtttgggagaatcctcaaaaatagggatatcagatatttcttcgctttcagaaaaaacttttcaaacacttgaatgccaacacaagagaagtaggagggtgaggagatctaaaggttgtgattgctgtggggaaaaatcacaacctcaggaaaagtcactcattgggttaaagaatacagaaaataatgacgtagagattagtgaaacaaaaaaggcagatgtgcaagcacctgtaagcccatcagaaacttctcaagctaatccatattctgaaggacaatttttagatgaacatcatagtgtgaattttcatttgggtctcaaagaggataatgatactattaatgattcattaattgtttctgaaaccaaatcaaaagaaaacactatgcaagaatctcttccttctggaatagtaaactttagagaggaaatttgtgatatggattctagtgaagcaatgtctcttgaaagccaggagtcacctaatgaaaattttaaaactgttggcccgtgtttaggagactcgaaaaatgtttcacaggaatctttggagacaaaagaagaaaaaccagaagaaaccccaaaaatggaactgagtctagagaatgttactgttgaaggaaatgcatgtaaagtaacagaatccaatctagagaaagcaaaaactatggaattgaatgtaggaaatgaagctagctttcatggacaagagagaaccaaaactggtatttctgaagaagcagcaatagaagaaaataaaagaaatgatgactctgaagcagacacagctaaactgaatgccaaagaagtagcaactgaggaatttaattcagatattagtctttctgataatactacacctgtaaaattgaatgctcaaactgagatttctgaacaaacagcagctggggaactagatggaggaaatgatgtatctgatctacactcatctgaagaaacgaataccaaaatgaaaaataatgaagaaatgatgatcggcgaggcaatggctgaaactggccatgatggtgaaacagagaatgagggcataactaccaaaacctcaaagcctgatgaagctgaaacaaacatgttgactgcagaaatggacaactttgtttgtgacacagttgaaatgagcactgaagaaggaatcattgacgctaataaaactgaaacaaatactgagtatagtaaatctgaagaaaaattagataacaatcaaatggtaatggaaagtgatattttacaggaagatcaccatacttcacagaaagtggaggaaccatcacagtgtctggcatctggaacagctatctctgagctaataatagaagacaataatgcatctcctcaaaaactaagggaacttgatccttcacttgtgtcagcaaatgacagtcctagtggcatgcagacacgctgtgtctggtctcctttggcttctccgtctacgagcattttaaagagaggactaaaaagatcccaagaagatgaaatctcatcacctgttaataaggttcgccgtgtctcctttgcagatccaatataccaagcaggattggcagatgacattgatagacggtgctctattgttaggtcccattcttccaatagttctcccataggaaaaagtgttaaaacttctcctactacacaatctaagcataataccacttcagccaaaggatttctgtccccaggatcacgtagccctaaatttaagagctcaaagaagtgtttaatttcagaaatggccaaagaatccataccatgcccaacagaaagtgtttacccaccattggtgaactgtgtggcaccagttgacatcattttacctcagattacatcaaacatgtgggcaagaggcctgggacaactcattagagctaagaatataaaaactattggtgatttgagtactcttacagcatctgaaataaaaactcttcctatccgttctccaaaagtgtccaatgtaaaaaaggctctcagaatatatcatgagcagcaggtgaagactcgtggactagaagagattccagtttttgatatttctgaaaaaacagtaaatggaatagaaaataaatctttgtcacctgatgaagaaagacttgtctcagatataattgatcctgttgctttagaaattccattatccaaaaaccttctggcacagattagtgctcttgctcttcagctggattcagaagatcttcataattattcaggaagccaactatttgaaatgcacgagaaactaagttgtatggcaaactctgtaataaaaaatctacagtcacgttggagatcaccatcccatgaaaattctatttagtattttcagagaaaattgaaggtttttttaaacatcactggatttcttgattgaggaaacaagttctgaaataatagcacaatttcaaagaagagactctttgcaaagttgataacatttcaaaccctgaaggacagtgacttattatgtaagttcaattttgtaagttcattatgtaagatccttttttttttcataatatgtattcttggctgctatgcgtggtttttcaggaaatttaattatcttactgagatgtgaaagcaaaactagtaacagaacttacattttatttcatgctttcttaaacccgtgcatattctggtgaaacatgtaaaatactttaagtaaaattgaacatttttatttgaatttttgctgaactgataaaggtgtttatatttttgtttgttggtttgtttaattcatgtttgttgggactgaggtttaggaagtttgttactggttaaaaacctcaaatgaaatgcgaaagaatttgaatttttcctgcatatgtcaactttggacagctttcaagaaaaatgagaaaagtttcaacttctggcggttaaaatattaatgcagaatttactaagattttattcatttgcattagcaaatattcatgcagcagcagttgactgaaaatttattcttatgagacgtatagtattcatttttaaatgcatgattgtacattatgtatagacgacaatgtttttaatttataaatttcattctttgttaattgcatgggtttttctgcagcttattgtgaataccttggttctgttcaatagaaacattttgtatatattaaatactgaaatatcagtatcgacggtggaagtgcttcatgggcttgctgcacatatttgtaggatactgtatctgcaaatgcaacaacaaatagttttgtacttggttaacagtcttagttaaaacatgagtttattttctaaaagtatccagaataagtaaaattatagaaataagaaaatgttacacaactttgctgttcatacccttaccttcttactacttttggtttggaggagggtatcaccactagaaagtgtgcctccttaagatttcttaaaggaaagttagtttcagtatttcacagcaagttggactacaaaatctagagttgatctgctttttaaaccttcatttaaaagcaaacttggaagaaatttgaaactgatgtttttaatatatgtctgtgttgcctaggttttctttttttaaagaggtatgtaattaaaacctttgtaaaatttgccaactaatattagtgcctgacttcccatatttgtttcatctttttaactgacagtatatctcacttcttctttgaatagaatgagtgagtgatctcagttttcacattttattcagaagctaatccctacttagcaaggcacacattctacagcaagtcatagaaagtttaatccttgtgcctccttagctctcgtatattcagggatctctataaaagttggtgtcttttttcatcatcataaattcatcataatcacagatatttttgggtctaagatattcatataccaaggatggttttgtaaagaattctgggatcattgaattaaggattgtggcttgaagtaactaaagaaaaatactaatttccttaaaaggaattataattatgatttacattttacatcattaatttcccaaattatatttaaccgtaaggaggtgcacatgagtttttagcaaacaggtatgaataagcagctatgtatatgtgtttggggcagaggggagcagattactttaacacacttcagaattaaaatcagttcgtttcatgactctgtgccttaacgtttgtgtgaactaaacttgctgattgaatgaaattcttgggaagccgaacagtaatagcagaaaatgtgaccaaatgagtatcatgtacttaaatcactgaattttatataagcacaagtattaattttaaaaacattatagtttaataaagctgcatttaaaaatatttgggagcaaagacaagcatgctaaatcttcattttgctatggctataagcatatatttttggcaacttatttgcaatattcttgccttaaagtttcctgcaaatttcccccttagtaattcccgaatagcaaaacattaatattccatgattagctctactgtgttgtctcactattaaaatggaattcgttttttcagatcttttctaatggttaataaaacaaatgtcagatcataataacactcaaa

SEQ ID NO: 3539 - DNA, 544 bp, Homo sapiens
ttggtctaggagggagcgcgccgcacgcgtgagtaaacagccggagctgggaaagtcgagctctggcagcgtctgggtgctgaggggcagaggcggagagaaccctgtcctgatcttcctaggtgggataaatatcggggtgacagtggtaggccgcggggaaccctcagtctgcccaccctccgccccctcgcggcgagatgcctcgttccccgggcttctcccgccctccgccgatctcctccctctgttgaaagctgcccgggaaagtggtggccgacatgacggccaggggtcagagccccctcgcgccgctgttggagactttggaagacccttctgcctcccatggagggcagactgacgcttacctgactctgaccagtcgtatgactggagaagaaggaaaagaagtaattacagaaattgagaaaaaacttcctcggctgtacaaagttttaaagactcacatttccagtcaaaactcggagctgagtagtgctgctctacaagccctggggttttgcttatataatcccaaaat

SEQ ID NO: 3540 - DNA, 7722 bp, Homo sapiens
actcctgggcccgcccagccgccatcttggtctaggagggagcgcgccgcacgcggtggccgacatgacggccaggggtcagagccccctcgcgccgctgttggagactttggaagacccttctgcctcccatggagggcagactgacgcttacctgactctgaccagtcgtatgactggagaagaaggaaaagaagtaattacagaaattgagaaaaaacttcctcggctgtacaaagttttaaagactcacatttccagtcaaaactcggagctgagtagtgctgctctacaagccctggggttttgcttatataatcccaaaattacctcagaattatcagaggcaaatgctctagaattgctttcaaaattgaatgataccattaagaattcagacaaaaatgtacgtactagagcactttgggtgatatctaagcagacatttccctctgaagtggttggcaaaatggtatccagtataattgattcattagaaatactgtttaacaaaggagagacgcattctgctgttgttgattttgaagcattaaatgttatcgtaaggctaattgaacaagccccaattcaaatgggagaagaggcagtgaggtgggcaaaactggtcatacctttagtggttcattcagcacaaaaggtacatttgcggggagcaactgctctggagatgggaatgccattattgcttcagaaacagcaagaaatagcatctattacggagcagcttatgactactaaattaatctcagaacttcagaagctatttatgagtaaaaatgagacttacgtgttaaaattatggcctttgtttgtcaaactacttggaaggaccttgcatcgaagtgggagtttcatcaattctctcttgcaactagaagaacttggatttcgtagtggagcacccatgattaaaaagatagcttttattgcttggaagagtttaatagataattttgctttaaatccagatatactatgtagtgcaaaaagactcaagttgttaatgcagcctttgagttccatccatgtgagaacagaaactctagcattaacaaaactagaagtctggtggtatttactgatgagacttggacctcatcttcctgctaattttgaacaggtttgtgtgcctctgattcaaagtacaataagcattgattctaatgcctcacctcagggcaattcgtgtcatgtagctacatctccaggtttaaatcctatgactcctgtacacaaaggtgcttcctccccgtacggagccccgggaactccccgaatgaacctgagttcgaatttaggtggaatggccacaatcccatccattcaacttttgggacttgaaatgttgcttcatttcttgttgggtccagaagccttgagttttgctaagcaaaataaacttgtgctgagcttagagccattggaacatccgttaatcagcagcccttcctttttttccaaacatgcaaatacacttatcactgctgttcatgatagctttgttgcagttggaaaagatgcccccgatgtggttgtcagtgctatctggaaggagctaattagcttggtgaagtcagttactgaatcaggtaacaaaaaagagaaaccaggttctgaagttttgactctcttattaaagtctttggaaagcatagtaaagtctgaagtatttcctgtatcaaaaacgctggtcctcatggaaattacaattaaaggacttcctcagaaagtattaggttcaccagcatatcaggttgctaatatggatattcttaatggaactccagctttgttcttaattcaattaattttcaacaatttcttggaatgtggtgtatcagatgaaaggttctttctcagtttggaatcacttgtaggctgtgttctttctggtccaacttcaccactagctttcagtgactcagttttaaatgttattaatcaaaatgcaaagcagttggaaaataaggagcatctctggaaaatgtggagtgttatagtcaccccattaactgaattgattaatcagaccaatgaagtaaatcaaggtgatgccttagaacataattttagtgccatctatggtgcattgactttaccagtaaaccacattttttcagaacagagatttccagtggccaccatgaagactttgcttagaacttggtcagaattatatagagcatttgctcgttgtgctgctttggtggcaacagcagaagagaacttgtgctgtgaggaactttcttccaagataatgtccagtttggaagatgaaggcttttctaatttgttgttcgtggatagaattatttatattattactgtaatggttgattgcattgacttctcaccatataatattaaatatcagcccaaagttaaatcaccacagagaccttcagattggtccaaaaagaagaatgagcccctagggaaattgacttctttatttaaacttattgtgaaagtgatctattctttccacacactgagcttcaaggaagcacattctgataccctcttcactattggcaactcaatcaccggcattatttccagtgtacttgggcatatttctttgccttctatgatccgaaaaatatttgcaactttaacaagacctctggcattattttatgaaaactcaaagcttgatgaagttcctaaagtatatagttgtctgaacaacaagttagaaaagctactgggagaaattattgcttgtctgcaattcagctacaccggaacttatgatagtgaacttcttgaacaactctccccactattatgcataatatttctgcacaagaataaacagattcgaaaacagagtgctcagttctggaatgccacttttgccaaagtgatgatgttggtttatcctgaagagttaaaaccagtactaacacaagccaaacaaaaatttctgctcctgttgcctggtttggaaactgttgaaatgatggaggaatccagtggaccatattctgatggaacagaaaattcacaactaaatgtgaagataagtggcatggagagaaaatcaaatggaaaaagagattcatttttggcacaaacaaagaataaaaaagaaaatatgaaaccagcagccaaactgaaacttgaatcttcgtctttaaaagtaaagggtgaaattcttttggaagaggaaaagtctactgactttgtgtttatacctccagaaggaaaagatgcaaaggaaagaatattaactgatcatcaaaaagaagttctcaaaacaaagcggtgtgatattcctgccatgtataataatctggatgtttcccaagataccttatttactcagtatagtcaggaagagcctatggaaattcctactttaaccagaaaaccaaaggaggattctaagatgatgattacggaggagcaaatggacagtgacattgtcattcctcaagatgtcacggaagactgtggtatggctgaacatcttgaaaagtcctccctttcgaataatgagtgtggttctcttgacaaaaccagtccagaaatgtcaaacagtaataatgatgaaagaaaaaaagctttaatttcatcaaggaaaacatcaactgaatgtgcatctagtacagaaaattctttcgttgtcagcagtagttcagtttctaataccactgttgctggaactcccccataccctacaagtcggaggcaaacctttattactttggagaagtttgatggttcagaaaatagaccttttagtccatcccccttgaataatatttcatcaactgttacagtgaaaaataaccaggaaaccatgattaaaacagattttctaccaaaagcaaagcaaagagaagggactttttcaaaatctgattctgaaaaaatagtgaatggaactaagagatcaagccggagagctggtaaagctgaacaaacagggaataaaaggtctaagcccttaatgagatctgagccggagaaaaatactgaggaatctgttgaaggcattgtagtcttagaaaataacccacctggtttgcttaatcaaacagaatgtgtgtcagataatcaggttcatctttctgaatctacaatggagcatgacaatacaaagcttaaagcagcaacagtggaaaatgctgtattattggaaactaatactgtagaggagaaaaatgtagaaattaatttggaatccaaagagaatacacccccagtagtaatatcagcagatcaaatggtaaatgaggatagtcaggttcagataactccaaatcagaaaacccttagacggtcttcaaggcgacgttcagaagtagtagagtctaccactgaaagccaagataaggaaaatagtcatcaaaaaaaggaacgacgtaaggaagaagaaaaacctcttcagaagagtccattgcatataaaagatgatgtgttacctaaacaaaaactgattgctgaacaaactctacaggagaatttaattgagaaaggaagtaatttacatgagaagactcttggggaaactagtgctaatgcagaaactgaacaaaataaaaaaaaggcagaccctgagaacattaagtctgagggggatggtacccaggacattgtagataagtcctctgagaaactagtcagaggccgaacacggtatcaaactagaagagcatctcagggtttgctttccagcattgaaaactcagaatctgatagttcggaggcaaaagaagaaggttctaggaagaagagatctggaaaatggaaaaacaaaagcaatgaaagtgttgacattcaagatcaagaagagaaagtggtgaaacaggaatgtataaaagctgaaaatcagtcacatgattataaagcaacttctgaagaagatgtaagcataaaatctccgatttgcgaaaaacaagatgaaagtaatactgtaatatgtcaggattctacagtaacttcagatttgttgcaagttcctgatgatttaccaaatgtgtgtgaggaaaaaaatgaaactagcaaatatgcagaatattcctttacaagtctacctgtgccagaatcaaatctaaggactagaaatgccattaagagattacataagcgagactcttttgataattgtagtttgggagaatcctcaaaaatagggatatcagatatttcttcgctttcagaaaaaacttttcaaacacttgaatgccaacacaagagaagtaggagggtgaggagatctaaaggttgtgattgctgtggggaaaaatcacaacctcaggaaaagtcactcattgggttaaagaatacagaaaataatgacgtagagattagtgaaacaaaaaaggcagatgtgcaagcacctgtaagcccatcagaaacttctcaagctaatccatattctgaaggacaatttttagatgaacatcatagtgtgaattttcatttgggtctcaaagaggataatgatactattaatgattcattaattgtttctgaaaccaaatcaaaagaaaacactatgcaagaatctcttccttctggaatagtaaactttagagaggaaatttgtgatatggattctagtgaagcaatgtctcttgaaagccaggagtcacctaatgaaaattttaaaactgttggcccgtgtttaggagactcgaaaaatgtttcacaggaatctttggagacaaaagaagaaaaaccagaagaaaccccaaaaatggaactgagtctagagaatgttactgttgaaggaaatgcatgtaaagtaacagaatccaatctagagaaagcaaaaactatggaattgaatgtaggaaatgaagctagctttcatggacaagagagaaccaaaactggtatttctgaagaagcagcaatagaagaaaataaaagaaatgatgactctgaagcagacacagctaaactgaatgccaaagaagtagcaactgaggaatttaattcagatattagtctttctgataatactacacctgtaaaattgaatgctcaaactgagatttctgaacaaacagcagctggggaactagatggaggaaatgatgtatctgatctacactcatctgaagaaacgaataccaaaatgaaaaataatgaagaaatgatgatcggcgaggcaatggctgaaactggccatgatggtgaaacagagaatgagggcataactaccaaaacctcaaagcctgatgaagctgaaacaaacatgttgactgcagaaatggacaactttgtttgtgacacagttgaaatgagcactgaagaaggaatcattgacgctaataaaactgaaacaaatactgagtatagtaaatctgaagaaaaattagataacaatcaaatggtaatggaaagtgatattttacaggaagatcaccatacttcacagaaagtggaggaaccatcacagtgtctggcatctggaacagctatctctgagctaataatagaagacaataatgcatctcctcaaaaactaagggaacttgatccttcacttgtgtcagcaaatgacagtcctagtggcatgcagacacgctgtgtctggtctcctttggcttctccgtctacgagcattttaaagagaggactaaaaagatcccaagaagatgaaatctcatcacctgttaataaggttcgccgtgtctcctttgcagatccaatataccaagcaggattggcagatgacattgatagacggtgctctattgttaggtcccattcttccaatagttctcccataggaaaaagtgttaaaacttctcctactacacaatctaagatttcagaaatggccaaagaatccataccatgcccaacagaaagtgtttacccaccattggtgaactgtgtggcaccagttgacatcattttacctcagattacatcaaacatgtgggcaagaggcctgggacaactcattagagctaagaatataaaaactattggtgatttgagtactcttacagcatctgaaataaaaactcttcctatccgttctccaaaagtgtccaatgtaaaaaaggctctcagaatatatcatgagcagcaggtgaagactcgtggactagaagagattccagtttttgatatttctgaaaaaacagtaaatggaatagaaaataaatctttgtcacctgatgaagaaagacttgtctcagatataattgatcctgttgctttagaaattccattatccaaaaaccttctggcacagattagtgctcttgctcttcagctggattcagaagatcttcataattattcaggaagccaactatttgaaatgcacgagaaactaagttgtatggcaaactctgtaataaaaaatctacagtcacgttggagatcaccatcccatgaaaattctatttagtattttcagagaaaattgaaggtttttttaaacatcactggatttcttgattgaggaaacaagttctgaaataatagcacaatttcaaagaagagactctttgcaaagttgataacatttcaaaccctgaaggacagtgacttattatgtaagttcaattttgtaagttcattatgtaagatccttttttttttcataatatgtattcttggctgctatgcgtggtttttcaggaaatttaattatcttactgagatgtgaaagcaaaactagtaacagaacttacattttatttcatgctttcttaaacccgtgca

SEQ ID NO: 3541 - DNA, 7992 bp, Homo sapiens
ccctccgccccctcgcggcgagatgcctcgttccccgggcttctcccgccctccgccgatctcctccctctgttgaaagctgcccgggaaagtggtggcgggagcgggcccaggcccgaatgtggcgtgggctcaggtgtctggtgtcgggcgccggaggaggttcgcgctggggtttggtgattcggaggcctggggtgcagacgcggcgtggctgtgaggcccgggcgggcgtgcgggtgtgagggccggactcacactgggccgccgcggggctgtttccatcggtcactggattttctcctcttccggttcgggcctcagggtggccgacatgacggccaggggtcagagccccctcgcgccgctgttggagactttggaagacccttctgcctcccatggagggcagactgacgcttacctgactctgaccagtcgtatgactggagaagaaggaaaagaagtaattacagaaattgagaaaaaacttcctcggctgtacaaagttttaaagactcacatttccagtcaaaactcggagctgagtagtgctgctctacaagccctggggttttgcttatataatcccaaaattacctcagaattatcagaggcaaatgctctagaattgctttcaaaattgaatgataccattaagaattcagacaaaaatgtacgtactagagcactttgggtgatatctaagcagacatttccctctgaagtggttggcaaaatggtatccagtataattgattcattagaaatactgtttaacaaaggagagacgcattctgctgttgttgattttgaagcattaaatgttatcgtaaggctaattgaacaagccccaattcaaatgggagaagaggcagtgaggtgggcaaaactggtcatacctttagtggttcattcagcacaaaaggtacatttgcggggagcaactgctctggagatgggaatgccattattgcttcagaaacagcaagaaatagcatctattacggagcagcttatgactactaaattaatctcagaacttcagaagctatttatgagtaaaaatgagacttacgtgttaaaattatggcctttgtttgtcaaactacttggaaggaccttgcatcgaagtgggagtttcatcaattctctcttgcaactagaagaacttggatttcgtagtggagcacccatgattaaaaagatagcttttattgcttggaagagtttaatagataattttgctttaaatccagatatactatgtagtgcaaaaagactcaagttgttaatgcagcctttgagttccatccatgtgagaacagaaactctagcattaacaaaactagaagtctggtggtatttactgatgagacttggacctcatcttcctgctaattttgaacaggtttgtgtgcctctgattcaaagtacaataagcattgattctaatgcctcacctcagggcaattcgtgtcatgtagctacatctccaggtttaaatcctatgactcctgtacacaaaggtgcttcctccccgtacggagccccgggaactccccgaatgaacctgagttcgaatttaggtggaatggccacaatcccatccattcaacttttgggacttgaaatgttgcttcatttcttgttgggtccagaagccttgagttttgctaagcaaaataaacttgtgctgagcttagagccattggaacatccgttaatcagcagcccttcctttttttccaaacatgcaaatacacttatcactgctgttcatgatagctttgttgcagttggaaaagatgcccccgatgtggttgtcagtgctatctggaaggagctaattagcttggtgaagtcagttactgaatcaggtaacaaaaaagagaaaccaggttctgaagttttgactctcttattaaagtctttggaaagcatagtaaagtctgaagtatttcctgtatcaaaaacgctggtcctcatggaaattacaattaaaggacttcctcagaaagtattaggttcaccagcatatcaggttgctaatatggatattcttaatggaactccagctttgttcttaattcaattaattttcaacaatttcttggaatgtggtgtatcagatgaaaggttctttctcagtttggaatcacttgtaggctgtgttctttctggtccaacttcaccactagctttcagtgactcagttttaaatgttattaatcaaaatgcaaagcagttggaaaataaggagcatctctggaaaatgtggagtgttatagtcaccccattaactgaattgattaatcagaccaatgaagtaaatcaaggtgatgccttagaacataattttagtgccatctatggtgcattgactttaccagtaaaccacattttttcagaacagagatttccagtggccaccatgaagactttgcttagaacttggtcagaattatatagagcatttgctcgttgtgctgctttggtggcaacagcagaagagaacttgtgctgtgaggaactttcttccaagataatgtccagtttggaagatgaaggcttttctaatttgttgttcgtggatagaattatttatattattactgtaatggttgattgcattgacttctcaccatataatattaaatatcagcccaaagttaaatcaccacagagaccttcagattggtccaaaaagaagaatgagcccctagggaaattgacttctttatttaaacttattgtgaaagtgatctattctttccacacactgagcttcaaggaagcacattctgataccctcttcactattggcaactcaatcaccggcattatttccagtgtacttgggcatatttctttgccttctatgatccgaaaaatatttgcaactttaacaagacctctggcattattttatgaaaactcaaagcttgatgaagttcctaaagtatatagttgtctgaacaacaagttagaaaagctactgggagaaattattgcttgtctgcaattcagctacaccggaacttatgatagtgaacttcttgaacaactctccccactattatgcataatatttctgcacaagaataaacagattcgaaaacagagtgctcagttctggaatgccacttttgccaaagtgatgatgttggtttatcctgaagagttaaaaccagtactaacacaagccaaacaaaaatttctgctcctgttgcctggtttggaaactgttgaaatgatggaggaatccagtggaccatattctgatggaacagaaaattcacaactaaatgtgaagataagtggcatggagagaaaatcaaatggaaaaagagattcatttttggcacaaacaaagaataaaaaagaaaatatgaaaccagcagccaaactgaaacttgaatcttcgtctttaaaagtaaagggtgaaattcttttggaagaggaaaagtctactgactttgtgtttatacctccagaaggaaaagatgcaaaggaaagaatattaactgatcatcaaaaagaagttctcaaaacaaagcggtgtgatattcctgccatgtataataatctggatgtttcccaagataccttatttactcagtatagtcaggaagagcctatggaaattcctactttaaccagaaaaccaaaggaggattctaagatgatgattacggaggagcaaatggacagtgacattgtcattcctcaagatgtcacggaagactgtggtatggctgaacatcttgaaaagtcctccctttcgaataatgagtgtggttctcttgacaaaaccagtccagaaatgtcaaacagtaataatgatgaaagaaaaaaagctttaatttcatcaaggaaaacatcaactgaatgtgcatctagtacagaaaattctttcgttgtcagcagtagttcagtttctaataccactgttgctggaactcccccataccctacaagtcggaggcaaacctttattactttggagaagtttgatggttcagaaaatagaccttttagtccatcccccttgaataatatttcatcaactgttacagtgaaaaataaccaggaaaccatgattaaaacagattttctaccaaaagcaaagcaaagagaagggactttttcaaaatctgattctgaaaaaatagtgaatggaactaagagatcaagccggagagctggtaaagctgaacaaacagggaataaaaggtctaagcccttaatgagatctgagccggagaaaaatactgaggaatctgttgaaggcattgtagtcttagaaaataacccacctggtttgcttaatcaaacagaatgtgtgtcagataatcaggttcatctttctgaatctacaatggagcatgacaatacaaagcttaaagcagcaacagtggaaaatgctgtattattggaaactaatactgtagaggagaaaaatgtagaaattaatttggaatccaaagagaatacacccccagtagtaatatcagcagatcaaatggtaaatgaggatagtcaggttcagataactccaaatcagaaaacccttagacggtcttcaaggcgacgttcagaagtagtagagtctaccactgaaagccaagataaggaaaatagtcatcaaaaaaaggaacgacgtaaggaagaagaaaaacctcttcagaagagtccattgcatataaaagatgatgtgttacctaaacaaaaactgattgctgaacaaactctacaggagaatttaattgagaaaggaagtaatttacatgagaagactcttggggaaactagtgctaatgcagaaactgaacaaaataaaaaaaaggcagaccctgagaacattaagtctgagggggatggtacccaggacattgtagataagtcctctgagaaactagtcagaggccgaacacggtatcaaactagaagagcatctcagggtttgctttccagcattgaaaactcagaatctgatagttcggaggcaaaagaagaaggttctaggaagaagagatctggaaaatggaaaaacaaaagcaatgaaagtgttgacattcaagatcaagaagagaaagtggtgaaacaggaatgtataaaagctgaaaatcagtcacatgattataaagcaacttctgaagaagatgtaagcataaaatctccgatttgcgaaaaacaagatgaaagtaatactgtaatatgtcaggattctacagtaacttcagatttgttgcaagttcctgatgatttaccaaatgtgtgtgaggaaaaaaatgaaactagcaaatatgcagaatattcctttacaagtctacctgtgccagaatcaaatctaaggactagaaatgccattaagagattacataagcgagactcttttgataattgtagtttgggagaatcctcaaaaatagggatatcagatatttcttcgctttcagaaaaaacttttcaaacacttgaatgccaacacaagagaagtaggagggtgaggagatctaaaggttgtgattgctgtggggaaaaatcacaacctcaggaaaagtcactcattgggttaaagaatacagaaaataatgacgtagagattagtgaaacaaaaaaggcagatgtgcaagcacctgtaagcccatcagaaacttctcaagctaatccatattctgaaggacaatttttagatgaacatcatagtgtgaattttcatttgggtctcaaagaggataatgatactattaatgattcattaattgtttctgaaaccaaatcaaaagaaaacactatgcaagaatctcttccttctggaatagtaaactttagagaggaaatttgtgatatggattctagtgaagcaatgtctcttgaaagccaggagtcacctaatgaaaattttaaaactgttggcccgtgtttaggagactcgaaaaatgtttcacaggaatctttggagacaaaagaagaaaaaccagaagaaaccccaaaaatggaactgagtctagagaatgttactgttgaaggaaatgcatgtaaagtaacagaatccaatctagagaaagcaaaaactatggaattgaatgtaggaaatgaagctagctttcatggacaagagagaaccaaaactggtatttctgaagaagcagcaatagaagaaaataaaagaaatgatgactctgaagcagacacagctaaactgaatgccaaagaagtagcaactgaggaatttaattcagatattagtctttctgataatactacacctgtaaaattgaatgctcaaactgagatttctgaacaaacagcagctggggaactagatggaggaaatgatgtatctgatctacactcatctgaagaaacgaataccaaaatgaaaaataatgaagaaatgatgatcggcgaggcaatggctgaaactggccatgatggtgaaacagagaatgagggcataactaccaaaacctcaaagcctgatgaagctgaaacaaacatgttgactgcagaaatggacaactttgtttgtgacacagttgaaatgagcactgaagaaggaatcattgacgctaataaaactgaaacaaatactgagtatagtaaatctgaagaaaaattagataacaatcaaatggtaatggaaagtgatattttacaggaagatcaccatacttcacagaaagtggaggaaccatcacagtgtctggcatctggaacagctatctctgagctaataatagaagacaataatgcatctcctcaaaaactaagggaacttgatccttcacttgtgtcagcaaatgacagtcctagtggcatgcagacacgctgtgtctggtctcctttggcttctccgtctacgagcattttaaagagaggactaaaaagatcccaagaagatgaaatctcatcacctgttaataaggttcgccgtgtctcctttgcagatccaatataccaagcaggattggcagatgacattgatagacggtgctctattgttaggtcccattcttccaatagttctcccataggaaaaagtgttaaaacttctcctactacacaatctaagatttcagaaatggccaaagaatccataccatgcccaacagaaagtgtttacccaccattggtgaactgtgtggcaccagttgacatcattttacctcagattacatcaaacatgtgggcaagaggcctgggacaactcattagagctaagaatataaaaactattggtgatttgagtactcttacagcatctgaaataaaaactcttcctatccgttctccaaaagtgtccaatgtaaaaaaggctctcagaatatatcatgagcagcaggtgaagactcgtggactagaagagattccagtttttgatatttctgaaaaaacagtaaatggaatagaaaataaatctttgtcacctgatgaagaaagacttgtctcagatataattgatcctgttgctttagaaattccattatccaaaaaccttctggcacagattagtgctcttgctcttcagctggattcagaagatcttcataattattcaggaagccaactatttgaaatgcacgagaaactaagttgtatggcaaactctgtaataaaaaatctacagtcacgttggagatcaccatcccatgaaaattctatttagtattttcagagaaaattgaaggtttttttaaacatcactggatttcttgattgaggaaacaagttctgaaataatagcacaatttcaaagaagagactctttgcaaagttgataacatttcaaaccctgaaggacagtgacttattatgtaagttcaattttgtaagttcattatgtaagatccttttttttttcataatatgtattcttggctgctatgcgtggtttttcaggaaatttaattatcttactgagatgtgaaagcaaaactagtaacagaacttacattttatttcatgctttcttaaacccgtgca

SEQ ID NO: 3542 - DNA, 1605 bp, Homo sapiens
ccagccgccatcttggtctaggagggagcgcgccgcacgcggtggccgacatgacggccaggggtcagagccccctcgcgccgctgttggagactttggaagacccttctgcctcccatggagggcagactgacgcttacctgactctgaccagtcgtatgactggagaagaaggaaaagaagtaattacagaaattgagaaaaaacttcctcggctgtacaaagttttaaagactcacatttccagtcaaaactcggagctgagtagtgctgctctacaagccctggggttttgcttatataatcccaaaattacctcagaattatcagaggcaaatgctctagaattgctttcaaaattgaatgataccattaagaattcagacaaaaatgtacgtactagagcactttgggtgatatctaagcagacatttccctctgaagtggttggcaaaatggtatccagtataattgattcattagaaatactgtttaacaaaggagagacgcattctgctgttgttgattttgaagcattaaatgttatcgtaaggctaattgaacaagccccaattcaaatgggagaagaggcagtgaggtgggcaaaactggtcatacctttagtggttcattcagcacaaaaggtacatttgcggggagcaactgctctggagatgggaatgccattattgcttcagaaacagcaagaaatagcatctattacggagcagcttatgactactaccttgcatcgaagtgggagtttcatcaattctctcttgcaactagaagaacttggatttcgtagtggagcacccatgattaaaaagatagcttttattgcttggaagagtttaatagataattttgctttaaatccagatatactatgtagtgcaaaaagactcaagttgttaatgcagcctttgagttccatccatgtgagaacagaaactctagcattaacaaaactagaagtctggtggtatttactgatgagacttggacctcatcttcctgctaattttgaacaggtgcttcctccccgtacggagccccgggaactccccgaatgaacctgagttcgaatttaggtggaatggccacaatcccatccattcaacttttgggacttgaaatgttgcttcatttcttgttgggtccagaagccttgagttttgctaagcaaaataaacttgtgctgagcttagagccattggaacatccgttaatcagcagcccttcctttttttccaaacatgcaaatacacttatcactgctgttcatgatagctttgttgcagttggaaaagatgcccccgatgtggttgtcagtgctatctggaaggagctaattagcttggtgaagtcagttactgaatcaggtaacaaaaaagagaaaccaggttctgaagttttgactctcttattaaagtctttggaaagcatagtaaagtctgaagtatttcctgtatcaaaaacgctggtcctcatggaaattacaattaaaggacttcctcagaaagtattaggttcaccagcatatcaggttgctaatatggatattcttaatggaactccagctttgttcttaattcaattaat

SEQ ID NO: 3543 - DNA, 7897 bp, Homo sapiens
cgcactcctgggcccgcccagccgccatcttggtctaggagggagcgcgccgcacgcgtgagtaaacagccggagctgggaaagtcgagctctggcagcgtctgggtgctgaggggcagaggcggagagaaccctgtcctgatcttcctagggtggccgacatgacggccaggggtcagagccccctcgcgccgctgttggagactttggaagacccttctgcctcccatggagggcagactgacgcttacctgactctgaccagtcgtatgactggagaagaaggaaaagaagtaattacagaaattgagaaaaaacttcctcggctgtacaaagttttaaagactcacatttccagtcaaaactcggagctgagtagtgctgctctacaagccctggggttttgcttatataatcccaaaattacctcagaattatcagaggcaaatgctctagaattgctttcaaaattgaatgataccattaagaattcagacaaaaatgtacgtactagagcactttgggtgatatctaagcagacatttccctctgaagtggttggcaaaatggtatccagtataattgattcattagaaatactgtttaacaaaggagagacgcattctgctgttgttgattttgaagcattaaatgttatcgtaaggctaattgaacaagccccaattcaaatgggagaagaggcagtgaggtgggcaaaactggtcatacctttagtggttcattcagcacaaaaggtacatttgcggggagcaactgctctggagatgggaatgccattattgcttcagaaacagcaagaaatagcatctattacggagcagcttatgactactaaattaatctcagaacttcagaagctatttatgagtaaaaatgagacttacgtgttaaaattatggcctttgtttgtcaaactacttggaaggaccttgcatcgaagtgggagtttcatcaattctctcttgcaactagaagaacttggatttcgtagtggagcacccatgattaaaaagatagcttttattgcttggaagagtttaatagataattttgctttaaatccagatatactatgtagtgcaaaaagactcaagttgttaatgcagcctttgagttccatccatgtgagaacagaaactctagcattaacaaaactagaagtctggtggtatttactgatgagacttggacctcatcttcctgctaattttgaacaggtttgtgtgcctctgattcaaagtacaataagcattgattctaatgcctcacctcagggcaattcgtgtcatgtagctacatctccaggtttaaatcctatgactcctgtacacaaaggtgcttcctccccgtacggagccccgggaactccccgaatgaacctgagttcgaatttaggtggaatggccacaatcccatccattcaacttttgggacttgaaatgttgcttcatttcttgttgggtccagaagccttgagttttgctaagcaaaataaacttgtgctgagcttagagccattggaacatccgttaatcagcagcccttcctttttttccaaacatgcaaatacacttatcactgctgttcatgatagctttgttgcagttggaaaagatgcccccgatgtggttgtcagtgctatctggaaggagctaattagcttggtgaagtcagttactgaatcaggtaacaaaaaagagaaaccaggttctgaagttttgactctcttattaaagtctttggaaagcatagtaaagtctgaagtatttcctgtatcaaaaacgctggtcctcatggaaattacaattaaaggacttcctcagaaagtattaggttcaccagcatatcaggttgctaatatggatattcttaatggaactccagctttgttcttaattcaattaattttcaacaatttcttggaatgtggtgtatcagatgaaaggttctttctcagtttggaatcacttgtaggctgtgttctttctggtccaacttcaccactagctttcagtgactcagttttaaatgttattaatcaaaatgcaaagcagttggaaaataaggagcatctctggaaaatgtggagtgttatagtcaccccattaactgaattgattaatcagaccaatgaagtaaatcaaggtgatgccttagaacataattttagtgccatctatggtgcattgactttaccagtaaaccacattttttcagaacagagatttccagtggccaccatgaagactttgcttagaacttggtcagaattatatagagcatttgctcgttgtgctgctttggtggcaacagcagaagagaacttgtgctgtgaggaactttcttccaagataatgtccagtttggaagatgaaggcttttctaatttgttgttcgtggatagaattatttatattattactgtaatggttgattgcattgacttctcaccatataatattaaatatcagcccaaagttaaatcaccacagagaccttcagattggtccaaaaagaagaatgagcccctagggaaattgacttctttatttaaacttattgtgaaagtgatctattctttccacacactgagcttcaaggaagcacattctgataccctcttcactattggcaactcaatcaccggcattatttccagtgtacttgggcatatttctttgccttctatgatccgaaaaatatttgcaactttaacaagacctctggcattattttatgaaaactcaaagcttgatgaagttcctaaagtatatagttgtctgaacaacaagttagaaaagctactgggagaaattattgcttgtctgcaattcagctacaccggaacttatgatagtgaacttcttgaacaactctccccactattatgcataatatttctgcacaagaataaacagattcgaaaacagagtgctcagttctggaatgccacttttgccaaagtgatgatgttggtttatcctgaagagttaaaaccagtactaacacaagccaaacaaaaatttctgctcctgttgcctggtttggaaactgttgaaatgatggaggaatccagtggaccatattctgatggaacagaaaattcacaactaaatgtgaagataagtggcatggagagaaaatcaaatggaaaaagagattcatttttggcacaaacaaagaataaaaaagaaaatatgaaaccagcagccaaactgaaacttgaatcttcgtctttaaaagtaaagggtgaaattcttttggaagaggaaaagtctactgactttgtgtttatacctccagaaggaaaagatgcaaaggaaagaatattaactgatcatcaaaaagaagttctcaaaacaaagcggtgtgatattcctgccatgtataataatctggatgtttcccaagataccttatttactcagtatagtcaggaagagcctatggaaattcctactttaaccagaaaaccaaaggaggattctaagatgatgattacggaggagcaaatggacagtgacattgtcattcctcaagatgtcacggaagactgtggtatggctgaacatcttgaaaagtcctccctttcgaataatgagtgtggttctcttgacaaaaccagtccagaaatgtcaaacagtaataatgatgaaagaaaaaaagctttaatttcatcaaggaaaacatcaactgaatgtgcatctagtacagaaaattctttcgttgtcagcagtagttcagtttctaataccactgttgctggaactcccccataccctacaagtcggaggcaaacctttattactttggagaagtttgatggttcagaaaatagaccttttagtccatcccccttgaataatatttcatcaactgttacagtgaaaaataaccaggaaaccatgattaaaacagattttctaccaaaagcaaagcaaagagaagggactttttcaaaatctgattctgaaaaaatagtgaatggaactaagagatcaagccggagagctggtaaagctgaacaaacagggaataaaaggtctaagcccttaatgagatctgagccggagaaaaatactgaggaatctgttgaaggcattgtagtcttagaaaataacccacctggtttgcttaatcaaacagaatgtgtgtcagataatcaggttcatctttctgaatctacaatggagcatgacaatacaaagcttaaagcagcaacagtggaaaatgctgtattattggaaactaatactgtagaggagaaaaatgtagaaattaatttggaatccaaagagaatacacccccagtagtaatatcagcagatcaaatggtaaatgaggatagtcaggttcagataactccaaatcagaaaacccttagacggtcttcaaggcgacgttcagaagtagtagagtctaccactgaaagccaagataaggaaaatagtcatcaaaaaaaggaacgacgtaaggaagaagaaaaacctcttcagaagagtccattgcatataaaagatgatgtgttacctaaacaaaaactgattgctgaacaaactctacaggagaatttaattgagaaaggaagtaatttacatgagaagactcttggggaaactagtgctaatgcagaaactgaacaaaataaaaaaaaggcagaccctgagaacattaagtctgagggggatggtacccaggacattgtagataagtcctctgagaaactagtcagaggccgaacacggtatcaaactagaagagcatctcagggtttgctttccagcattgaaaactcagaatctgatagttcggaggcaaaagaagaaggttctaggaagaagagatctggaaaatggaaaaacaaaagcaatgaaagtgttgacattcaagatcaagaagagaaagtggtgaaacaggaatgtataaaagctgaaaatcagtcacatgattataaagcaacttctgaagaagatgtaagcataaaatctccgatttgcgaaaaacaagatgaaagtaatactgtaatatgtcaggattctacagtaacttcagatttgttgcaagttcctgatgatttaccaaatgtgtgtgaggaaaaaaatgaaactagcaaatatgcagaatattcctttacaagtctacctgtgccagaatcaaatctaaggactagaaatgccattaagagattacataagcgagactcttttgataattgtagtttgggagaatcctcaaaaatagggatatcagatatttcttcgctttcagaaaaaacttttcaaacacttgaatgccaacacaagagaagtaggagggtgaggagatctaaaggttgtgattgctgtggggaaaaatcacaacctcaggaaaagtcactcattgggttaaagaatacagaaaataatgacgtagagattagtgaaacaaaaaaggcagatgtgcaagcacctgtaagcccatcagaaacttctcaagctaatccatattctgaaggacaatttttagatgaacatcatagtgtgaattttcatttgggtctcaaagaggataatgatactattaatgattcattaattgtttctgaaaccaaatcaaaagaaaacactatgcaagaatctcttccttctggaatagtaaactttagagaggaaatttgtgatatggattctagtgaagcaatgtctcttgaaagccaggagtcacctaatgaaaattttaaaactgttggcccgtgtttaggagactcgaaaaatgtttcacaggaatctttggagacaaaagaagaaaaaccagaagaaaccccaaaaatggaactgagtctagagaatgttactgttgaaggaaatgcatgtaaagtaacagaatccaatctagagaaagcaaaaactatggaattgaatgtaggaaatgaagctagctttcatggacaagagagaaccaaaactggtatttctgaagaagcagcaatagaagaaaataaaagaaatgatgactctgaagcagacacagctaaactgaatgccaaagaagtagcaactgaggaatttaattcagatattagtctttctgataatactacacctgtaaaattgaatgctcaaactgagatttctgaacaaacagcagctggggaactagatggaggaaatgatgtatctgatctacactcatctgaagaaacgaataccaaaatgaaaaataatgaagaaatgatgatcggcgaggcaatggctgaaactggccatgatggtgaaacagagaatgagggcataactaccaaaacctcaaagcctgatgaagctgaaacaaacatgttgactgcagaaatggacaactttgtttgtgacacagttgaaatgagcactgaagaaggaatcattgacgctaataaaactgaaacaaatactgagtatagtaaatctgaagaaaaattagataacaatcaaatggtaatggaaagtgatattttacaggaagatcaccatacttcacagaaagtggaggaaccatcacagtgtctggcatctggaacagctatctctgagctaataatagaagacaataatgcatctcctcaaaaactaagggaacttgatccttcacttgtgtcagcaaatgacagtcctagtggcatgcagacacgctgtgtctggtctcctttggcttctccgtctacgagcattttaaagagaggactaaaaagatcccaagaagatgaaatctcatcacctgttaataaggttcgccgtgtctcctttgcagatccaatataccaagcaggattggcagatgacattgatagacggtgctctattgttaggtcccattcttccaatagttctcccataggaaaaagtgttaaaacttctcctactacacaatctaagcataataccacttcagccaaaggatttctgtccccaggatcacgtagccctaaatttaagagctcaaagaagtgtttaatttcagaaatggccaaagaatccataccatgcccaacagaaagtgtttacccaccattggtgaactgtgtggcaccagttgacatcattttacctcagattacatcaaacatgtgggcaagaggcctgggacaactcattagagctaagaatataaaaactattggtgatttgagtactcttacagcatctgaaataaaaactcttcctatccgttctccaaaagtgtccaatgtaaaaaaggctctcagaatatatcatgagcagcaggtgaagactcgtggactagaagagattccagtttttgatatttctgaaaaaacagtaaatggaatagaaaataaatctttgtcacctgatgaagaaagacttgtctcagatataattgatcctgttgctttagaaattccattatccaaaaaccttctggcacagattagtgctcttgctcttcagctggattcagaagatcttcataattattcaggaagccaactatttgaaatgcacgagaaactaagttgtatggcaaactctgtaataaaaaatctacagtcacgttggagatcaccatcccatgaaaattctatttagtattttcagagaaaattgaaggtttttttaaacatcactggatttcttgattgaggaaacaagttctgaaataatagcacaatttcaaagaagagactctttgcaaagttgataacatttcaaaccctgaaggacagtgacttattatgtaagttcaattttgtaagttcattatgtaagatccttttttttttcataatatgtattcttggctgctatgcgtggtttttcaggaaatttaattatcttactgagatgtgaaagcaaaactagtaacagaacttacattttatttcatgctttcttaaacccgtgca

SEQ ID NO: 3544 - DNA, 8053 bp, Homo sapiens
cgcactcctgggcccgcccagccgccatcttggtctaggagggagcgcgccgcacgcgtgagtaaacagccggagctgggaaagtcgagctctggcagcgtctgggtgctgaggggcagaggcggagagaaccctgtcctgatcttcctagggtggccgacatgacggccaggggtcagagccccctcgcgccgctgttggagactttggaagacccttctgcctcccatggagggcagactgacgcttacctgactctgaccagtcgtatgactggagaagaaggaaaagaagtaattacagaaattgagaaaaaacttcctcggctgtacaaagttttaaagactcacatttccagtcaaaactcggagctgagtagtgctgctctacaagccctggggttttgcttatataatcccaaaattacctcagaattatcagaggcaaatgctctagaattgctttcaaaattgaatgataccattaagaattcagacaaaaatgtacgtactagagcactttgggtgatatctaagcagacatttccctctgaagtggttggcaaaatggtatccagtataattgattcattagaaatactgtttaacaaaggagagacgcattctgctgttgttgattttgaagcattaaatgttatcgtaaggctaattgaacaagccccaattcaaatgggagaagaggcagtgaggtgggcaaaactggtcatacctttagtggttcattcagcacaaaaggtacatttgcggggagcaactgctctggagatgggaatgccattattgcttcagaaacagcaagaaatagcatctattacggagcagcttatgactactaaattaatctcagaacttcagaagctatttatgagtaaaaatgagacttacgtgttaaaattatggcctttgtttgtcaaactacttggaaggaccttgcatcgaagtgggagtttcatcaattctctcttgcaactagaagaacttggatttcgtagtggagcacccatgattaaaaagatagcttttattgcttggaagagtttaatagataattttgctttaaatccagatatactatgtagtgcaaaaagactcaagttgttaatgcagcctttgagttccatccatgtgagaacagaaactctagcattaacaaaactagaagtctggtggtatttactgatgagacttggacctcatcttcctgctaattttgaacaggtttgtgtgcctctgattcaaagtacaataagcattgattctaatgcctcacctcagggcaattcgtgtcatgtagctacatctccaggtttaaatcctatgactcctgtacacaaaggtgcttcctccccgtacggagccccgggaactccccgaatgaacctgagttcgaatttaggtggaatggccacaatcccatccattcaacttttgggacttgaaatgttgcttcatttcttgttgggtccagaagccttgagttttgctaagcaaaataaacttgtgctgagcttagagccattggaacatccgttaatcagcagcccttcctttttttccaaacatgcaaatacacttatcactgctgttcatgatagctttgttgcagttggaaaagatgcccccgatgtggttgtcagtgctatctggaaggagctaattagcttggtgaagtcagttactgaatcaggtaacaaaaaagagaaaccaggttctgaagttttgactctcttattaaagtctttggaaagcatagtaaagtctgaagtatttcctgtatcaaaaacgctggtcctcatggaaattacaattaaaggacttcctcagaaagtattaggttcaccagcatatcaggttgctaatatggatattcttaatggaactccagctttgttcttaattcaattaattttcaacaatttcttggaatgtggtgtatcagatgaaaggttctttctcagtttggaatcacttgtaggctgtgttctttctggtccaacttcaccactagctttcagtgactcagttttaaatgttattaatcaaaatgcaaagcagttggaaaataaggagcatctctggaaaatgtggagtgttatagtcaccccattaactgaattgattaatcagaccaatgaagtaaatcaaggtgatgccttagaacataattttagtgccatctatggtgcattgactttaccagtaaaccacattttttcagaacagagatttccagtggccaccatgaagactttgcttagaacttggtcagaattatatagagcatttgctcgttgtgctgctttggtggcaacagcagaagagaacttgtgctgtgaggaactttcttccaagataatgtccagtttggaagatgaaggcttttctaatttgttgttcgtggatagaattatttatattattactgtaatggttgattgcattgacttctcaccatataatattaaatatcagcccaaagttaaatcaccacagagaccttcagattggtccaaaaagaagaatgagcccctagggaaattgacttctttatttaaacttattgtgaaagtgatctattctttccacacactgagcttcaaggaagcacattctgataccctcttcactattggcaactcaatcaccggcattatttccagtgtacttgggcatatttctttgccttctatgatccgaaaaatatttgcaactttaacaagacctctggcattattttatgaaaactcaaagcttgatgaagttcctaaagtatatagttgtctgaacaacaagttagaaaagctactgggagaaattattgcttgtctgcaattcagctacaccggaacttatgatagtgaacttcttgaacaactctccccactattatgcataatatttctgcacaagaataaacagattcgaaaacagagtgctcagttctggaatgccacttttgccaaagtgatgatgttggtttatcctgaagagttaaaaccagtactaacacaagccaaacaaaaatttctgctcctgttgcctggtttggaaactgttgaaatgatggaggaatccagtggaccatattctgatggaacagaaaattcacaactaaatgtgaagataagtggcatggagagaaaatcaaatggaaaaagagattcatttttggcacaaacaaagaataaaaaagaaaatatgaaaccagcagccaaactgaaacttgaatcttcgtctttaaaagtaaagggtgaaattcttttggaagaggaaaagtctactgactttgtgtttatacctccagaaggaaaagatgcaaaggaaagaatattaactgatcatcaaaaagaagttctcaaaacaaagcggtgtgatattcctgccatgtataataatctggatgtttcccaagataccttatttactcagtatagtcaggaagagcctatggaaattcctactttaaccagaaaaccaaaggaggattctaagatgatgattacggaggagcaaatggacagtgacattgtcattcctcaagatgtcacggaagactgtggtatggctgaacatcttgaaaagtcctccctttcgaataatgagtgtggttctcttgacaaaaccagtccagaaatgtcaaacagtaataatgatgaaagaaaaaaagctttaatttcatcaaggaaaacatcaactgaatgtgcatctagtacagaaaattctttcgttgtcagcagtagttcagtttctaataccactgttgctggaactcccccataccctacaagtcggaggcaaacctttattactttggagaagtttgatggttcagaaaatagaccttttagtccatcccccttgaataatatttcatcaactgttacagtgaaaaataaccaggaaaccatgattaaaacagattttctaccaaaagcaaagcaaagagaagggactttttcaaaatctgattctgaaaaaatagtgaatggaactaagagatcaagccggagagctggtaaagctgaacaaacagggaataaaaggtctaagcccttaatgagatctgagccggagaaaaatactgaggaatctgttgaaggcattgtagtcttagaaaataacccacctggtttgcttaatcaaacagaatgtgtgtcagataatcaggttcatctttctgaatctacaatggagcatgacaatacaaagcttaaagcagcaacagtggaaaatgctgtattattggaaactaatactgtagaggagaaaaatgtagaaattaatttggaatccaaagagaatacacccccagtagtaatatcagcagatcaaatggtaaatgaggatagtcaggttcagataactccaaatcagaaaacccttagacggtcttcaaggcgacgttcagaagtagtagagtctaccactgaaagccaagataaggaaaatagtcatcaaaaaaaggaacgacgtaaggaagaagaaaaacctcttcagaagagtccattgcatataaaagatgatgtgttacctaaacaaaaactgattgctgaacaaactctacaggagaatttaattgagaaaggaagtaatttacatgagaagactcttggggaaactagtgctaatgcagaaactgaacaaaataaaaaaaaggcagaccctgagaacattaagtctgagggggatggtacccaggacattgtagataagtcctctgagaaactagtcagaggccgaacacggtatcaaactagaagagcatctcagggtttgctttccagcattgaaaactcagaatctgatagttcggaggcaaaagaagaaggttctaggaagaagagatctggaaaatggaaaaacaaaagcaatgaaagtgttgacattcaagatcaagaagagaaagtggtgaaacaggaatgtataaaagctgaaaatcagtcacatgattataaagcaacttctgaagaagatgtaagcataaaatctccgatttgcgaaaaacaagatgaaagtaatactgtaatatgtcaggattctacagtaacttcagatttgttgcaagttcctgatgatttaccaaatgtgtgtgaggaaaaaaatgaaactagcaaatatgcagaatattcctttacaagtctacctgtgccagaatcaaatctaaggactagaaatgccattaagagattacataagcgagactcttttgataattgtagtttgggagaatcctcaaaaatagggatatcagatatttcttcgctttcagaaaaaacttttcaaacacttgaatgccaacacaagagaagtaggagggtgaggagatctaaaggttgtgattgctgtggggaaaaatcacaacctcaggaaaagtcactcattgggttaaagaatacagaaaataatgacgtagagattagtgaaacaaaaaaggcagatgtgcaagcacctgtaagcccatcagaaacttctcaagctaatccatattctgaaggacaatttttagatgaacatcatagtgtgaattttcatttgggtctcaaagaggataatgatactattaatgattcattaattgtttctgaaaccaaatcaaaagaaaacactatgcaagaatctcttccttctggaatagtaaactttagagaggaaatttgtgatatggattctagtgaagcaatgtctcttgaaagccaggagtcacctaatgaaaattttaaaactgttggcccgtgtttaggagactcgaaaaatgtttcacaggaatctttggagacaaaagaagaaaaaccagaagaaaccccaaaaatggaactgagtctagagaatgttactgttgaaggaaatgcatgtaaagtaacagaatccaatctagagaaagcaaaaactatggaattgaatgtaggaaatgaagctagctttcatggacaagagagaaccaaaactggtatttctgaagaagcagcaatagaagaaaataaaagaaatgatgactctgaagcagacacagctaaactgaatgccaaagaagtagcaactgaggaatttaattcagatattagtctttctgataatactacacctgtaaaattgaatgctcaaactgagatttctgaacaaacagcagctggggaactagatggaggaaatgatgtatctgatctacactcatctgaagaaacgaataccaaaatgaaaaataatgaagaaatgatgatcggcgaggcaatggctgaaactggccatgatggtgaaacagagaatgagggcataactaccaaaacctcaaagcctgatgaagctgaaacaaacatgttgactgcagaaatggacaactttgtttgtgacacagttgaaatgagcactgaagaaggaatcattgacgctaataaaactgaaacaaatactgagtatagtaaatctgaagaaaaattagataacaatcaaatggtaatggaaagtgatattttacaggaagatcaccatacttcacagaaagtggaggaaccatcacagtgtctggcatctggaacagctatctctgagctaataatagaagacaataatgcatctcctcaaaaactaagggaacttgatccttcacttgtgtcagcaaatgacagtcctagtggcatgcagacacgctgtgtctggtctcctttggcttctccgtctacgagcattttaaagagaggactaaaaagatcccaagaagatgaaatctcatcacctgttaataaggttcgccgtgtctcctttgcagatccaatataccaagcaggattggcagatgacattgatagacggtgctctattgttaggtcccattcttccaatagttctcccataggaaaaagtgttaaaacttctcctactacacaatctaagatttcagaaatggccaaagaatccataccatgcccaacagaaagtgtttacccaccattggtgaactgtgtggcaccagttgacatcattttacctcagattacatcaaacatgtgggcaagaggcctgggacaactcattagagctaagaatataaaaactattggtgatttgagtactcttacagcatctgaaataaaaactcttcctatccgttctccaaaagtgtccaatgtaaaaaaggctctcagaatatatcatgagcagcaggtgaagactcgtggactagaagagattccagtttttgatatttctgaaaaaacagtaaatggaatagaaaataaatctttgtcacctgatgaagaaagacttgtctcagatataattgatcctgttgctttagaaattccattatccaaaaaccttctggcacagattagtgctcttgctcttcagctggattcagaagatcttcataattattcaggaagccaactatttgaaatgcacgagaaactaagttgtatggcaaactctgtaataaaaaatctacagtcacgttggagatcaccatcccatgaaaattctatttagtattttcagagaaaattgaaggtttttttaaacatcactggatttcttgattgaggaaacaagttctgaaataatagcacaatttcaaagaagagactctttgcaaagttgataacatttcaaaccctgaaggacagtgacttattatgtaagttcaattttgtaagttcattatgtaagatccttttttttttcataatatgtattcttggctgctatgcgtggtttttcaggaaatttaattatcttactgagatgtgaaagcaaaactagtaacagaacttacattttatttcatgctttcttaaacccgtgcatattctggtgaaacatgtaaaatactttaagtaaaattgaacatttttatttgaatttttgctgaactgataaaggtgtttatatttttgtttgttggtttgtttaattcatgtttgttgggactgaggtttaggaagtttgttactggttaaaaacctcaaatgaaatgcgaaagaatttgaatttttcctgcatatgtcaactttggacagctttcaagaaaaatgagaaaa

SEQ ID NO: 3545 - DNA, 1586 bp, Homo sapiens
atccttcgcgtactgacggaaacactggcggcacatattgaggccgtatttcaggatcagacctgccggttcgaacacacgcgacaagagcaaagaagttaaaagagaagtgtctgtgtggctccttccacgtgggtgaaggactgtgccagctgagaggtggtagagcaggaagctgcctgaggacctccatttatttggtgaaaaactgggctccgcccttaagagagcaagtcgagggccgtgtaggagttggaggagagaaatgaaattttggaagagtcagcagaagatcgtcagtatttaaacagatcacatcatgcgtgagtacaagctagtggtccttggttcaggaggcgttgggaagtctgctctgacagttcagtttgttcagggaatttttgttgaaaaatatgacccaacgatagaagattcctacagaaagcaagttgaagtcgattgccaacagtgtatgctcgaaatcctggatactgcagggacagagcaatttacagcaatgagggatttgtatatgaagaacggccaaggttttgcactagtatattctattacagctcagtccacgtttaacgacttacaggacctgagggaacagattttacgggttaaggacacggaagatgttccaatgattttggttggcaataaatgtgacctggaagatgagcgagtagttggcaaagagcagggccagaatttagcaagacagtggtgtaactgtgcctttttagaatcttctgcaaagtcaaagatcaatgttaatgagatattttatgacctggtcagacagataaataggaaaacaccagtggaaaagaagaagcctaaaaagaaatcatgtctgctgctctaggcccatagtcagcagcagctctgagccagattacaggaatgaagaactgttgcctaattggaaagtgccagcattccagacttcaaaaataaaaaatctgaagaggcttctcctgttttatatattatgtgaagaatttagatcttatattggtttgcacaagttccctggagaaaaaaattgctctgtgtatatctcttggaaaataagacaatagtatttctcctttgcaatagcagttataacagatgtgaaaatatacttgactctaatatgattatacaaaagagcatggatgcatttcaaatgttagatattgctactataatcaaatgatttcatattgatctttttatcatgatcctccctatcaagcactaaaaagttgaaccattatactttatatctgtaatgatactgattatgaaatgtcccctcaaactcattgcagcagataacttttttgagtcattgacttcattttatatttaaaaaattatggaatatcatctgtcattatattctaattaaaattgtgcataatgctttggaaaaatgggtcttttataggaaaaaaactgggataactgatttctatggctttcaaagctaaaatatataatatactaaaccaactctaatattgcttcttgtgttttactgtcagattaaattacagcttttatggatgattaaattttagtacattttc

SEQ ID NO: 3546 - DNA, 5024 bp, Homo sapiens
ggcgccgccgccgctcccgaggcccctgccgccgccgctcccgctgctgtcgccgcgcagagccggagcaggagccacggccgagaggagggaggaggaggaggaggaggtggaggaggtggaggaggtggaggaggcgccggaccggggggatcgtcagtatttaaacagatcacatcatgcgtgagtacaagctagtggtccttggttcaggaggcgttgggaagtctgctctgacagttcagtttgttcagggaatttttgttgaaaaatatgacccaacgatagaagattcctacagaaagcaagttgaagtcgattgccaacagtgtatgctcgaaatcctggatactgcagggacagagcaatttacagcaatgagggatttgtatatgaagaacggccaaggttttgcactagtatattctattacagctcagtccacgtttaacgacttacaggacctgagggaacagattttacgggttaaggacacggaagatgttccaatgattttggttggcaataaatgtgacctggaagatgagcgagtagttggcaaagagcagggccagaatttagcaagacagtggtgtaactgtgcctttttagaatcttctgcaaagtcaaagatcaatgttaatgagatattttatgacctggtcagacagataaataggaaaacaccagtggaaaagaagaagcctaaaaagaaatcatgtctgctgctctaggcccatagtcagcagcagctctgagccagattacaggaatgaagaactgttgcctaattggaaagtgccagcattccagacttcaaaaataaaaaatctgaagaggcttctcctgttttatatattatgtgaagaatttagatcttatattggtttgcacaagttccctggagaaaaaaattgctctgtgtatatctcttggaaaataagacaatagtatttctcctttgcaatagcagttataacagatgtgaaaatatacttgactctaatatgattatacaaaagagcatggatgcatttcaaatgttagatattgctactataatcaaatgatttcatattgatctttttatcatgatcctccctatcaagcactaaaaagttgaaccattatactttatatctgtaatgatactgattatgaaatgtcccctcaaactcattgcagcagataacttttttgagtcattgacttcattttatatttaaaaaattatggaatatcatctgtcattatattctaattaaaattgtgcataatgctttggaaaaatgggtcttttataggaaaaaaactgggataactgatttctatggctttcaaagctaaaatatataatatactaaaccaactctaatattgcttcttgtgttttactgtcagattaaattacagcttttatggatgattaaattttagtacattttcatttggtttgtgtgtttttgttattgtttatagattaaagcgtttattttataatgaccacattgttttaaatgcgacagtagctcctttctgcctagtatctgcagaacactggctttaaactatactaagtaactggtgatttctctaggaacagacctcgcactttctgttctaaatatatttattcctactatacagtaaaatacatcagacaacatagaatagttttgtatattctctcttgatcttaaagattgtatcttattgaatatcccactgtatattatttttatatgtaaaaagataagtttaatactgtatcagggtttaacttttactatttcagatcttccacagcttgtaatttcatcaagggaatccttttgcattgttaatttgttgggtgtgagtccaccaatgaagtgttatgtgaaaaatttcaaacttgctttataatagattgaagaatttgagagaagtgagagaaagttaaaacacataaaaggaatgtgttacttttgcttaaactacttatgaaatagtatggtagtagtaatatggaagagattgctaagttaaaattgtagcttcctatatagtggtgctttttcttttccttcccagttattttcctctttacaaaagatagggcttaagtaagacatggacccagggtgatactacttatgtagtctctataaagagaggtagaacaaaaagcttgttagccaattaagttctggaaaaggaaagaaacaagcttagaaaaccctgtgccttgtcctcaaatattaaggaggagacagaccagtcctagaaagtctaagtcattgctcagggatctctagatactgtctctttgcaactaggtatgaagaagtgttcatgccttgctgagattttccaggcatgtggtcagcctgtcacttactaaactgaaattttaaaatcaggtttcaaatgttaagctttgaccaacctgagaaaatgttaaagtattgtttttaaaaaaatggaaattttttttgtttgtgtttttgttttagtttcgaataaacttagttaccttacacttcccttctacttatccaattatgcatatgtctgggattgaggggccaaaactatagcgaacttgaatgaagtattagggccagttgtcaggtcagggtggcatcttttattttaaggtcctctaaagtcattctgctttaaaacacccctcaaacatacctttaaacttaagatcatagacagacatctcatcaaccagtaaaactttctaaatactaccttgtcacatctattgtgtagttatttaacagattaaatagaagtcatttaataagactccaagtctcagtctgcttgactagtagcataaactcagtctattctattttagaatgtggtggagaaagatgatagttattagattcctttgtcacatcttatacagtccacttgggttaaaggtggaactgtcaagaaaaacgcctttctggcacacagtgatatgcagagcaggaccagctgaagtcagatgtgcaaggaaatctgtggttgctgagcaggatgaaaagtatcctgttagaaagtgagataggtgtgtttttatattgtcctaatgtgaactccttagtcttggttccaaagggaagggtacctgaaaataaatgtatttttatagctgaaaaatcaagagtttctaggatattgtgtgaatgtcaaatgataaatatctagaaactgatttcatattagtatgtgtggctatttaaagtataatgactttggtttggttatatgagtgacacagaatttaaggaggcttcatgccatagttcatagtttgctctaatggcttggtggtatccctgaacagtctacttttagaaattaacagtaaatacacaatccagctgtaatcttaccctccaccagggggagcttcaacatcggttaatactttttttttttttgagatggagtctcgccctgtcgcccaggctagagtgcaatggctcagtctccgctcactgcaacctctgcctcccgggttcaaacagttgtgcctcagtcttccaagtagctgggattacaggcacccgccaccacgcccagctaatttttgtatttttagtagagacggggtttcatcatgttggcgaggctggtcttgaactcctgacttcgtgatccgcccccccctcagcctcccaaagtgctgggattacaggcgtgagccaccgcgcctggcccggttaatactttcataagcattgaagtaactatttaagtcctagtacataaacactgtgtggttcacaaaaaggcatagagacattctctcaagagtttacaatctaattgggcagggaagatactacagttcatcaaagatatgaataacaccctagttttctgaactgcagctgcatgggtaattatcttaagaacttttggcaaaatatggatgttggtgtgttactctcttctccctacaactctgaactaatctgtgtttggcaccttgatttgccatcataaatggccaccatttactcctcactgaaatattcttcttctttgaggttataatgtacttggaaaagttaatacttatagaaaataatgatctttattaccaactttattaaaacaggcttggaacatttttctccatagaagaatagtaataagacattctacatttcctggacatggccagtttaaaatattttgccccattacccttgtagatacacatgtatttgtcagtttatgtgcctcagttttgtcttaggcactgagggacagaaagagaaataaggaataccttggtattttcctttgcaagcaatcacagcagaatgctagaaaacataaaatatactcttataaattgtatgtgtgttgaaaccaaagtgtgaagaaattgtcaggtatttggaggaggaaaataatttgtaaaataacctttttaagaatttggattttgtacttatttaaggtgctaaatatgtgttaaaatatcccctcttgaatcagctccaggcttaaaagggcagagtggtttggattcttgtccagggtctggaaagagctcatcttgccgagagggaaataaatgtgagctttgaggcggtctaactacccagcttttagtatttatgttccccaaaatgtaaaaactgtaagttattcttgaaaatgtagtccagacatttctttgatcctggattttactgcagtttcatcatgggtttgttgaatgtgcagtccatttattgccctgtcttgcttaaatattcttgttgagaacagctggaggctttgactgggttcctagttctgttttctgggaaggcaacgtggattctgttttgtagacattaatgagctttaaatgggaattggggatgatgtatgttcgttgggcatgctgagaagcggcctcctgtggttctgggcccaaggtgtgacatacatttcccactaattgcttctctcaagaagcaagagattggctgttcctcttgaggaaaaaccttaataaaccttcccattttaaa

SEQ ID NO: 3547 - DNA, 666 bp, Homo sapiens
ggaggaggcgccgccgccgctcccgaggcccctgccgccgccgctcccgctgctgtcgccgcgcagagccggagcaggagccacggccgagaggagggaggaggaggaggaggaggtggaggaggtggaggaggtggaggaggcgccggaccgggggggatagattcccagaagtgggataactggatcagagggtgattaccctgtgtataagagtatgtgtctcactgcaccttcaatggcattgagtagatcgtcagtatttaaacagatcacatcatgcgtgagtacaagctagtggtccttggttcaggaggcgttgggaagtctgctctgacagttcagtttgttcagggaatttttgttgaaaaatatgacccaacgatagaagattcctacagaaagcaagttgaagtcgattgccaacagtgtatgctcgaaatcctggatactgcagggacagagcaatttacagcaatgagggatttgtatatgaagaacggccaaggttttgcactagtatattctattacagctcagtccacgtttaacgacttacaggacctgagggaacagattttacgggttaaggacacggaagatgttccaatgattttggttggcaataaatgtgacctggaagatgagcgagtagttggcaaagag

SEQ ID NO: 3548 - DNA, 1906 bp, Homo sapiens
ggcgccgccgccgctcccgaggcccctgccgccgccgctcccgctgctgtcgccgcgcagagccggagcaggagccacggccgagaggagggaggaggaggaggaggaggtggaggaggtggaggaggtggaggaggcgccggaccgggggggatagattcccagaagtgggataactggatcagagggtgattaccctgtgtataagagtatgtgtctcactgcaccttcaatggcattgagtagatcgtcagtatttaaacagatcacatcatgcgtgagtacaagctagtggtccttggttcaggaggcgttgggaagtctgctctgacagttcagtttgttcagggaatttttgttgaaaaatatgacccaacgatagaagattcctacagaaagcaagttgaagtcgattgccaacagtgtatgctcgaaatcctggatactgcagggacagagcaatttacagcaatgagggatttgtatatgaagaacggccaaggttttgcactagtatattctattacagctcagtccacgtttaacgacttacaggacctgagggaacagattttacgggttaaggacacggaagatgttccaatgattttggttggcaataaatgtgacctggaagatgagcgagtagttggcaaagagcagggccagaatttagcaagacagtggtgtaactgtgcctttttagaatcttctgcaaagtcaaagatcaatgttaatgagatattttatgacctggtcagacagataaataggaaaacaccagtggaaaagaagaagcctaaaaagaaatcatgtctgctgctctaggcccatagtcagcagcagctctgagccagattacaggaatgaagaactgttgcctaattggaaagtgccagcattccagacttcaaaaataaaaaatctgaagaggcttctcctgttttatatattatgtgaagaatttagatcttatattggtttgcacaagttccctggagaaaaaaattgctctgtgtatatctcttggaaaataagacaatagtatttctcctttgcaatagcagttataacagatgtgaaaatatacttgactctaatatgattatacaaaagagcatggatgcatttcaaatgttagatattgctactataatcaaatgatttcatattgatctttttatcatgatcctccctatcaagcactaaaaagttgaaccattatactttatatctgtaatgatactgattatgaaatgtcccctcaaactcattgcagcagataacttttttgagtcattgacttcattttatatttaaaaaattatggaatatcatctgtcattatattctaattaaaattgtgcataatgctttggaaaaatgggtcttttataggaaaaaaactgggataactgatttctatggctttcaaagctaaaatatataatatactaaaccaactctaatattgcttcttgtgttttactgtcagattaaattacagcttttatggatgattaaattttagtacattttcatttggtttgtgtgtttttgttattgtttatagattaaagcgtttattttataatgaccacattgttttaaatgcgacagtagctcctttctgcctagtatctgcagaacactggctttaaactatactaagtaactggtgatttctctaggaacagacctcgcactttctgttctaaatatatttattcctactatacagtaaaatacatcagacaacatagaatagttttgtatattctctcttgatcttaaagattgtatcttattgaatatcccactgtatattatttttatatgtaaaaagataagtttaatactgtatcagggtttaacttttactatttcagatcttccacagcttgta

SEQ ID NO: 3549 - DNA, 869 bp, Homo sapiens
caaccacgcccgcggaccgacccggtcgactgtaggcctgcgggagaccgtcgggaggggccccggccggctgtgggagagaaagaggacattgtgtcccccacccttcagctccccgaggtgtcatagcacaagcccatttccctcgccgtctccccagacacggtgccctcgtacctcactgcctgagagaagtagaagatcgtcagtatttaaacagatcacatcatgcgtgagtacaagctagtggtccttggttcaggaggcgttgggaagtctgctctgacagttcagtttgttcagggaatttttgttgaaaaatatgacccaacgatagaagattcctacagaaagcaagttgaagtcgattgccaacagtgtatgctcgaaatcctggatactgcagggacagagcaatttacagcaatgagggatttgtatatgaagaacggccaaggttttgcactagtatattctattacagctcagtccacgtttaacgacttacaggacctgagggaacagattttacgggttaaggacacggaagatgttccaatgattttggttggcaataaatgtgacctggaagatgagcgagtagttggcaaagagcagggccagaatttagcaagacagtggtgtaactgtgcctttttagaatcttctgcaaagtcaaagatcaatgttaatgagatattttatgacctggtcagacagataaataggaaaacaccagtggaaaagaagaagcctaaaaagaaatcatgtctgctgctctaggcccatagtcagcagcagctctgagccagattacaggaatgaagaactgttgcctaattggaaagtgccagcattccagacttcaa

SEQ ID NO: 3550 - DNA, 3567 bp, Homo sapiens
cccttcctccctgtaactgaacagtgaaaattcacattgtggatccgctaacaggcacagatgtcatgtgaaaacgcacatgctctgccatccacaccgcctttctttcttttctttctgtttccttttttcccccttgttccttctccctcttctttgtaactaacaaaaccaccaccaactcctcctcctgctgctgcccttcctcctcctcctcagtccaagtgatcacaaaagaaatcttctgagccggaggcggtggcattttttaaaaagcaagcacattggagagaaagaaaaagaaaaacaaaaccaaaacaaaacccaggcaccagacagccagaacatttttttttcacccttcctgaaaacaaacaaacaaacaaacaatcatcaaaacagtcaccaccaacatcaaaactgttaacatagcggcggcggcggcaaacgtcaccctgcagccacggcgtccgcctaaagggatggttttctcggcagagcagctcttcgccgaccaccttcttcactcgtgctgagcgggatttttgggctctccggggttcgggctgggagcagcttcatgactacgcggagcgggagagcggccacaccatgcgagcacaaattgaagtgataccatgcaaaatttgtggcgataagtcctctgggatccactacggagtcatcacatgtgaaggctgcaagggattctttaggaggagccagcagaacaatgcttcttattcctgcccaaggcagagaaactgtttaattgacagaacgaacagaaaccgttgccaacactgccgactgcagaagtgtcttgccctaggaatgtcaagagatgctgtgaagtttgggaggatgtccaagaagcaaagggacagcctgtatgctgaggtgcagaagcaccagcagcggctgcaggaacagcggcagcagcagagtggggaggcagaagcccttgccagggtgtacagcagcagcattagcaacggcctgagcaacctgaacaacgagaccagcggcacttatgccaacgggcacgtcattgacctgcccaagtctgagggttattacaacgtcgattccggtcagccgtcccctgatcagtcaggacttgacatgactggaatcaaacagataaagcaagaacctatctatgacctcacatccgtacccaacttgtttacctatagctctttcaacaatgggcagttagcaccagggataaccatgactgaaatcgaccgaattgcacagaacatcattaagtcccatttggagacatgtcaatacaccatggaagagctgcaccagctggcgtggcagacccacacctatgaagaaattaaagcatatcaaagcaagtccagggaagcactgtggcaacaatgtgccatccagatcactcacgccatccaatacgtggtggagtttgcaaagcggataacaggcttcatggagctctgtcaaaatgatcaaattctacttctgaagtcaggttgcttggaagtggttttagtgagaatgtgccgtgccttcaacccattaaacaacactgttctgtttgaaggaaaatatggaggaatgcaaatgttcaaagccttaggttctgatgacctagtgaatgaagcatttgactttgcaaagaatttgtgttccttgcagctgaccgaggaggagatcgctttgttctcatctgctgttctgatatctccagaccgagcctggcttatagaaccaaggaaagtccagaagcttcaggaaaaaatttattttgcacttcaacatgtgattcagaagaatcacctggatgatgagaccttggcaaagttaatagccaagataccaaccatcacggcagtttgcaacttgcacggggagaagctgcaggtatttaagcaatctcatccagagatagtgaatacactgtttcctccgttatacaaggagctctttaatcctgactgtgccaccggctgcaaatgaaggggacaagagaactgtctcatagtcatggaatgcatcaccattaagacaaaagcaatgtgttcatgaagacttaagaaaaatgtcactactgcaacattaggaatgtcctgcacttaatagaattatttttcaccgctacagtttgaagaatgtaaatatgcacctgagtggggctcttttatttgtttgtttgtttttgaaatgaccataaatatacaaatataggacactgggtgttatcctttttttaattttattcgggtatgttttgggagacaactgtttatagaattttattgtagatatatacaagaaaagagcggtactttacatgattacttttcctgttgattgttcaaatataatttaagaaaattccacttaataggcttacctatttctatgtttttaggtagttgatgcatgtgtaaatttgtagctgtcttggaaagtactgtgcatgtatgtaataagtatataatatgtgagaatattatatatgactattacttatacatgcacatgcactgtggcttaaataccatacctactagcaatggaggttcagtcaggctctcttctatgatttaccttctgtgttatatgttacctttatgttagacaatcaggattttgttttcccagccagagttttcatctatagtcaatggcaggacggtaccaactcagagttaagtctacaaaggaataaacataatgtgtggcctctatatacaaactctatttctgtcaatgacatcaaagccttgtcaagatggttcatattgggaaggagacagtattttaagccattttcctgtttcaagaattaggccacagataacattgcaaggtccaagacttttttgaccaaacagtagatattttctatttttcaccagaacacataaaaacactttttttcttttggatttctggttgtgaaacaagcttgatttcagtgcttattgtgtcttcaactgaaaaatacaatctgtggattatgactaccagcaatttttttctaggaaagttaaaagaataaatcagaacccagggcaacaatgccatttcatgtaaacattttctctctcaccatgttttggcaagaaaaggtagaaagagaagacccagagtgaagaagtaattctttatattcctttctttaatgtatttgttaggaaaagtggcaataaagggggaggcatattataaaatgctataatataaaaatgtagcaaaaacttgacagactagaaaaaaaaagatctgtgttattctagggaactaatgtaccccaaagccaaaactaattcctgtgaagtttacagttacatcatccatttaccctagaattatttttttagcaacttttagaaataaagaatacaactgtgacattaggatcagagattttagacttccttgtacaaattctcacttctccacctgctcaccaatgaaattaatcataagaaaagcatatattccaagaaatttgttctgcctgtgtcctggaggcctatacctctgttattttctgatacaaaataaaacttaaaaaaaagaaaa

SEQ ID NO: 3551 - DNA, 2996 bp, Homo sapiens
atgtgtgagaaccagctcaaaactaaagctgacgccactgcacaaattgaagtgataccatgcaaaatttgtggcgataagtcctctgggatccactacggagtcatcacatgtgaaggctgcaagggattctttaggaggagccagcagaacaatgcttcttattcctgcccaaggcagagaaactgtttaattgacagaacgaacagaaaccgttgccaacactgccgactgcagaagtgtcttgccctaggaatgtcaagagatgctgtgaagtttgggaggatgtccaagaagcaaagggacagcctgtatgctgaggtgcagaagcaccagcagcggctgcaggaacagcggcagcagcagagtggggaggcagaagcccttgccagggtgtacagcagcagcattagcaacggcctgagcaacctgaacaacgagaccagcggcacttatgccaacgggcacgtcattgacctgcccaagtctgagggttattacaacgtcgattccggtcagccgtcccctgatcagtcaggacttgacatgactggaatcaaacagataaagcaagaacctatctatgacctcacatccgtacccaacttgtttacctatagctctttcaacaatgggcagttagcaccagggataaccatgactgaaatcgaccgaattgcacagaacatcattaagtcccatttggagacatgtcaatacaccatggaagagctgcaccagctggcgtggcagacccacacctatgaagaaattaaagcatatcaaagcaagtccagggaagcactgtggcaacaatgtgccatccagatcactcacgccatccaatacgtggtggagtttgcaaagcggataacaggcttcatggagctctgtcaaaatgatcaaattctacttctgaagtcaggttgcttggaagtggttttagtgagaatgtgccgtgccttcaacccattaaacaacactgttctgtttgaaggaaaatatggaggaatgcaaatgttcaaagccttaggttctgatgacctagtgaatgaagcatttgactttgcaaagaatttgtgttccttgcagctgaccgaggaggagatcgctttgttctcatctgctgttctgatatctccagaccgagcctggcttatagaaccaaggaaagtccagaagcttcaggaaaaaatttattttgcacttcaacatgtgattcagaagaatcacctggatgatgagaccttggcaaagttaatagccaagataccaaccatcacggcagtttgcaacttgcacggggagaagctgcaggtatttaagcaatctcatccagagatagtgaatacactgtttcctccgttatacaaggagctctttaatcctgactgtgccaccggctgcaaatgaaggggacaagagaactgtctcatagtcatggaatgcatcaccattaagacaaaagcaatgtgttcatgaagacttaagaaaaatgtcactactgcaacattaggaatgtcctgcacttaatagaattatttttcaccgctacagtttgaagaatgtaaatatgcacctgagtggggctcttttatttgtttgtttgtttttgaaatgaccataaatatacaaatataggacactgggtgttatcctttttttaattttattcgggtatgttttgggagacaactgtttatagaattttattgtagatatatacaagaaaagagcggtactttacatgattacttttcctgttgattgttcaaatataatttaagaaaattccacttaataggcttacctatttctatgtttttaggtagttgatgcatgtgtaaatttgtagctgtcttggaaagtactgtgcatgtatgtaataagtatataatatgtgagaatattatatatgactattacttatacatgcacatgcactgtggcttaaataccatacctactagcaatggaggttcagtcaggctctcttctatgatttaccttctgtgttatatgttacctttatgttagacaatcaggattttgttttcccagccagagttttcatctatagtcaatggcaggacggtaccaactcagagttaagtctacaaaggaataaacataatgtgtggcctctatatacaaactctatttctgtcaatgacatcaaagccttgtcaagatggttcatattgggaaggagacagtattttaagccattttcctgtttcaagaattaggccacagataacattgcaaggtccaagacttttttgaccaaacagtagatattttctatttttcaccagaacacataaaaacactttttttcttttggatttctggttgtgaaacaagcttgatttcagtgcttattgtgtcttcaactgaaaaatacaatctgtggattatgactaccagcaatttttttctaggaaagttaaaagaataaatcagaacccagggcaacaatgccatttcatgtaaacattttctctctcaccatgttttggcaagaaaaggtagaaagagaagacccagagtgaagaagtaattctttatattcctttctttaatgtatttgttaggaaaagtggcaataaagggggaggcatattataaaatgctataatataaaaatgtagcaaaaacttgacagactagaaaaaaaaagatctgtgttattctagggaactaatgtaccccaaagccaaaactaattcctgtgaagtttacagttacatcatccatttaccctagaattatttttttagcaacttttagaaataaagaatacaactgtgacattaggatcagagattttagacttccttgtacaaattctcacttctccacctgctcaccaatgaaattaatcataagaaaagcatatattccaagaaatttgttctgcctgtgtcctggaggcctatacctctgttattttctgatacaaaataaaacttaaaaaaaagaaaacaagctaa

SEQ ID NO: 3552 - DNA, 1751 bp, Homo sapiens
gcgatctacgtttcagtcttaacggttgcggcgcggctctggcccgggcgcacgcgcacactgacacgcgtacacgcacgcacgcgaccggggcggtggttggcggctacggacgcgcaggactgggggacgggcgggtacggctatgggcgaggcggaggcgccttctttcgaaatgacctggagcagcacgacgagcagtggctactgcagccaagaggactcggactcggagctcgagcagtacttcaccgcgcgaacctcgctagctcgcaggccgcgccgggaccaggacgagcctgtggagtgggagacacctgacctttctcaagctgagattgagcagaagatcaaggagtacaatgcccagatcaacagcaacctcttcatgagcttgaacaaggacggttcttacacaggcttcatcaaggttcagctgaagctggtgcgccctgtctctgtgccctccagcaagaagccaccctccttgcaggatgcccggcggggcccaggacggggcacaagtgtcaggcgccgcacttccttttacctgcccaaggatgctgtcaagcacctgcatgtgctgtcacgcacaagggcacgtgaagtcattgaggccctgctgcgaaagttcttggtggtggatgacccccgcaagtttgcactctttgagcgcgctgagcgtcacggccaagtgtacttgcggaagctgttggatgatgagcagcccctgcggctgcggctcctggcagggcccagtgacaaggccctgagctttgtcctgaaggaaaatgactctggggaggtgaactgggacgccttcagcatgcctgaactacataacttcctacgtatcctgcagcgggaggaggaggagcacctccgccagatcctgcagaagtactcctattgccgccagaagatccaagaggccctgcacgcctgcccccttgggtgacctcttgtacccccaggtggaaggcagacagcaggcagcgccaagtgcgtgccgtgtgagtgtgacagggccagtggggcctgtggaatgagtgtgcatggaggccctcctgtgctgggggaatgagcccagagaacagcgaagtagcttgctccctgtgtccacctgtgggtgtagccaggtatggctctgcacccctctgccctcattactgggccttagtgggccagggctgccctgagaagctgctccaggcctgcagcaggagtggtgcagacagaagtctcctcaatttttgtctcagaagtgaaaatcttggagaccctgcaaacagaacagggtcatgtttgcaggggtgacggccctcatctatgaggaaaggttttggatcttgaatgtggtctcaggatatccttatcagagctaagggtgggtgctcagaataaggcaggcattgaggaagagtcttggtttctctctacagtgccaactcctcacacaccctgaggtcagggagtgctggctcacagtacagcatgtgccttaatgcttcatatgaggaggatgtccctgggccagggtctgtgtgaatgtgggcactggcccaggttcataccttatttgctaatcaaagccagggtctctccctcaggtgttttttatgaagtgcgtgaatgtatgtaatgtgtggtggcctcagctgaatgcctcctgtggggaaaggggttggggtgacagtcatcatcagggcctggggcctgagagaattggctcaataaagatttcaagatcc

SEQ ID NO: 3553 - DNA, 1864 bp, Homo sapiens
cgcccaaagccagcgaagcacgggcccaaccgggccatgtcgggggagcctgagctcattgagctgcgggagctggcacccgctgggcgcgctgggaagggccgcacccggctggagcgtgccaacgcgctgcgcatcgcgcggggcaccgcgtgcaaccccacacggcagctggtccctggccgtggccaccgcttccagcccgcggggcccgccacgcacacgtggtgcgacctctgtggcgacttcatctggggcgtcgtgcgcaaaggcctgcagtgcgcgcgcctctctgcagattgcaagttcacctgccactaccgctgccgcgcgctcgtctgcctggactgttgcgggccccgggacctgggctgggaacccgcggtggagcgggacacgaacgtggacgagcctgtggagtgggagacacctgacctttctcaagctgagattgagcagaagatcaaggagtacaatgcccagatcaacagcaacctcttcatgagcttgaacaaggacggttcttacacaggcttcatcaaggttcagctgaagctggtgcgccctgtctctgtgccctccagcaagaagccaccctccttgcaggatgcccggcggggcccaggacggggcacaagtgtcaggcgccgcacttccttttacctgcccaaggatgctgtcaagcacctgcatgtgctgtcacgcacaagggcacgtgaagtcattgaggccctgctgcgaaagttcttggtggtggatgacccccgcaagtttgcactctttgagcgcgctgagcgtcacggccaagtgtacttgcggaagctgttggatgatgagcagcccctgcggctgcggctcctggcagggcccagtgacaaggccctgagctttgtcctgaaggaaaatgactctggggaggtgaactgggacgccttcagcatgcctgaactacataacttcctacgtatcctgcagcgggaggaggaggagcacctccgccagatcctgcagaagtactcctattgccgccagaagatccaagaggccctgcacgcctgcccccttgggtgacctcttgtacccccaggtggaaggcagacagcaggcagcgccaagtgcgtgccgtgtgagtgtgacagggccagtggggcctgtggaatgagtgtgcatggaggccctcctgtgctgggggaatgagcccagagaacagcgaagtagcttgctccctgtgtccacctgtgggtgtagccaggtatggctctgcacccctctgccctcattactgggccttagtgggccagggctgccctgagaagctgctccaggcctgcagcaggagtggtgcagacagaagtctcctcaatttttgtctcagaagtgaaaatcttggagaccctgcaaacagaacagggtcatgtttgcaggggtgacggccctcatctatgaggaaaggttttggatcttgaatgtggtctcaggatatccttatcagagctaagggtgggtgctcagaataaggcaggcattgaggaagagtcttggtttctctctacagtgccaactcctcacacaccctgaggtcagggagtgctggctcacagtacagcatgtgccttaatgcttcatatgaggaggatgtccctgggccagggtctgtgtgaatgtgggcactggcccaggttcataccttatttgctaatcaaagccagggtctctccctcaggtgttttttatgaagtgcgtgaatgtatgtaatgtgtggtggcctcagctgaatgcctcctgtggggaaaggggttggggtgacagtcatcatcagggcctggggcctgagagaattggctcaataaagatttcaagatcc

SEQ ID NO: 3554 - DNA, 1923 bp, Homo sapiens
cagtctggatcctgggggaggcgctgaagtcggggcccgccctgtggccccgcccggcccgcgcttgctagcgcccaaagccagcgaagcacgggcccaaccgggccatgtcgggggagcctgagctcattgagctgcgggagctggcacccgctgggcgcgctgggaagggccgcacccggctggagcgtgccaacgcgctgcgcatcgcgcggggcaccgcgtgcaaccccacacggcagctggtccctggccgtggccaccgcttccagcccgcggggcccgccacgcacacgtggtgcgacctctgtggcgacttcatctggggcgtcgtgcgcaaaggcctgcagtgcgcgcattgcaagttcacctgccactaccgctgccgcgcgctcgtctgcctggactgttgcgggccccgggacctgggctgggaacccgcggtggagcgggacacgaacgtggacgagcctgtggagtgggagacacctgacctttctcaagctgagattgagcagaagatcaaggagtacaatgcccagatcaacagcaacctcttcatgagcttgaacaaggacggttcttacacaggcttcatcaaggttcagctgaagctggtgcgccctgtctctgtgccctccagcaagaagccaccctccttgcaggatgcccggcggggcccaggacggggcacaagtgtcaggcgccgcacttccttttacctgcccaaggatgctgtcaagcacctgcatgtgctgtcacgcacaagggcacgtgaagtcattgaggccctgctgcgaaagttcttggtggtggatgacccccgcaagtttgcactctttgagcgcgctgagcgtcacggccaagtgtacttgcggaagctgttggatgatgagcagcccctgcggctgcggctcctggcagggcccagtgacaaggccctgagctttgtcctgaaggaaaatgactctggggaggtgaactgggacgccttcagcatgcctgaactacataacttcctacgtatcctgcagcgggaggaggaggagcacctccgccagatcctgcagaagtactcctattgccgccagaagatccaagaggccctgcacgcctgcccccttgggtgacctcttgtacccccaggtggaaggcagacagcaggcagcgccaagtgcgtgccgtgtgagtgtgacagggccagtggggcctgtggaatgagtgtgcatggaggccctcctgtgctgggggaatgagcccagagaacagcgaagtagcttgctccctgtgtccacctgtgggtgtagccaggtatggctctgcacccctctgccctcattactgggccttagtgggccagggctgccctgagaagctgctccaggcctgcagcaggagtggtgcagacagaagtctcctcaatttttgtctcagaagtgaaaatcttggagaccctgcaaacagaacagggtcatgtttgcaggggtgacggccctcatctatgaggaaaggttttggatcttgaatgtggtctcaggatatccttatcagagctaagggtgggtgctcagaataaggcaggcattgaggaagagtcttggtttctctctacagtgccaactcctcacacaccctgaggtcagggagtgctggctcacagtacagcatgtgccttaatgcttcatatgaggaggatgtccctgggccagggtctgtgtgaatgtgggcactggcccaggttcataccttatttgctaatcaaagccagggtctctccctcaggtgttttttatgaagtgcgtgaatgtatgtaatgtgtggtggcctcagctgaatgcctcctgtggggaaaggggttggggtgacagtcatcatcagggcctggggcctgagagaattggctcaataaagatttcaagatcc

SEQ ID NO: 3555 - DNA, 1657 bp, Homo sapiens
caactgttgagcaggcctctctgcctgtggccttccggccggtttccagacgcccaggtggccaacattagagtccgcgtagcagtgtgagattgcaagttcacctgccactaccgctgccgcgcgctcgtctgcctggactgttgcgggccccgggacctgggctgggaacccgcggtggagcgggacacgaacgtggacgagcctgtggagtgggagacacctgacctttctcaagctgagattgagcagaagatcaaggagtacaatgcccagatcaacagcaacctcttcatgagcttgaacaaggacggttcttacacaggcttcatcaaggttcagctgaagctggtgcgccctgtctctgtgccctccagcaagaagccaccctccttgcaggatgcccggcggggcccaggacggggcacaagtgtcaggcgccgcacttccttttacctgcccaaggatgctgtcaagcacctgcatgtgctgtcacgcacaagggcacgtgaagtcattgaggccctgctgcgaaagttcttggtggtggatgacccccgcaagtttgcactctttgagcgcgctgagcgtcacggccaagtgtacttgcggaagctgttggatgatgagcagcccctgcggctgcggctcctggcagggcccagtgacaaggccctgagctttgtcctgaaggaaaatgactctggggaggtgaactgggacgccttcagcatgcctgaactacataacttcctacgtatcctgcagcgggaggaggaggagcacctccgccagatcctgcagaagtactcctattgccgccagaagatccaagaggccctgcacgcctgcccccttgggtgacctcttgtacccccaggtggaaggcagacagcaggcagcgccaagtgcgtgccgtgtgagtgtgacagggccagtggggcctgtggaatgagtgtgcatggaggccctcctgtgctgggggaatgagcccagagaacagcgaagtagcttgctccctgtgtccacctgtgggtgtagccaggtatggctctgcacccctctgccctcattactgggccttagtgggccagggctgccctgagaagctgctccaggcctgcagcaggagtggtgcagacagaagtctcctcaatttttgtctcagaagtgaaaatcttggagaccctgcaaacagaacagggtcatgtttgcaggggtgacggccctcatctatgaggaaaggttttggatcttgaatgtggtctcaggatatccttatcagagctaagggtgggtgctcagaataaggcaggcattgaggaagagtcttggtttctctctacagtgccaactcctcacacaccctgaggtcagggagtgctggctcacagtacagcatgtgccttaatgcttcatatgaggaggatgtccctgggccagggtctgtgtgaatgtgggcactggcccaggttcataccttatttgctaatcaaagccagggtctctccctcaggtgttttttatgaagtgcgtgaatgtatgtaatgtgtggtggcctcagctgaatgcctcctgtggggaaaggggttggggtgacagtcatcatcagggcctggggcctgagagaattggctcaataaagatttcaagatcc

SEQ ID NO: 3556 - DNA, 5282 bp, Homo sapiens
aatgctgtgagttccttgttaggcctctccttccgatgaaaagagaaaggaagaatggactacagccaccaaacgtccctagtcccatgtggacaagataaatacatttccaaaaatgaacttctcttgcatctgaagacctacaacttgtactatgaaggccagaatttacagctccggcaccgggaggaagaagacgagttcattgtggaggggctcctgaacatctcctggggcctgcgccggcccattcgcctgcagatgcaggatgacaacgaacgcattcgaccccctccatcctcctcctcctggcactctggctgtaacctgggggctcagggaaccactctgaagcccctgactgtgcccaaagttcagatctcagaggtggatgccccgccggagggtgaccagatgccaagctccacagactccaggggcctgaagcccctgcaggaggacaccccacagctgatgcgcacacgcagtgatgttggggtgcgtcgccgtggcaatgtgaggacgcctagtgaccagcggcgaatcagacgccaccgcttctccatcaacggccatttctacaaccataagacatccgtgttcacaccagcctatggctctgtcaccaacgtccgcatcaacagcaccatgaccaccccacaggtcctgaagctgctgctcaacaaatttaagattgagaattcagcagaggagtttgccttgtacgtggtccatacgagtggtgagaaacagaagctgaaggccaccgattacccgctgattgcccgaatcctccagggcccatgtgagcagatctccaaagtgttcctaatggagaaggaccaggtggaggaagtcacctacgacgtggcccagtatataaagttcgagatgccggtacttaaaagcttcattcagaagctccaggaggaagaagatcgggaagtaaagaagctgatgcgcaagtacaccgtgctccggctaatgattcgacagaggctggaggagatagccgagaccccagcaacaatctgagccatgagaacgaggggatctgggcaccccaggaaccgccattgcccataagacccccaggaagctaggcactttctttccatggaaacatttagacacaaacctccccagctccggccaagccatcatttgctacctggagctggatgtagaagtcagcagacagctccctatccctggacccctgccctccttttttctgctcacaaggacttttgattttagttataaggaggacccaaaatgtgtgtgtgtacatgtgtgtgcacacatggtacgtgtccatgtgcctacctgatactttcacatgtaattaaattccaggcaaccagcacaagagccgtgagcttggcacatgtgctgctcgtgagcaggaaaatcagaggagccactgatctgagtggtatttaggttgaaggaaagatttctcctctcaagtgccagggagcagccacacgtctgtctgtgtttagagagggaagagggttctccaggttcaccatttgggttgtttatatgttggtagaaattctccctgtatgcctagaaggatcagtgaatgtaagagccttggaaattaacaaaataacagccacataaccttgcggcaagtctgatggaaagaaaaagataaaccatccgtggggtagatgcaataagcccacgtatttttacactggaaacgttgattgttttaaatgacaaagacatatgtgatgttctatgtggaaacctgtgaagagtggattctgcctccatctctgcctccatggctacctttaggagacagagaagatcctgtgtgtttctctgtacccagctgacagcctgtctctatggcgcttccttgagtggaaggaaatgtctcaagaaacaaagatctcgctggtgcgtacacagtgctgaccagctagtgtggccagggcctggtggcctggtggccaggaagtttcaggttgaagggaaatgtcgaggctacctgcagatatgacaggtgccttgaacgcagcccatcttcatgtcatcaaaggtcttcctgcacttgaagctggggcgatgtttgcagtcaagaccattctttccaacctctgggttcttgcaagttgccctcaccttgtgtgtggagatgcattccaagaatgaagcctcatcttgctactgagtgtggggttcagggaagctctttaggccacctggtgaaggtgcatggggaggatggagcttctcctcagctcctctgagcagccacctatgtgatctttaaatccaaccccaatgggagaaaagggcaagaacagtctgtgccctgggactcctatcaggaagcttgacaggcagctgggcatcagtgcagctgatatcgtttgaggagggagacagatgcttggacctgggtgcctggctatggagattgaccaagcaagatcaggagctcctgatagcaggcgtctttgagcctagctggggtagaggcactgcccatctcttctccaccttctctccacagaatgtttgcagagctgggcagttgaggaaaggacagcccctggttggtgcctccaaaggaaggtggacttttttggtggagacgtttctgccctgggcaccctcctgcccccgattcatacctatggcttcttgagaaggctcacagctgtggtcttaacgtagactgcagaaagatggcatgcggcccctggcatttcgccaagggttttatagcaagtctccttcctccatagggacagcagcaccagccctgtggggcatggagtggaagcccagaagggcttctgcaagctgcacagaactggggtaagaagacaaagagtagccaccgggagaggcttcctttgttacagctgggaaagaacagttctgtgaatgcaaacacctcctgagttttgcaattgagaaaatgatttggagaacttctcttctggtaatttttattttgaatgttcagggccttagttggccccagtaattctccttggaggacttgggagaagaatttccacaaagcaaactactaaccactagctcttactggacagcgatttctggcttataagagttctctttgatttgcactagcactacgatagtgttagatggggaaatactgcaacatgtccagttggccagatcactttccaagggagcgatactaaggcagactcagctttttaaagatgggaggtcaggaggtggaagtgagaggagatcccatctcacacaacacacttccacgtaatgcagaccacacttttccattttgtcctgccctcttgagaggtcatttctcacgtcctaagaacctgatcagaaattttggaagggttctttgaaatagcagcagttgaaacagagacactttgccacagtgtggagcagattttctcactggtatcacatggtcttgcagttttgaactcttcgaccgatttgtgggagtttatgtaattgcgtgcaatgaacctgaaattgtgtaaaggacaaaagaccagtttatagggttgggttttttttccaacttgtgaaaagcagtttagctgcatctgtctccccaccacccccaccccgggaggggcttatgttacaaggtgatcaagtgaaggaaaaacctgagcctatctggctgggatggtggaattaagcacaaggtcacattctctgtgatcacatgagagggaaggtgatgacttaaatggcagggggtggggattatcttggggagaggctgaaaagcacaaaagatagtcttccctgtacgtattggtgaagaacgtgcacaaggctggatggacttcaacttggagttgagttgaggcaagaggatttctggatattagtcacccatctgcaagaaaaatgctgaggcctcgggtcaagattttgatctgagacatgctgatgcttcaaggagaaatattttcacaatcctctcttccctcaccagaagagaacagtactctctcctagaaacctctaggtaaacacattttatcctaatatcggtagcatataatgccccccccaaaatatctgttttccatgcaaaaaagtctcaacaagaagtctgtggagttgagtggttacttcaaagtgtcaggagagtgaagaaattggccacagaagagcaagaagctctcttaagaaaagggaattctctttaaagaaaccaccaccaacaacaaaacaaccaaaaaccatgttttatgtcaaagctctgtagcacagagaatgtggtgtcacagatacatcgccgagagaggtttctttctttcttttttttttttttgagacagagtctggttctgtttcccaggctggagtgcagtggtgggatctcagctcactgcaacatccgcctctggggttcaagtgattctcctgtctcagcctcccaagtagctggaattacagggacccgccaccacgcccggctaatttttttgtgtggttttagtagaggtggggtttcaccatcttggccaggctggtcttgaactcctgacctcgtgatccacccgcctaggcctcccaaagtgttgggattacaggcgtgagccactgtgcccagccaaaagagaaatttctacatgaacaaggcaatttcagtgtcttacagcggccaaaccatgacgtgaagaatgagataggagacaggagatcaccataagcgtccctgatatagcagcacacattttcacgtttccacttaaatcgttttgcacaaagtcttgcttcgctcagatgagatgagatatgatttcctagagatgtaaaaataagaatgaatgtggcgcccccttcttccagatgtaatagaaagctctgccctatcacaaggggggtgttgaagcgccccttgtgttttaactgtatttaactgagcacaagatgcacaagctgtggtgggaaaccctcagtttacctttggagtcttccctgcagatcgcagacctgtttccaggctgatgtttctggtgtgtaattgctagcgtttctgaagggttttcccaattgttttagccttgtgaagtattcttaattataacttgcctttcagcgatggtacatgacttgattcaacgtttggttctgaacttacacactgatgcgtttactcatctaacataatctgacagggcctcagcaagggagccatacatttttgtaacattttgatatgttttaatgcatctgacttagatcttactgaaataaagcacttttcaaag

SEQ ID NO: 3557 - DNA, 5427 bp, Homo sapiens
ggggaggaagaaaggcgaaggcaaggcgaaggggtggagagtgatatgaagagcgagagaaaagagaggacagcggacgagcagatccggtatctggaatcccggcgcctagaacgtgtttttcgggagagcaaaggctgtgtctacggcagcctggggatatagcctctccttccgatgaaaagagaaaggaagaatggactacagccaccaaacgtccctagtcccatgtggacaagataaatacatttccaaaaatgaacttctcttgcatctgaagacctacaacttgtactatgaaggccagaatttacagctccggcaccgggaggaagaagacgagttcattgtggaggggctcctgaacatctcctggggcctgcgccggcccattcgcctgcagatgcaggatgacaacgaacgcattcgaccccctccatcctcctcctcctggcactctggctgtaacctgggggctcagggaaccactctgaagcccctgactgtgcccaaagttcagatctcagaggtggatgccccgccggagggtgaccagatgccaagctccacagactccaggggcctgaagcccctgcaggaggacaccccacagctgatgcgcacacgcagtgatgttggggtgcgtcgccgtggcaatgtgaggacgcctagtgaccagcggcgaatcagacgccaccgcttctccatcaacggccatttctacaaccataagacatccgtgttcacaccagcctatggctctgtcaccaacgtccgcatcaacagcaccatgaccaccccacaggtcctgaagctgctgctcaacaaatttaagattgagaattcagcagaggagtttgccttgtacgtggtccatacgagtggtgagaaacagaagctgaaggccaccgattacccgctgattgcccgaatcctccagggcccatgtgagcagatctccaaagtgttcctaatggagaaggaccaggtggaggaagtcacctacgacgtggcccagtatataaagttcgagatgccggtacttaaaagcttcattcagaagctccaggaggaagaagatcgggaagtaaagaagctgatgcgcaagtacaccgtgctccggctaatgattcgacagaggctggaggagatagccgagaccccagcaacaatctgagccatgagaacgaggggatctgggcaccccaggaaccgccattgcccataagacccccaggaagctaggcactttctttccatggaaacatttagacacaaacctccccagctccggccaagccatcatttgctacctggagctggatgtagaagtcagcagacagctccctatccctggacccctgccctccttttttctgctcacaaggacttttgattttagttataaggaggacccaaaatgtgtgtgtgtacatgtgtgtgcacacatggtacgtgtccatgtgcctacctgatactttcacatgtaattaaattccaggcaaccagcacaagagccgtgagcttggcacatgtgctgctcgtgagcaggaaaatcagaggagccactgatctgagtggtatttaggttgaaggaaagatttctcctctcaagtgccagggagcagccacacgtctgtctgtgtttagagagggaagagggttctccaggttcaccatttgggttgtttatatgttggtagaaattctccctgtatgcctagaaggatcagtgaatgtaagagccttggaaattaacaaaataacagccacataaccttgcggcaagtctgatggaaagaaaaagataaaccatccgtggggtagatgcaataagcccacgtatttttacactggaaacgttgattgttttaaatgacaaagacatatgtgatgttctatgtggaaacctgtgaagagtggattctgcctccatctctgcctccatggctacctttaggagacagagaagatcctgtgtgtttctctgtacccagctgacagcctgtctctatggcgcttccttgagtggaaggaaatgtctcaagaaacaaagatctcgctggtgcgtacacagtgctgaccagctagtgtggccagggcctggtggcctggtggccaggaagtttcaggttgaagggaaatgtcgaggctacctgcagatatgacaggtgccttgaacgcagcccatcttcatgtcatcaaaggtcttcctgcacttgaagctggggcgatgtttgcagtcaagaccattctttccaacctctgggttcttgcaagttgccctcaccttgtgtgtggagatgcattccaagaatgaagcctcatcttgctactgagtgtggggttcagggaagctctttaggccacctggtgaaggtgcatggggaggatggagcttctcctcagctcctctgagcagccacctatgtgatctttaaatccaaccccaatgggagaaaagggcaagaacagtctgtgccctgggactcctatcaggaagcttgacaggcagctgggcatcagtgcagctgatatcgtttgaggagggagacagatgcttggacctgggtgcctggctatggagattgaccaagcaagatcaggagctcctgatagcaggcgtctttgagcctagctggggtagaggcactgcccatctcttctccaccttctctccacagaatgtttgcagagctgggcagttgaggaaaggacagcccctggttggtgcctccaaaggaaggtggacttttttggtggagacgtttctgccctgggcaccctcctgcccccgattcatacctatggcttcttgagaaggctcacagctgtggtcttaacgtagactgcagaaagatggcatgcggcccctggcatttcgccaagggttttatagcaagtctccttcctccatagggacagcagcaccagccctgtggggcatggagtggaagcccagaagggcttctgcaagctgcacagaactggggtaagaagacaaagagtagccaccgggagaggcttcctttgttacagctgggaaagaacagttctgtgaatgcaaacacctcctgagttttgcaattgagaaaatgatttggagaacttctcttctggtaatttttattttgaatgttcagggccttagttggccccagtaattctccttggaggacttgggagaagaatttccacaaagcaaactactaaccactagctcttactggacagcgatttctggcttataagagttctctttgatttgcactagcactacgatagtgttagatggggaaatactgcaacatgtccagttggccagatcactttccaagggagcgatactaaggcagactcagctttttaaagatgggaggtcaggaggtggaagtgagaggagatcccatctcacacaacacacttccacgtaatgcagaccacacttttccattttgtcctgccctcttgagaggtcatttctcacgtcctaagaacctgatcagaaattttggaagggttctttgaaatagcagcagttgaaacagagacactttgccacagtgtggagcagattttctcactggtatcacatggtcttgcagttttgaactcttcgaccgatttgtgggagtttatgtaattgcgtgcaatgaacctgaaattgtgtaaaggacaaaagaccagtttatagggttgggttttttttccaacttgtgaaaagcagtttagctgcatctgtctccccaccacccccaccccgggaggggcttatgttacaaggtgatcaagtgaaggaaaaacctgagcctatctggctgggatggtggaattaagcacaaggtcacattctctgtgatcacatgagagggaaggtgatgacttaaatggcagggggtggggattatcttggggagaggctgaaaagcacaaaagatagtcttccctgtacgtattggtgaagaacgtgcacaaggctggatggacttcaacttggagttgagttgaggcaagaggatttctggatattagtcacccatctgcaagaaaaatgctgaggcctcgggtcaagattttgatctgagacatgctgatgcttcaaggagaaatattttcacaatcctctcttccctcaccagaagagaacagtactctctcctagaaacctctaggtaaacacattttatcctaatatcggtagcatataatgccccccccaaaatatctgttttccatgcaaaaaagtctcaacaagaagtctgtggagttgagtggttacttcaaagtgtcaggagagtgaagaaattggccacagaagagcaagaagctctcttaagaaaagggaattctctttaaagaaaccaccaccaacaacaaaacaaccaaaaaccatgttttatgtcaaagctctgtagcacagagaatgtggtgtcacagatacatcgccgagagaggtttctttctttcttttttttttttttgagacagagtctggttctgtttcccaggctggagtgcagtggtgggatctcagctcactgcaacatccgcctctggggttcaagtgattctcctgtctcagcctcccaagtagctggaattacagggacccgccaccacgcccggctaatttttttgtgtggttttagtagaggtggggtttcaccatcttggccaggctggtcttgaactcctgacctcgtgatccacccgcctaggcctcccaaagtgttgggattacaggcgtgagccactgtgcccagccaaaagagaaatttctacatgaacaaggcaatttcagtgtcttacagcggccaaaccatgacgtgaagaatgagataggagacaggagatcaccataagcgtccctgatatagcagcacacattttcacgtttccacttaaatcgttttgcacaaagtcttgcttcgctcagatgagatgagatatgatttcctagagatgtaaaaataagaatgaatgtggcgcccccttcttccagatgtaatagaaagctctgccctatcacaaggggggtgttgaagcgccccttgtgttttaactgtatttaactgagcacaagatgcacaagctgtggtgggaaaccctcagtttacctttggagtcttccctgcagatcgcagacctgtttccaggctgatgtttctggtgtgtaattgctagcgtttctgaagggttttcccaattgttttagccttgtgaagtattcttaattataacttgcctttcagcgatggtacatgacttgattcaacgtttggttctgaacttacacactgatgcgtttactcatctaacataatctgacagggcctcagcaagggagccatacatttttgtaacattttgatatgttttaatgcatctgacttagatcttactgaaataaagcacttttcaaagaga

SEQ ID NO: 3558 - DNA, 2518 bp, Homo sapiens
ctgaagcctggggtcagcaggcgctgcgggcgcagctccggtgcaagcgaggacacgacacatgcagtggcttctggactgcgcgatgactggacgcaagtaacttctaggtctgcagacaagaggaagagaagatgaaggaagactgtctgccgagttctcacgtgcccatcagtgacagcaagtccattcagaagagggatgtgcaaggcctgagtgaagaagggactctgatcatcgaggggctcctcaacattgcctgggggctgaggcggcccatccggctgcagatgcaggatgaccgggagcaggtgcacctcccctccacctcatggatgcccagacggcctagctgccctctgggctgctggtctcttctccttggcctgagctccctttctctgccggcagccatctcagccctgcagttgtctgttttcagaaaggagccatcgccccagaacgggaacatcacagcccaggggccaagcattcagccagtgcacaaggctgagagttccacagacagctcggggcccctggaggaggcagaggaggccccccagctgatgcggaccaagagcgacgccagttgcatgagccagaggaggcccaagtgccgcgcccccggtgaggcccagcgcatccggcgacaccggttctctatcaacggccacttctacaatcataagacctccgtgtttactccagcctatggatccgtgaccaatgtgagggtcaacagcaccatgacaaccctgcaggtgctcaccctgctgctgaacaaatttagggtggaagatggccccagtgagttcgcactctacatcgttcacgagtctggggagcggacaaaattaaaagactgcgagtacccgctgatttccagaatcctgcatgggccatgtgagaagatcgccaggatcttcctgatggaagctgacttgggcgtggaagtcccccatgaagtcgctcagtacattaagtttgaaatgccggtgctggacagttttgttgaaaaattaaaagaagaggaagaaagagaaataatcaaactgaccatgaagttccaagccctgcgtctgacgatgctgcagcgcctggagcagctggtggaggccaagtaactggccaacacctgcctcttccaaagtccccagcagtggcaggtgtacactgagccctggttgctggccccggccggtcacattgactgatggccaccgcctgacgaatcgagtgcctgtgtgtctacctctctgaagcctgagcaccatgattcccacagccagctcttggctccaagatgagcacccacaggaagccgacccaggcctgaggggccaggaacttgctgggtcagatctgtgtggccagccctgtccacaccatgcctctcctgcactggagagcagtgctggcccagcccctgcggcttaggcttcatctgcttgcacattgcctgtcccagagcccctgtgggtccacaagcccctgtcctcttccttcatatgagattcttgtctgccctcatatcacgctgccccacaggaatgctgctgggaaaagcagggcctgccagcaggtatgagatctagcctgctttcagccatcaccttgccacagtgtccccggcttctaagcctccaatatcaccctgtgagcctcgcacagctcagccccaacacagaggtgagaccaggaataaggccacaagtatctcactttctctgcagaaatcaatctttacttcatcagagagacctaaagcgattcttacaaggagcttgctgcaagaaacacggtcattcaatcacattgaggagggtccacatggcattgagagggtgctgcccgctcaatgcccagcagcagctctggaaggcagtgctcagccccatcaccactgtcccgtggatgcctgtgtacctcttgccttttctgggcttgcgtttctctcctctagtgggtggggatgactttcaatgactttcaatacttcccctgaaggaagaatgataaggagaaatgtctgttttgaggaaagggctttgaattccccagatactgaacaatttgtgtttgtgactgatggagaatttcaggaatgaatgagaaagcctttgcgaaactatgcaacagtttacatcagtcatgtgaagtatttgtctaaaacagagcaaactgaagaccaaattattctcctgttgaggtccgtggatggcagatttaaagggaagaaccacaaaggcttgcaaagataggagaggctccatctctaatgcatgtagaagctccttacgggtgcccatcaagagcatagcttggaagccaccatgctgtgcggaactgcgtcagggcaaatgtcacagcaggatttccccaacccagctccatcatcacagacacagagagctgcaggggaggcctgcccactgttttgtcgactctgccctcctctggcagcatagatccttaggtgctcaataaaggtgtgctgtattgaactgaagaagtg

SEQ ID NO: 3559 - DNA, 2474 bp, Homo sapiens
cgctgcgggcgcagctccggtgcaagcgaggacacgacacatgcagtggcttctggactgcgcgatgactggacgcaagtaacttctaggtctgcagacaagaggaagagaagatgaaggaagactgtctgccgagttctcacgtgcccatcagtgacagcaagtccattcagaagtcggagctcttaggcctgctgaaaacctacaactgctaccatgagggcaagagcttccagctgagacaccgtgaggaagaagggactctgatcatcgaggggctcctcaacattgcctgggggctgaggcggcccatccggctgcagatgcaggatgaccgggagcaggtgcacctcccctccacctcatggatgcccagacggcctagctgccctctaaaggagccatcgccccagaacgggaacatcacagcccaggggccaagcattcagccagtgcacaaggctgagagttccacagacagctcggggcccctggaggaggcagaggaggccccccagctgatgcggaccaagagcgacgccagttgcatgagccagaggaggcccaagtgccgcgcccccggtgaggcccagcgcatccggcgacaccggttctctatcaacggccacttctacaatcataagacctccgtgtttactccagcctatggatccgtgaccaatgtgagggtcaacagcaccatgacaaccctgcaggtgctcaccctgctgctgaacaaatttagggtggaagatggccccagtgagttcgcactctacatcgttcacgagtctggggagcggacaaaattaaaagactgcgagtacccgctgatttccagaatcctgcatgggccatgtgagaagatcgccaggatcttcctgatggaagctgacttgggcgtggaagtcccccatgaagtcgctcagtacattaagtttgaaatgccggtgctggacagttttgttgaaaaattaaaagaagaggaagaaagagaaataatcaaactgaccatgaagttccaagccctgcgtctgacgatgctgcagcgcctggagcagctggtggaggccaagtaactggccaacacctgcctcttccaaagtccccagcagtggcaggtgtacactgagccctggttgctggccccggccggtcacattgactgatggccaccgcctgacgaatcgagtgcctgtgtgtctacctctctgaagcctgagcaccatgattcccacagccagctcttggctccaagatgagcacccacaggaagccgacccaggcctgaggggccaggaacttgctgggtcagatctgtgtggccagccctgtccacaccatgcctctcctgcactggagagcagtgctggcccagcccctgcggcttaggcttcatctgcttgcacattgcctgtcccagagcccctgtgggtccacaagcccctgtcctcttccttcatatgagattcttgtctgccctcatatcacgctgccccacaggaatgctgctgggaaaagcagggcctgccagcaggtatgagatctagcctgctttcagccatcaccttgccacagtgtccccggcttctaagcctccaatatcaccctgtgagcctcgcacagctcagccccaacacagaggtgagaccaggaataaggccacaagtatctcactttctctgcagaaatcaatctttacttcatcagagagacctaaagcgattcttacaaggagcttgctgcaagaaacacggtcattcaatcacattgaggagggtccacatggcattgagagggtgctgcccgctcaatgcccagcagcagctctggaaggcagtgctcagccccatcaccactgtcccgtggatgcctgtgtacctcttgccttttctgggcttgcgtttctctcctctagtgggtggggatgactttcaatgactttcaatacttcccctgaaggaagaatgataaggagaaatgtctgttttgaggaaagggctttgaattccccagatactgaacaatttgtgtttgtgactgatggagaatttcaggaatgaatgagaaagcctttgcgaaactatgcaacagtttacatcagtcatgtgaagtatttgtctaaaacagagcaaactgaagaccaaattattctcctgttgaggtccgtggatggcagatttaaagggaagaaccacaaaggcttgcaaagataggagaggctccatctctaatgcatgtagaagctccttacgggtgcccatcaagagcatagcttggaagccaccatgctgtgcggaactgcgtcagggcaaatgtcacagcaggatttccccaacccagctccatcatcacagacacagagagctgcaggggaggcctgcccactgttttgtcgactctgccctcctctggcagcatagatccttaggtgctcaataaaggtgtgctgtattgaactgaagaagtgagaa

SEQ ID NO: 3560 - DNA, 2630 bp, Homo sapiens
ggaagcaacgcaggtggagggcagggaggctgccagggccttacctgtgatagtgaaagtgtcggcaccctggacatcctggaccagacgcaggcctgtcccgtgagtctcgcctcctcctcagcccgacccccatgccccccaccagggccatgtgcagaaccatccgggtgcattgcgatggcagtctggtctcctctggttatgcctggccggcgagaagggtgctgtcacactcctgttacaaatgaggaaacagaggccagggaagccaaaggccagaagctgaggccctgccacaccctaggagtacatgtgtgtctttccctttttaggtcggagctcttaggcctgctgaaaacctacaactgctaccatgagggcaagagcttccagctgagacaccgtgaggaagaagggactctgatcatcgaggggctcctcaacattgcctgggggctgaggcggcccatccggctgcagatgcaggatgaccgggagcaggtgcacctcccctccacctcatggatgcccagacggcctagctgccctctaaaggagccatcgccccagaacgggaacatcacagcccaggggccaagcattcagccagtgcacaaggctgagagttccacagacagctcggggcccctggaggaggcagaggaggccccccagctgatgcggaccaagagcgacgccagttgcatgagccagaggaggcccaagtgccgcgcccccggtgaggcccagcgcatccggcgacaccggttctctatcaacggccacttctacaatcataagacctccgtgtttactccagcctatggatccgtgaccaatgtgagggtcaacagcaccatgacaaccctgcaggtgctcaccctgctgctgaacaaatttagggtggaagatggccccagtgagttcgcactctacatcgttcacgagtctggggagcggacaaaattaaaagactgcgagtacccgctgatttccagaatcctgcatgggccatgtgagaagatcgccaggatcttcctgatggaagctgacttgggcgtggaagtcccccatgaagtcgctcagtacattaagtttgaaatgccggtgctggacagttttgttgaaaaattaaaagaagaggaagaaagagaaataatcaaactgaccatgaagttccaagccctgcgtctgacgatgctgcagcgcctggagcagctggtggaggccaagtaactggccaacacctgcctcttccaaagtccccagcagtggcaggtgtacactgagccctggttgctggccccggccggtcacattgactgatggccaccgcctgacgaatcgagtgcctgtgtgtctacctctctgaagcctgagcaccatgattcccacagccagctcttggctccaagatgagcacccacaggaagccgacccaggcctgaggggccaggaacttgctgggtcagatctgtgtggccagccctgtccacaccatgcctctcctgcactggagagcagtgctggcccagcccctgcggcttaggcttcatctgcttgcacattgcctgtcccagagcccctgtgggtccacaagcccctgtcctcttccttcatatgagattcttgtctgccctcatatcacgctgccccacaggaatgctgctgggaaaagcagggcctgccagcaggtatgagatctagcctgctttcagccatcaccttgccacagtgtccccggcttctaagcctccaatatcaccctgtgagcctcgcacagctcagccccaacacagaggtgagaccaggaataaggccacaagtatctcactttctctgcagaaatcaatctttacttcatcagagagacctaaagcgattcttacaaggagcttgctgcaagaaacacggtcattcaatcacattgaggagggtccacatggcattgagagggtgctgcccgctcaatgcccagcagcagctctggaaggcagtgctcagccccatcaccactgtcccgtggatgcctgtgtacctcttgccttttctgggcttgcgtttctctcctctagtgggtggggatgactttcaatgactttcaatacttcccctgaaggaagaatgataaggagaaatgtctgttttgaggaaagggctttgaattccccagatactgaacaatttgtgtttgtgactgatggagaatttcaggaatgaatgagaaagcctttgcgaaactatgcaacagtttacatcagtcatgtgaagtatttgtctaaaacagagcaaactgaagaccaaattattctcctgttgaggtccgtggatggcagatttaaagggaagaaccacaaaggcttgcaaagataggagaggctccatctctaatgcatgtagaagctccttacgggtgcccatcaagagcatagcttggaagccaccatgctgtgcggaactgcgtcagggcaaatgtcacagcaggatttccccaacccagctccatcatcacagacacagagagctgcaggggaggcctgcccactgttttgtcgactctgccctcctctggcagcatagatccttaggtgctcaataaaggtgtgctgtattgaactgaagaagtg

SEQ ID NO: 3561 - DNA, 527 bp, Homo sapiens
ctgaagcctggggtcagcaggcgctgcgggcgcagctccggtgcaagcgaggacacgacacatgcagtggcttctggactgcgcgatgactggacgcaagtaacttctaggtctgcagacaagaggaagagaagatgaaggaagactgtctgccgagttctcacgtgcccatcagtgacagcaagtccattcagaagtcggagctcttaggcctgctgaaaacctacaactgctaccatgagggcaagagcttccagctgagacaccgtgaggaagaagggactctgatcatcgaggggctcctcaacattgcctgggggctgaggcggcccatccggctgcagatgcaggatgaccgggagcaggtgcacctcccctccacctcatggatgcccagacggcctagctgccctctccaccttgctggcaagaagggacgactacagccaggggggctcccaacacctatgcaagccgaacatgtctcgccatctcttgttctatctttaaaattcacacgaatttag

SEQ ID NO: 3562 - DNA, 2399 bp, Homo sapiens
ctgaagcctggggtcagcaggcgctgcgggcgcagctccggtgcaagcgaggacacgacacatgcagtggcttctggactgcgcgatgactggacgcaagtaacttctaggtctgcagacaagaggaagagaagatgaaggaagactgtctgccgagttctcacgtgcccatcagtgacagcaagtccattcagaagtcggagctcttaggcctgctgaaaacctacaactgctaccatgagggcaagagcttccagctgagacaccgtgaggaagaagggactctgatcatcgaggggctcctcaacattgcctgggggctgaggcggcccatccggctgcagatgcaggatgaccgggagcaggtgcacctcccctccacctcatggatgcccagacggcctagctgccctctggcccctggaggaggcagaggaggccccccagctgatgcggaccaagagcgacgccagttgcatgagccagaggaggcccaagtgccgcgcccccggtgaggcccagcgcatccggcgacaccggttctctatcaacggccacttctacaatcataagacctccgtgtttactccagcctatggatccgtgaccaatgtgagggtcaacagcaccatgacaaccctgcaggtgctcaccctgctgctgaacaaatttagggtggaagatggccccagtgagttcgcactctacatcgttcacgagtctggggagcggacaaaattaaaagactgcgagtacccgctgatttccagaatcctgcatgggccatgtgagaagatcgccaggatcttcctgatggaagctgacttgggcgtggaagtcccccatgaagtcgctcagtacattaagtttgaaatgccggtgctggacagttttgttgaaaaattaaaagaagaggaagaaagagaaataatcaaactgaccatgaagttccaagccctgcgtctgacgatgctgcagcgcctggagcagctggtggaggccaagtaactggccaacacctgcctcttccaaagtccccagcagtggcaggtgtacactgagccctggttgctggccccggccggtcacattgactgatggccaccgcctgacgaatcgagtgcctgtgtgtctacctctctgaagcctgagcaccatgattcccacagccagctcttggctccaagatgagcacccacaggaagccgacccaggcctgaggggccaggaacttgctgggtcagatctgtgtggccagccctgtccacaccatgcctctcctgcactggagagcagtgctggcccagcccctgcggcttaggcttcatctgcttgcacattgcctgtcccagagcccctgtgggtccacaagcccctgtcctcttccttcatatgagattcttgtctgccctcatatcacgctgccccacaggaatgctgctgggaaaagcagggcctgccagcaggtatgagatctagcctgctttcagccatcaccttgccacagtgtccccggcttctaagcctccaatatcaccctgtgagcctcgcacagctcagccccaacacagaggtgagaccaggaataaggccacaagtatctcactttctctgcagaaatcaatctttacttcatcagagagacctaaagcgattcttacaaggagcttgctgcaagaaacacggtcattcaatcacattgaggagggtccacatggcattgagagggtgctgcccgctcaatgcccagcagcagctctggaaggcagtgctcagccccatcaccactgtcccgtggatgcctgtgtacctcttgccttttctgggcttgcgtttctctcctctagtgggtggggatgactttcaatgactttcaatacttcccctgaaggaagaatgataaggagaaatgtctgttttgaggaaagggctttgaattccccagatactgaacaatttgtgtttgtgactgatggagaatttcaggaatgaatgagaaagcctttgcgaaactatgcaacagtttacatcagtcatgtgaagtatttgtctaaaacagagcaaactgaagaccaaattattctcctgttgaggtccgtggatggcagatttaaagggaagaaccacaaaggcttgcaaagataggagaggctccatctctaatgcatgtagaagctccttacgggtgcccatcaagagcatagcttggaagccaccatgctgtgcggaactgcgtcagggcaaatgtcacagcaggatttccccaacccagctccatcatcacagacacagagagctgcaggggaggcctgcccactgttttgtcgactctgccctcctctggcagcatagatccttaggtgctcaataaaggtgtgctgtattgaactgaagaagtg

SEQ ID NO: 3563 - DNA, 528 bp, Homo sapiens
catgcagtggcttctggactgcgcgatgactggacgcaagtaacttctaggtctgcagacaagaggaagagaagatgaaggaagactgtctgccgagttctcacgtgcccatcagtgacagcaagtccattcagaagtcggagctcttaggcctgctgaaaacctacaactgctaccatgagggcaagagcttccagctgagacaccgtgaggaagaagggactctgatcatcgaggggctcctcaacattgcctgggggctgaggcggcccatccggctgcagatgcaggatgaccgggagcaggtgcacctcccctccacctcatggatgcccagacggcctagctgccctctgggctgctggtctcttctccttggcctgagctccctttctctgccggcagccatctcagccctgcagttgtctgttttcagaaaggagccatcgccccagaacgggaacatcacagcccaggggccaagcattcagccagtgcacaaggctgagagttccacagacagctcgg

SEQ ID NO: 3564 - DNA, 435 bp, Homo sapiens
agttctcacgtgcccatcagtgacagcaagtccattcagaagtcggagctcttaggcctgctgaaaacctacaactgctaccatgagggcaagagcttccagctgagacaccgtgaggaagaagggactctgatcatcgaggggctcctcaacattgcctgggggctgaggcggcccatccggctgcagatgcaggatgaccgggagcaggtgcacctcccctccacctcatggatgcccagacggcctagctgccctctccaccttgctggcaagaagggacgactacagccaggggggctcccaacacctatgcaagccgaacatgtctcgccatctcttgttctatctttaaaattcacacgaatttagcctcttactactctgttttcattttaatgtcaaaattttaaaaataaatttatcagaatttca

SEQ ID NO: 3565 - DNA, 3496 bp, Homo sapiens
gaactgctttacgcgaggggcaggaaaggcgcgggaggcgggggaggtgcggagatggcgctctgcacggcggcggagggagggcgctggcgccggggacacgaaaccgcagagcccggacgagtcagggagtgaggcgcgagccgggcgcccggggctctgcaggcgcaggcggcgcggggacaggagcaggttaccgggccgcccgagcgctcgcaccccgctgaaagaaacgcaggcggcccgccggctctgcctggtccgctacccgaccagctcccggctcggggctcagagctaggggcttacgccaagcggagcccggggaggggtgcccacctccctccgccgcatcccaagcccggcccccttgatgcgctggcggcctcggccgggaactccggggtagatgaccgtggacagcagcatgagcagtgggtactgcagcctggacgaggaactggaagactgcttcttcactgctaagactacctttttcagaaatgcgcagagcaaacatctttcaaagaatgtctgtaaacctgtggaggagacacagcgcccgcccacactgcaggagatcaagcagaagatcgacagctacaacacgcgagagaagaactgcctgggcatgaaactgagtgaagacggcacctacacgggtttcatcaaagtgcatctgaaactccggcggcctgtgacggtgcctgctgggatccggccccagtccatctatgatgccatcaaggaggtgaacctggcggctaccacggacaagcggacatccttctacctgcccctagatgccatcaagcagctgcacatcagcagcaccaccaccgtcagtgaggtcatccaggggctgctcaagaagttcatggttgtggacaatccccagaagtttgcactttttaagcggatacacaaggacggacaagtgctcttccagaaactctccattgctgaccgccccctctacctgcgcctgcttgctgggcctgacacggaggtcctcagctttgtgctaaaggagaatgaaactggagaggtagagtgggatgccttctccatccctgaacttcagaacttcctaacaatcctggaaaaagaggagcaggacaaaatccaacaagtgcaaaagaagtatgacaagtttaggcagaaactggaggaggccttaagagaatcccagggcaaacctgggtaaccggtcctgcttcctctcctcctggtgcattcagatttatttgtattattaattattattttgcaacagacactttttctcaggacatctctggcaggtgcatttgtgcctgcccagcagttccagctgtggcaaaagtctcttccatggacaagtgtttgcatgggggttcagctgtgcccgcccccaggctgtgccccaccacagattctgccaaggatcagaactcatgtgaaacaaacagctgacgtcctctctcgatctgcaagcctttcaccaaccaaatagttgcctctctcgtcaccaaactggaacctcacaccagccggcaaaggaaggaagaaaggttttagagctgtgtgttctttctctggctttgattcttctttgagttctcttacttgccacgtacaggaccattatttatgagtgaaaagttgtagcacattccttttgcaggtctgagctaagcccctgaaagcagggtaatgctcataaaaggactgttcccgcggccccaaggtgcctgttgttcacacttaagggaagtttataaagctactggccccagatgctcagggtaaggagcaccaaagctgaggctggctcagagatctccagagaagctgcagcctgccctggccctggctctggccctggcccacattgcacatggaaacccaaaggcatatatctgcgtatgtgtggtacttagtcacatctttgtcaacaaactgttcgtttttaagttacaaatttgaatttaatgttgtcatcatcgtcatgtgtttccccaaagggaagccagtcattgaccatttaaaaagtctcctgctaagtatggaaatcagacagtaagagaaagccaaaaagcaatgcagagaaaggtgtccaagctgtcttcagccttccccagctaaagagcagaggagggcctgggctacttgggttccccatcggcctccagcactgcctccctcctcccactgcgactctgggatctccaggtgctgcccaaggagttgccttgattacagagaggggagcctccaattcggccaacttggagtcctttctgttttgaagcatgggccagacccggcactgcgctcggagagccggtgggcctggcctccccgtcgacctcagtgcctttttgttttcagagagaaataggagtagggcgagtttgcctgaagctctgctgctggcttctcctgccaggaagtgaacaatggcggcggtgtgggagacaaggccaggagagcccgcgttcagtatgggttgagggtcacagacctccctcccatctgggtgcctgagttttgactccaatcagtgataccagaccacattgacagggaggatcaaattcctgacttacatttgcactggcttcttgtttaggctgaatcctaaaataaattagtcaaaaaattccaacaagtagccaggactgcagagacactccagtgcagagggagaaggacttgtaattttcaaagcagggctggttttccaacccagcctctgagaaaccatttctttgctatcctctgccttcccaagtccctcttgggtcggttcaagcccaagcttgttcgtgtagcttcagaagttccctctctgacccaggctgagtccatactgcccctgatcccagaaggaatgctgacccctcgtcgtatgaactgtgcatagtctccagagcttcaaaggcaacacaagctcgcaactctaagatttttttaaaccacaaaaaccctggttagccatctcatgctcagccttatcacttccctccctttagaaactctctccctgctgtatattaaagggagcaggtggagagtcattttccttcgtcctgcatgtctctaacattaatagaaggcatggctcctgctgcaaccgctgtgaatgctgctgagaacctccctctatggggatggctattttatttttgagaaggaaaaaaaaagtcatgtatatatacacataaaggcatatagctatatataaagagataagggtgtttatgaaatgagaaaattattggacaattcagactttactaaagcacagttagacccaaggcctatgctgaggtctaaacctctgaaaaaagtatagtatcgagtacccgttccctcccagaggtgggagtaactgctggtagtgccttctttggttgtgttgctcagtgtgtaagtgtttgtttccaggatattttctttttaaatgtctttcttatatgggttttaaaaaaaagtaataaaagcctgttgc

SEQ ID NO: 3566 - DNA, 3481 bp, Homo sapiens
cgggagtagcgcagtcgccaaagccgccgctgccaaagctgccgccactagccgggcatggccatggcgtccccggccatcgggcagcgcccgtacccgctactattggaccccgagccgccgcgctatctacagagcctgagcggccccgagctaccgccgccgccccccgaccggtcctcgcgcctctgtgtcccggcgcccctctccactgcgcccggggcgcgcgaggggcgcagcgcccggagggctgcccgggggaacctggagcccccgccccgggcctcccgacccgctcgcccgctccggcctggtctgcagcagagactgcggcggcggcctggagcgccccgaccccgcgacgtgcggagcatcttcgagcagccgcaggatcccagagtcccggcggagcgaggcgaggggcactgcttcgccgagttggtgctgccgggcggccccggctggtgtgacctgtgcggacgagaggtgctgcggcaggcgctgcgctgcactaactgtaaattcacctgtcacccagaatgccgcagcctgatccagttggactgcagtcagcaggagggtttatcccgggacagaccctctccagaaagcaccctcaccgtgaccttcagccagaatgtctgtaaacctgtggaggagacacagcgcccgcccacactgcaggagatcaagcagaagatcgacagctacaacacgcgagagaagaactgcctgggcatgaaactgagtgaagacggcacctacacgggtttcatcaaagtgcatctgaaactccggcggcctgtgacggtgcctgctgggatccggccccagtccatctatgatgccatcaaggaggtgaacctggcggctaccacggacaagcggacatccttctacctgcccctagatgccatcaagcagctgcacatcagcagcaccaccaccgtcagtgaggtcatccaggggctgctcaagaagttcatggttgtggacaatccccagaagtttgcactttttaagcggatacacaaggacggacaagtgctcttccagaaactctccattgctgaccgccccctctacctgcgcctgcttgctgggcctgacacggaggtcctcagctttgtgctaaaggagaatgaaactggagaggtagagtgggatgccttctccatccctgaacttcagaacttcctctcctcctggtgcattcagatttatttgtattattaattattattttgcaacagacactttttctcaggacatctctggcaggtgcatttgtgcctgcccagcagttccagctgtggcaaaagtctcttccatggacaagtgtttgcatgggggttcagctgtgcccgcccccaggctgtgccccaccacagattctgccaaggatcagaactcatgtgaaacaaacagctgacgtcctctctcgatctgcaagcctttcaccaaccaaatagttgcctctctcgtcaccaaactggaacctcacaccagccggcaaaggaaggaagaaaggttttagagctgtgtgttctttctctggctttgattcttctttgagttctcttacttgccacgtacaggaccattatttatgagtgaaaagttgtagcacattccttttgcaggtctgagctaagcccctgaaagcagggtaatgctcataaaaggactgttcccgcggccccaaggtgcctgttgttcacacttaagggaagtttataaagctactggccccagatgctcagggtaaggagcaccaaagctgaggctggctcagagatctccagagaagctgcagcctgccctggccctggctctggccctggcccacattgcacatggaaacccaaaggcatatatctgcgtatgtgtggtacttagtcacatctttgtcaacaaactgttcgtttttaagttacaaatttgaatttaatgttgtcatcatcgtcatgtgtttccccaaagggaagccagtcattgaccatttaaaaagtctcctgctaagtatggaaatcagacagtaagagaaagccaaaaagcaatgcagagaaaggtgtccaagctgtcttcagccttccccagctaaagagcagaggagggcctgggctacttgggttccccatcggcctccagcactgcctccctcctcccactgcgactctgggatctccaggtgctgcccaaggagttgccttgattacagagaggggagcctccaattcggccaacttggagtcctttctgttttgaagcatgggccagacccggcactgcgctcggagagccggtgggcctggcctccccgtcgacctcagtgcctttttgttttcagagagaaataggagtagggcgagtttgcctgaagctctgctgctggcttctcctgccaggaagtgaacaatggcggcggtgtgggagacaaggccaggagagcccgcgttcagtatgggttgagggtcacagacctccctcccatctgggtgcctgagttttgactccaatcagtgataccagaccacattgacagggaggatcaaattcctgacttacatttgcactggcttcttgtttaggctgaatcctaaaataaattagtcaaaaaattccaacaagtagccaggactgcagagacactccagtgcagagggagaaggacttgtaattttcaaagcagggctggttttccaacccagcctctgagaaaccatttctttgctatcctctgccttcccaagtccctcttgggtcggttcaagcccaagcttgttcgtgtagcttcagaagttccctctctgacccaggctgagtccatactgcccctgatcccagaaggaatgctgacccctcgtcgtatgaactgtgcatagtctccagagcttcaaaggcaacacaagctcgcaactctaagatttttttaaaccacaaaaaccctggttagccatctcatgctcagccttatcacttccctccctttagaaactctctccctgctgtatattaaagggagcaggtggagagtcattttccttcgtcctgcatgtctctaacattaatagaaggcatggctcctgctgcaaccgctgtgaatgctgctgagaacctccctctatggggatggctattttatttttgagaaggaaaaaaaaagtcatgtatatatacacataaaggcatatagctatatataaagagataagggtgtttatgaaatgagaaaattattggacaattcagactttactaaagcacagttagacccaaggcctatgctgaggtctaaacctctgaaaaaagtatagtatcgagtacccgttccctcccagaggtgggagtaactgctggtagtgccttctttggttgtgttgctcagtgtgtaagtgtttgtttccaggatattttctttttaaatgtctttcttatatgggttttaaaaaaaagtaataaaagcctgttgcaaaaatga

SEQ ID NO: 3567 - DNA, 2048 bp, Homo sapiens
cgggagtagcgcagtcgccaaagccgccgctgccaaagctgccgccactagccgggcatggccatggcgtccccggccatcgggcagcgcccgtacccgctactattggaccccgagccgccgcgctatctacagagcctgagcggccccgagctaccgccgccgccccccgaccggtcctcgcgcctctgtgtcccggcgcccctctccactgcgcccggggcgcgcgaggggcgcagcgcccggagggctgcccgggggaacctggagcccccgccccgggcctcccgacccgctcgcccgctccggcctggtctgcagcagagactgcggcggcggcctggagcgccccgaccccgcgacgtgcggagcatcttcgagcagccgcaggatcccagagtcccggcggagcgaggcgaggggcactgcttcgccgagttggtgctgccgggcggccccggctggtgtgacctgtgcggacgagaggtgctgcggcaggcgctgcgctgcactaactgtaaattcacctgtcacccagaatgccgcagcctgatccagttggactgcagtcagcaggagggtttatcccgggacagaccctctccagaaagcaccctcaccgtgaccttcagccagaatgtctgtaaacctgtggaggagacacagcgcccgcccacactgcaggagatcaagcagaagatcgacagctacaacacgcgagagaagaactgcctgggcatgaaactgagtgaagacggcacctacacgggtttcatcaaagtgcatctgaaactccggcggcctgtgacggtgcctgctgggatccggccccagtccatctatgatgccatcaaggaggtgaacctggcggctaccacggacaagcggacatccttctacctgcccctagatgccatcaagcagctgcacatcagcagcaccaccaccgtcagtgaggtcatccaggggctgctcaagaagttcatggttgtggacaatccccagaagtttgcactttttaagcggatacacaaggacggacaagtgctcttccagaaactctccattgctgaccgccccctctacctgcgcctgcttgctgggcctgacacggaggtcctcagctttgtgctaaaggagaatgaaactggagaggtagagtgggatgccttctccatccctgaacttcagaacttcctaacaatcctggaaaaagaggagcaggacaaaatccaacaagtgcaaaagaagtatgacaagtttaggcagaaactggaggaggccttaagagaatcccagggcaaacctgggtaaccggtcctgcttcctctcctcctggtgcattcagatttatttgtattattaattattattttgcaacagacactttttctcaggacatctctggcaggtgcatttgtgcctgcccagcagttccagctgtggcaaaagtctcttccatggacaagtgtttgcatgggggttcagctgtgcccgcccccaggctgtgccccaccacagattctgccaaggatcagaactcatgtgaaacaaacagctgacgtcctctctcgatctgcaagcctttcaccaaccaaatagttgcctctctcgtcaccaaactggaacctcacaccagccggcaaaggaaggaagaaaggttttagagctgtgtgttctttctctggctttgattcttctttgagttctcttacttgccacgtacaggaccattatttatgagtgaaaagttgtagcacattccttttgcaggtctgagctaagcccctgaaagcagggtaatgctcataaaaggactgttcccgcggccccaaggtgcctgttgttcacacttaagggaagtttataaagctactggccccagatgctcagggtaaggagcaccaaagctgaggctggctcagagatctccagagaagctgcagcctgccctggccctggctctggccctggcccacattgcacatggaaacccaaaggcatatatctgcgtatgtgtggtacttagtcacatctttgtcaacaaa

SEQ ID NO: 3568 - DNA, 1932 bp, Homo sapiens
cgggagtagcgcagtcgccaaagccgccgctgccaaagctgccgccactagccgggcatggccatggcgtccccggccatcgggcagcgcccgtacccgctactattggaccccgagccgccgcgctatctacagagcctgagcggccccgagctaccgccgccgccccccgaccggtcctcgcgcctctgtgtcccggcgcccctctccactgcgcccggggcgcgcgaggggcgcagcgcccggagggctgcccgggggaacctggagcccccgccccgggcctcccgacccgctcgcccgctccggcctggtctgcagcagagactgcggcggcggcctggagcgccccgaccccgcgacgtgcggagcatcttcgagcagccgcaggatcccagagtcccggcggagcgaggcgaggggcactgcttcgccgagttggtgctgccgggcggccccggctggtgtgacctgtgcggacgagaggtgctgcggcaggcgctgcgctgcactaactgtaaattcacctgtcacccagaatgccgcagcctgatccagttggactgcagtcagcaggagggtttatcccgggacagaccctctccagaaagcaccctcaccgtgaccttcagccagaatgtctgtaaacctgtggaggagacacagcgcccgcccacactgcaggagatcaagcagaagatcgacagctacaacacgcgagagaagaactgcctgggcatgaaactgagtgaagacggcacctacacgggtttcatcaaagtgcatctgaaactccggcggcctgtgacggtgcctgctgggatccggccccagtccatctatgatgccatcaaggaggtgaacctggcggctaccacggacaagcggacatccttctacctgcccctagatgccatcaagcagctgcacatcagcagcaccaccaccgtcagtgaggtcatccaggggctgctcaagaagttcatggttgtggacaatccccagaagtttgcactttttaagcggatacacaaggacggacaagtgggatgccttctccatccctgaacttcagaacttcctaacaatcctggaaaaagaggagcaggacaaaatccaacaagtgcaaaagaagtatgacaagtttaggcagaaactggaggaggccttaagagaatcccagggcaaacctgggtaaccggtcctgcttcctctcctcctggtgcattcagatttatttgtattattaattattattttgcaacagacactttttctcaggacatctctggcaggtgcatttgtgcctgcccagcagttccagctgtggcaaaagtctcttccatggacaagtgtttgcatgggggttcagctgtgcccgcccccaggctgtgccccaccacagattctgccaaggatcagaactcatgtgaaacaaacagctgacgtcctctctcgatctgcaagcctttcaccaaccaaatagttgcctctctcgtcaccaaactggaacctcacaccagccggcaaaggaaggaagaaaggttttagagctgtgtgttctttctctggctttgattcttctttgagttctcttacttgccacgtacaggaccattatttatgagtgaaaagttgtagcacattccttttgcaggtctgagctaagcccctgaaagcagggtaatgctcataaaaggactgttcccgcggccccaaggtgcctgttgttcacacttaagggaagtttataaagctactggccccagatgctcagggtaaggagcaccaaagctgaggctggctcagagatctccagagaagctgcagcctgccctggccctggctctggccctggcccacattgcacatggaaacccaaaggcatatatctgcgtatgtgtggtacttagtcacatctttgtcaacaaa

SEQ ID NO: 3569 - DNA, 1239 bp, Homo sapiens
cgggagtagcgcagtcgccaaagccgccgctgccaaagctgccgccactagccgggcatggccatggcgtccccggccatcgggcagcgcccgtacccgctactattggaccccgagccgccgcgctatctacagagcctgagcggccccgagctaccgccgccgccccccgaccggtcctcgcgcctctgtgtcccggcgcccctctccactgcgcccggggcgcgcgaggggcgcagcgcccggagggctgcccgggggaacctggagcccccgccccgggcctcccgacccgctcgcccgctccggcctggtctgcagcagagactgcggcggcggcctggagcgccccgaccccgcgacgtgcggagcatcttcgagcagccgcaggatcccagagtcccggcggagcgaggcgaggggcactgcttcgccgagttggtgctgccgggcggccccggctggtgtgacctgtgcggacgagaggtgctgcggcaggcgctgcgctgcactaactgtaaattcacctgtcacccagaatgccgcagcctgatccagttggactgcagtcagcaggagggtttatcccgggacagaccctctccagaaagcaccctcaccgtgaccttcagccagaatgtctgtaaacctgtggaggagacacagcgcccgcccacactgcaggagatcaagcagaagatcgacagctacaacacgcgagagaagaactgcctgggcatgaaactgagtgaagacggcacctacacgggtttcatcaaagtgcatctgaaactccggcggcctgtgacggtgcctgctgggatccggccccagtccatctatgatgccatcaaggaggtgaacctggcggctaccacggacaagcggacatccttctacctgcccctagatgccatcaagcagctgcacatcagcagcaccaccaccgtcagtgaggtcatccaggggctgctcaagaagttcatggttgtggacaatccccagaagtttgcactttttaagcggatacacaaggacggacaagtgctcttccagaaactctccattgctgaccgccccctctacctgcgcctgcttgctgggcctgacacggaggtcctcagctttgtgctaaaggagaatgaaactggagaggtagagtgggatgccttctccatccctgaacttcagaacttcttcctctcctcctggtgcattcagatttatttgtattattaa

SEQ ID NO: 3570 - DNA, 2075 bp, Homo sapiens
ggcgtaattaaaaagcggcggaagaaggtgggagggtcatgacgcagcgagtttcagtcgtgacttttctgggggcatcgcggcgtcccctttttttgcctttaaagtaaaacgtcgccccgacgcaccccccgcgtatttcggggggcggaggcggcgggccacggcgcgaagaggggcggtgctgacgccggccggtcacgtgggcgtgttgtgggggggaggggcgccgccgcgcggtcggttccgggcggttgggagcgcgcgagctagcgagcgagaggcagccgcgcccgccgccgcccctgctctgtatgccgctctctcccggcgcggccgccgccgatcacagcagcaggagccaccgccgccgcggttgatgtggttgggccggggctgaggaggccgccaagatgccgcagtccaagtcccggaagatcgcgatcctgggctaccggtctgtggggaaatcctcattgacgattcaatttgttgaaggccaatttgtggactcctacgatccaaccatagaaaacacttttacaaagttgatcacagtaaatggacaagaatatcatcttcaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttgggaataagaaagacctgcatatggaaagggtgatcagttatgaagaagggaaagctttggcagaatcttggaatgcagcttttttggaatcttctgctaaagaaaatcagactgctgtggatgtttttcgaaggataattttggaggcagaaaaaatggacggggcagcttcacaaggcaagtcttcatgctcggtgatgtgattctgctgcaaagcctgaggacactgggaatatattctacctgaagaagcaaactgcccgttctccttgaagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgaccaagaattttatcggcattaatttttcagtgtagtttgttgtttaaaataatgtaatcatcaaaatgatgcatattgttacactactattaactaggcttcagtatatcagtgtttatttcattgtgttaaatgtatacttgtaaataaaatagctgcaaacctcagtcctttgtgctacttgatgtggctttcaaagaagagaagccttgtcctgagtttctcacttggcttcaggaaggccccaggttggattccagaaaccagtgaagatgtggccacaggaggaggtgtgctgaggtggctgctgaccgtggactccctgcgcagtggcctgcagatgttggggctgggttacagctgattgaagctgagtggccctggggggtctgtgaggggagttcctccccagtgatgaaattctctccttccaccctcaaatccctagaccttgactgaaatgctccgtggtcgggagcctggtcaaggaggaggagctgctgagaggcattgttcgcccttgctcatagcttagctcgatgtccgtgtcagacaggagatgattgagaacagccttgcctgtcactgtcctagaacaccctggagtttagtgttctgtgtcagagtcttgggagcctccttcagacccagatgacgggcctccctctgtccaaggagcagctgtaaaggagaagagggatttcatttgtttggtggctgttaccttgtctgtaagtcaaacttggagttgagcagtgctttttaaacgattcccttttgcagctaaaatttcacagggctatttctaatacgtaagcaaatgttaccattgactttattaataaaatatagttttgctttgca

SEQ ID NO: 3571 - DNA, 2031 bp, Homo sapiens
aatagcaaccaggtcttttatagccccggagttcccgtgatgccccacgcggctgcaatgattggttaagggttttgcttttagggcgtggacgggctcctgagcaatagtggatgagctgtgagtgcgcgcgcgtgcgcggggccgcgacctgtgccggctcgagcccgctgggcactcggaggcgcgcacgtcgttccccgccctcccgccgccgcccgccctcgctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcatctggctctaattcacagtgctcttttctcctcactgtatccaggttccctcccagaggagccaccagttctcatgggtggcactcagtctctcttctctccagctgactaaactttttttctgtaccagttaatttttccaactactaatagaataaaggcagttttctaaa

SEQ ID NO: 3572 - DNA, 2366 bp, Homo sapiens
atctgccaccgcagtctggttggagctgttgtcttgtatgctcagcgaggcccggagagacccgggagagagctaggccgagtccaccgcccgagtctgctgcccgagcccgcgttacgcacaaagccgccgatccccggcctggggtgagcagagcgaccaccgcccgggagcagcgcggcgagacgcacggtgcgccctatgcccccgcgcccccaccgcccccgccgcggcagccgaagcgcagcgagagaacgcgccaccgcggggcccgggtgcagctagcgaccctctcgccacctgcgcgcagcccgaggtgagcagtgagcggcgagcgggagggcagcgaggcgttcgcgggccccctcctgctgcccgggcccggcccgctcatggcggccatccgcaagaagctggtggtggtgggcgacggcgcgtgtggcaagacgtgcctgctgatcgtgttcagtaaggacgagttccccgaggtgtacgtgcccaccgtcttcgagaactatgtggccgacattgaggtggacggcaagcaggtggagctggcgctgtgggacacggcgggccaggaggactacgaccgcctgcggccgctctcctacccggacaccgacgtcattctcatgtgcttctcggtggacagcccggactcgctggagaacatccccgagaagtgggtccccgaggtgaagcacttctgtcccaatgtgcccatcatcctggtggccaacaaaaaagacctgcgcagcgacgagcatgtccgcacagagctggcccgcatgaagcaggaacccgtgcgcacggatgacggccgcgccatggccgtgcgcatccaagcctacgactacctcgagtgctctgccaagaccaaggaaggcgtgcgcgaggtcttcgagacggccacgcgcgccgcgctgcagaagcgctacggctcccagaacggctgcatcaactgctgcaaggtgctatgagggccgcgcccgtcgcgcctgcccctgccggcacggctccccctcctggaccagtcccccgcgagcccggagaaggggagacccgtgtcccacaaggaccccaccggcctgcctggcatctgtctgctgacgcctctggcttgcgccaggacttggcgtgggcaccgggcgcccccatcccagtgtctgtgtgcgtccagctgtgttgcacaggcctgggctccccactgagtgccaagggtcccctgagcatgcttttctgaagagccgggcctcagagtgtgtggctgtgtgtctgttcgactcccctcgccccattttcaccccacccccgcctctgatccccgggggcgagattggcgcgggagtgtggccgcgccccatcagatgttcgcccttcaccagcgggagcttgatatcccttgtctgtaacatagaccccgggtactgcgggaggggagggctgctggggaggatggggggatgttatataaatatagatataattttattttcggagctaagatggtgttatttaagggtggtgatgggtgagcgctctggcccaggctgggccagactcccgcccaagcatgaacaggacttgaccatctttccaacccctggggaagacatttgcaactgacttggggaggacacagcttcagcacagcctctcctgcgggccagcccgctgcgaaccctccaccagctaccggagggaggagggaggatgcgctgtggggttgtttttgccataagcgaactttgtgcctgtcctagaagtgaaaattgttcagtccaagaaactgatgttatttgatttatttaaaggctaaaatttgtttttttattctttgcacaattgtttcattgtttgacacttaatgcactcgtcatttgcatacgacagtagcattctgaccacacttgtacgctgtaacctcatctacttctgatgtttttaaaaaatgacttttaacaaggagagggaaaagaaacccactaaattttgctttgtttccttgaagaatgtggcaacactgttttgtgattttatttgtgcaggtcatgcacacagttttgataaagggcagtaacaagtattggggcctattttttttttttccacaaggcattctctaaagctatgtgaaattttctctgcacctctgtacagagaatacacctgcccctgtatatccttttttcccctcccctccctcccagtggtacttctactaaattgttgtcttgttttttattttttaaataaactgacaaatgacaaaatggtgagcttatgatgtttacataaaagttctataagctgtgtatacagttttttatgtaaaatattaaaagactatgatgatgacattt

SEQ ID NO: 3573 - DNA, 2199 bp, Homo sapiens
agtctgagcctccggcaccggccgcgcagctggaggcggcggagcggaaggtgtagggtgggccggcaaagtcaaccggccgctctggatcatctgggaattcaagagagcgattggagagaggtctgatgtagccacactgtcttgtcttggggaaggccccagaagttccaggctccattccaggccctgtgtggggctcagttgcccctcttaaggggtcagtgggacagtccctctggggctgcctctcacagggagttgtccatgccatcttggccttgggcctagtgtcctggcctgggctgcctgctgttctggcccaatcatagcctggagggaaagtcttctaattgggctggaggctccaggtcccttaacgcatgcctcaaccccgggtttctgtcctctgcctcccaccactctggtgccgtctgaattaccctgctggggggacagcagtggcatactcatgcctaagtgactggctttcaccccagtagtgattgccctccatcaacactgcccaccccaggttggggctaccccagcccatctttacaaaacagggcaaggtgaactaatggagtgggtggaggagttggaagaaatcccagcgtcagtcaccgggatagaattcccaaggaaccctctttttggaggatggtttccatttctggaggcgatctgccgacagggtgaatgccttcttgcttgtcttctggggaatcagagagagtccgttttgtggtgggaagagtgtggctgtgtactttgaactcctgtaaattctctgactcatgtccacaaaaccaacagttttgtgaatgtgtctggaggcaagggaagggccactcaggatctatgttgaagggaagaggcctggggctggagtattcgcttcctaaagggcagtgtgaggtggtggtggggtgtggggagtagaggcgttcagtcagcccagtttgacaggatgtgggactgagagaaaaagctaggtttgaggctgagatcaggttaccgtcgctttcttaactgctccctgcctggttggtgctgggactggccctcatttgtctcttcttttggggctcctcccagcccagactctagccccctcccccttcccaacagccttgacttcatctcagctccagagcccgccctctcttcctgcagcctgggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgagatccccaaggcctttcctacatgccccctcccttcacaggggtacagaaattatccccctacaaccccagcctcctgagggctccatgctgaaggctcccattttcagttccctcctgcccaggactgcattgttttctagccccgaggtggtggcacgggccctccctcccagcgctctgggagccacgcctatgccctgcccttcctcagggcccctggggatcttgccccctttgaccttccccaaaggatggtcacacaccagcactttatacacttctggctcacaggaaagtgtctgcagtaggggacccagagtcccaggcccctggagttgttttcggcaggggccttgtctctcactgcatttggtcaggggggcatgaataaaggctacaggctcc

SEQ ID NO: 3574 - DNA, 1418 bp, Homo sapiens
attgaaggctgggcagagtctgagtccacccgggtcgtgctccccccgctcgcccggctcctccgcagtccaggaatctccccgtggctctccccgacctggaggggtggacgcccctggcccccagtccccggcctgcggagggggccggtggctgcggccctgcgcggggccggggcgggccgagccaagggccgcccccggccgaccctccccctgccgggcccgccctccccgccgcggcgctggaggagggcggggcggggccctggggtcagtctgagcctccggcaccggccgcgcagctggaggcggcggagcggaagccttgacttcatctcagctccagagcccgccctctcttcctgcagcctgggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgagatccccaaggcctttcctacatgccccctcccttcacaggggtacagaaattatccccctacaaccccagcctcctgagggctccatgctgaaggctcccattttcagttccctcctgcccaggactgcattgttttctagccccgaggtggtggcacgggccctccctcccagcgctctgggagccacgcctatgccctgcccttcctcagggcccctggggatcttgccccctttgaccttccccaaaggatggtcacacaccagcactttatacacttctggctcacaggaaagtgtctgcagtaggggacccagagtcccaggcccctggagttgttttcggcaggggccttgtctctcactgcatttggtcaggggggcatgaataaaggctacaggctccaacgtgtgtggcagctttcggtctttc

SEQ ID NO: 3575 - DNA, 1026 bp, Homo sapiens
aggtaccctgggccggggctgcgggcggtggggcgtcttgggaactcgtccccaggagagcactttcccttcctcgctggcccggagatcggggcccgtgcgaggaggggcttcggcctgggcgtggaccccgttccctccaagcggagtcggcatccgggctgggcggtggtcggaccgcgtcggcccctccccgggctgcagcgagggggcccggacctgccggcaggggctctggcctcctgaggtccgagtcggagccccttcccttctcctcccagcttcccggaacctgccccgccgggcgaggggcgagggaacttcaactcagacgccccagcccccaggccttgacttcatctcagctccagagcccgccctctcttcctgcagcctgggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgagatccccaaggcctttccta

SEQ ID NO: 3576 - DNA, 1295 bp, Homo sapiens
ggcggtggggcgtcttgggaactcgtccccaggagagcactttcccttcctcgctggcccggagatcggggcccgtgcgaggaggggcttcggcctgggcgtggaccccgttccctccaagcggagtcggcatccgggctgggcggtggtcggaccgcgtcggcccctccccgggctgcagcgagggggcccggacctgccggcaggggctctggcctcctgagccttgacttcatctcagctccagagcccgccctctcttcctgcagcctgggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgagatccccaaggcctttcctacatgccccctcccttcacaggggtacagaaattatccccctacaaccccagcctcctgagggctccatgctgaaggctcccattttcagttccctcctgcccaggactgcattgttttctagccccgaggtggtggcacgggccctccctcccagcgctctgggagccacgcctatgccctgcccttcctcagggcccctggggatcttgccccctttgaccttccccaaaggatggtcacacaccagcactttatacacttctggctcacaggaaagtgtctgcagtaggggacccagagtcccaggcccctggagttgttttcggcaggggccttgtctctcactgcatttggtcaggggggcatgaataaaggctacaggctccaacgtg

SEQ ID NO: 3577 - DNA, 786 bp, Homo sapiens
gcctccggcaccggccgcgcagctggaggcggcggagcggaagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgagatccccaaggcctttcctacatgccccctcccttcacaggggtacagaaattatccccctacaaccccagcctcctgagggctccatgctgaaggctcccattttcagttccctcctgcccaggactgcattgttttctagccccgaggtggtggcacgggccctccctcccagcgctctgggagccacgcctatgccctgcccttcctcaggg

SEQ ID NO: 3578 - DNA, 888 bp, Homo sapiens
tctgagcctccggcaccggccgcgcagctggaggcggcggagcggaagcctgggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgagatccccaaggcctttcctacatgccccctcccttcacaggggtacagaaattatccccctacaaccccagcctcctgagggctccatgctgaaggctcccattttcagttccctcctgcccaggactgcattgttttctagccccgaggtggtggcacgggccctccctcccagcgctctgggagccacgcctatgccctgcccttcctcagggcccctggggatc

SEQ ID NO: 3579 - DNA, 1028 bp, Homo sapiens
ctggggtcagtctgagcctccggcaccggccgcgcagctggaggcggcggagcggaagccttgacttcatctcagctccagagcccgccctctcttcctgcagcctgggaacttcagccggctggaggtcagttcccctccccagggaaggaggaagtgagggaagctgcgaagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgagatccccaaggcctttcctacatgccccctcccttcacaggggtacagaaattatccccctacaaccccagcctcctgagggctccatgctgaaggctcccattttcagttccctcctgcccaggactgcattgttttctagccccgaggtggtggcacgggccctccctcccagcgctctgggagccacgcctatgccctgcccttcctcagggcccctggggatcttgccccctttgaccttccccaaaggatggtcacacac

SEQ ID NO: 3580 - DNA, 1355 bp, Homo sapiens
aactttcccgacgccggtcctcccctaggggattgaaggctgggcagagtctgagtccacccgggtcgtgctccccccgctcgcccggctcctccgcagtccaggaatctccccgtggctctccccgacctggaggggtggacgcccctggcccccagtccccggcctgcggagggggccggtggctgcggccctgcgcggggccggggcgggccgagccaagggccgcccccggccgaccctccccctgccgggcccgccctccccgccgcggcgctggaggagggcggggcggggccctggggtcagtctgagcctccggcaccggccgcgcagctggaggcggcggagcggaagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgagatccccaaggcctttcctacatgccccctcccttcacaggggtacagaaattatccccctacaaccccagcctcctgagggctccatgctgaaggctcccattttcagttccctcctgcccaggactgcattgttttctagccccgaggtggtggcacgggccctccctcccagcgctctgggagccacgcctatgccctgcccttcctcagggcccctggggatcttgccccctttgaccttccccaaaggatggtcacacaccagcactttatacacttctggctcacaggaaagtgtctgcagtaggggacccagagtcccaggcccctggagttgttttcggcaggggccttgtctctcactgcatttggtcaggggggcatgaataaaggctacaggctccaa

SEQ ID NO: 3581 - DNA, 470 bp, Homo sapiens
aggaaggggctgttccagagtgggtggaggcatctgggtaccgaaggagataattcctgccaaaatgcccgacagagtgcctggcacctaggggctctataactattcttcctttacccacctaccacctggtagctggttctgctactctggtcctagagagggactcctcatttgtgactggacagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcct

SEQ ID NO: 3582 - DNA, 866 bp, Homo sapiens
ggcggtggggcgtcttgggaactcgtccccaggagagcactttcccttcctcgctggcccggagatcggggcccgtgcgaggaggggcttcggcctgggcgtggaccccgttccctccaagcggagtcggcatccgggctgggcggtggtcggaccgcgtcggcccctccccgggctgcagcgagggggcccggacctgccggcaggggctctggcctcctgagccttgacttcatctcagctccagagcccgccctctcttcctgcagcctgggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggagggg

SEQ ID NO: 3583 - DNA, 517 bp, Homo sapiens
gcagctggaggcggcggagcggaagcccagactctagccccctcccccttcccaacagccttgacttcatctcagctccagagcccgccctctcttcctgcagcctgggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccag

SEQ ID NO: 3584 - DNA, 820 bp, Homo sapiens
ccggcaccggccgcgcagctggaggcggcggagcggaagggcaaggtgaactaatggagtgggtggaggagttggaagaaatcccagcgtcagtcaccgggatagaattcccaaggaaccctctttttggaggatggtttccatttctggaggcgatctgccgacaggccttgacttcatctcagctccagagcccgccctctcttcctgcagcctgggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccatt

SEQ ID NO: 3585 - DNA, 574 bp, Homo sapiens
aagcccgggaagctgactccttgccctgagtcacagggaggggtgggcagggcatgcggccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggagg

SEQ ID NO: 3586 - DNA, 3752 bp, Homo sapiens
ctgagagctccaggtagtgagcagttcagtcgatttcctcgttaccccgcccccctttctcttgcccccccacccctctcatctgcctggtggaggatgaagcggctgcagtggccccagcctcagcagcggcaccggcggtggctgcggtgtgggtggccggaactggggtggtgaagaagcggtggtggcggctgaaggagcggtagcagcctcagcctctttccctgtgcttcctttcctctttagtgcagcgaggaagttttcgcttctgtacatgtgtttgtgtgcgtgagtgtgggtgtgtgcggtgaggtttgggtggcgtttgtgcaggcgttgggttttttgcccacttggcttcccgtaacccaggcagctggggagcctgggctgtggccctaggagggggcgcggcggcgggctctctccttttgttgttgtttcctcagcctggggagctgaaggggagacgcgtctgggtggggctgctcggagcccgggcctggtggcccctggggctcccgggcgggcagggtagggcagagtagagcgggcttcaacatgatggcggccgaggccggcagtgaggagggcggcccggtaacagccggagctggaggaggcggcgcggcagcgggctccagtgcctatcccgcagtgtgtcgggtgaagatacccgcggccctgcctgtggcagccgccccctatcctgggctggtggagaccggagtggctggaactctgggtggcggagccgctttggggtcagagttcctaggagccgggtctgtggcaggggcactggggggagctggactgacagggggaggtactgctgctggcgtagctggtgctgctgctggcgtggccggtgctgctgttgctggacctagtggagacatggctctcaccaaactgcccacttcgttgcttgctgagactctcgggccaggcggcggttttccccctctgccccctcccccttacctgccccctttgggggcgggcctcgggacagtggacgaaggtgactctctggatggaccagaatacgaggaggaagaggtggccataccgttgaccgctcctccaactaaccagtggtatcacggaaaacttgacagaacgatagcagaagaacgcctcaggcaggcagggaagtctggcagttatcttataagagagagtgatcggaggccagggtcctttgtactttcatttcttagccagatgaatgttgtcaaccattttaggattattgctatgtgtggagattactacattggtggaagacgtttttcttcactgtcagacctaataggttattacagtcatgtttcttgtttgcttaaaggagaaaaattactttacccagttgcaccaccagagccagtagaagatagaaggcgtgtacgagctattctaccttacacaaaagtaccagacactgatgaaataagtttcttaaaaggagatatgttcattgttcataatgaattagaagatggatggatgtgggttacaaatttaagaacagatgaacaaggccttattgttgaagacctagtagaagaggtgggccgggaagaagatccacatgaaggaaaaatatggttccatgggaagatttccaaacaggaagcttataatttactaatgacagttggtcaagtctgcagttttcttgtgaggccctcagataatactcctggcgattattcactttatttccggaccaatgaaaatattcagcgatttaaaatatgtccaacgccaaacaatcagtttatgatgggaggccggtattataacagcattggggacatcatagatcactatcgaaaagaacagattgttgaaggatattatcttaaggaacctgtaccaatgcaggatcaagaacaagtactcaatgacacagtggatggcaaggaaatctataataccatccgtcgtaaaacaaaggatgccttttataaaaacattgttaagaaaggttatcttctgaaaaagggcaaaggaaaacgttggaaaaatttatattttatcttagagggtagtgatgcccaacttatttattttgaaagcgaaaaacgagctaccaaaccaaaaggattaatagatctcagtgtatgttctgtctatgtcgttcatgatagtctctttggcaggccaaactgttttcagatagtagttcagcactttagtgaagaacattacatcttttactttgcaggagaaactccagaacaagcagaggattggatgaaaggtctgcaggcattttgcaatttacggaaaagtagtccagggacatccaataaacgccttcgtcaggtcagcagccttgttttacatattgaagaagcccataaactcccagtaaaacattttactaatccatattgtaacatctacctgaatagtgtccaagtagcaaaaactcatgcaagggaagggcaaaacccagtatggtcagaagagtttgtctttgatgatcttcctcctgacatcaatagatttgaaataactcttagtaataaaacaaagaaaagcaaagatcctgatatcttatttatgcgctgccagttgagccgattacagaaagggcatgccacagatgaatggtttctgctcagctcccatataccattaaaaggtattgaaccagggtccctgcgtgttcgagcacgatactctatggaaaaaatcatgccagaagaagagtacagtgaatttaaagagcttatactgcaaaaggaacttcatgtagtctatgctttatcacatgtatgtggacaagaccgaacactactggccagcatcctactgaggatttttcttcacgaaaagcttgaatcgttgttgttatgcacactaaatgacagagaaataagcatggaagatgaagccactaccctatttcgagccacaacacttgcaagcaccttgatggagcagtatatgaaagccactgctacacagtttgttcatcatgctttgaaagactctattttaaagataatggaaagcaagcagtcttgtgagttaagtccatcaaagttagaaaaaaatgaagatgtgaacactaatttaacacacctattgaacatactttcagagcttgtggagaaaatattcatggcttcagaaatacttccaccgacattgagatatatttatgggtgtttacagaaatctgttcagcataagtggcctacaaataccaccatgagaacaagagttgttagtggttttgtttttcttcgactcatctgtcctgccatcctgaatccacggatgttcaatatcatctcagattctccatctcctattgctgcaagaacactgatattagtggctaaatctgtgcagaacttagcaaatcttgtggaatttggagctaaggagccctacatggaaggtgtcaatccattcatcaaaagcaacaaacatcgtatgatcatgtttttagatgaacttgggaatgtacctgaacttccggacactacagagcattctagaacggacctgtcccgtgatttagcagcattgcatgagatttgcgtggctcattcagatgaacttcgaacgctcagtaatgagcgtggtgcacagcagcacgtattgaaaaagcttctggctataacagaactgcttcaacaaaaacaaaaccagtatacaaaaaccaatgatgtcaggtagcagccttcgccccagtgttctgcatggattcagcatgtccaaca

SEQ ID NO: 3587 - DNA, 3776 bp, Homo sapiens
gaccagaatacgaggaggaagaggtggccataccgttgaccgctcctccaactaaccagtaagttaagactgctgttcaggaatttgggaagctggctccagaaaagaagtggaaatgaaggggtggtatcacggaaaacttgacagaacgatagcagaagaacgcctcaggcaggcagggaagtctggcagttatcttataagagagagtgatcggaggccagggtcctttgtactttcatttcttagccagatgaatgttgtcaaccattttaggattattgctatgtgtggagattactacattggtggaagacgtttttcttcactgtcagacctaataggttattacagtcatgtttcttgtttgcttaaaggagaaaaattactttacccagttgcaccaccagagccagtagaagatagaaggcgtgtacgagctattctaccttacacaaaagtaccagacactgatgaaataagtttcttaaaaggagatatgttcattgttcataatgaattagaagatggatggatgtgggttacaaatttaagaacagatgaacaaggccttattgttgaagacctagtagaagaggtgggccgggaagaagatccacatgaaggaaaaatatggttccatgggaagatttccaaacaggaagcttataatttactaatgacagttggtcaagtctgcagttttcttgtgaggccctcagataatactcctggcgattattcactttatttccggaccaatgaaaatattcagcgatttaaaatatgtccaacgccaaacaatcagtttatgatgggaggccggtattataacagcattggggacatcatagatcactatcgaaaagaacagattgttgaaggatattatcttaaggaacctgtaccaatgcaggatcaagaacaagtactcaatgacacagtggatggcaaggaaatctataataccatccgtcgtaaaacaaaggatgccttttataaaaacattgttaagaaaggttatcttctgaaaaagggcaaaggaaaacgttggaaaaatttatattttatcttagagggtagtgatgcccaacttatttattttgaaagcgaaaaacgagctaccaaaccaaaaggattaatagatctcagtgtatgttctgtctatgtcgttcatgatagtctctttggcaggccaaactgttttcagatagtagttcagcactttagtgaagaacattacatcttttactttgcaggagaaactccagaacaagcagaggattggatgaaaggtctgcaggcattttgcaatttacggaaaagtagtccagggacatccaataaacgccttcgtcaggtcagcagccttgttttacatattgaagaagcccataaactcccagtaaaacattttactaatccatattgtaacatctacctgaatagtgtccaagtagcaaaaactcatgcaagggaagggcaaaacccagtatggtcagaagagtttgtctttgatgatcttcctcctgacatcaatagatttgaaataactcttagtaataaaacaaagaaaagcaaagatcctgatatcttatttatgcgctgccagttgagccgattacagaaagggcatgccacagatgaatggtttctgctcagctcccatataccattaaaaggtattgaaccagggtccctgcgtgttcgagcacgatactctatggaaaaaatcatgccagaagaagagtacagtgaatttaaagagcttatactgcaaaaggaacttcatgtagtctatgctttatcacatgtatgtggacaagaccgaacactactggccagcatcctactgaggatttttcttcacgaaaagcttgaatcgttgttgttatgcacactaaatgacagagaaataagcatggaagatgaagccactaccctatttcgagccacaacacttgcaagcaccttgatggagcagtatatgaaagccactgctacacagtttgttcatcatgctttgaaagactctattttaaagataatggaaagcaagcagtcttgtgagttaagtccatcaaagttagaaaaaaatgaagatgtgaacactaatttaacacacctattgaacatactttcagagcttgtggagaaaatattcatggcttcagaaatacttccaccgacattgagatatatttatgggtgtttacagaaatctgttcagcataagtggcctacaaataccaccatgagaacaagagttgttagtggttttgtttttcttcgactcatctgtcctgccatcctgaatccacggatgttcaatatcatctcagattctccatctcctattgctgcaagaacactgatattagtggctaaatctgtgcagaacttagcaaatcttgtggaatttggagctaaggagccctacatggaaggtgtcaatccattcatcaaaagcaacaaacatcgtatgatcatgtttttagatgaacttgggaatgtacctgaacttccggacactacagagcattctagaacggacctgtcccgtgatttagcagcattgcatgagatttgcgtggctcattcagatgaacttcgaacgctcagtaatgagcgtggtgcacagcagcacgtattgaaaaagcttctggctataacagaactgcttcaacaaaaacaaaaccagtatacaaaaaccaatgatgtcaggtagcagccttcgccccagtgttctgcatggattcagcatgtccaacatggtaattcacttcagtttaatgtctcctttgctcttgccaaaaaatagcacacttttccacattccagtgatgtgtgagctatgcaaacaaaatccaagattctgctggtgaataactatgccagcaaccttgtaagctatctgtgcaggatatttgcactatttccacatggaatcaatctttaacaacctctgagccttggtgtacagaccacctttcacaaaacgaaatgctatgactgtatcttgatatctcgaactttcaaaatatattttcagtacacccagttgccaaagttttgctgtctcttagagaaagaactatgaaatcaactgacaagaaacacattcttattgacaattgtgtataactggattgcagactgttcttactgtaactacttcctgattaggaatatgaccatttgactgttcaatgattatttgtatttacagtttccagagtttgtcattataataggaacaatctttgctgtatacttttaaaaaatactctgctatttctcttgctggaactgttgaaagaaaatatatagaatgatctattgctcatcagctttattttttaaacatacgacttattttgttgaaattgtcaaagactgtatttagatctcataatgctttgttaaatgtttacaagtaaatagtttgaattcagtaaatattattggttgttgtattgatcaatgcatgttacccattcaaccattttatagactaccaatttcttttatgttaactagaatgcttttgttaaaagttatttgttcattatttgtgctacccctttgattatgcagacaacctcatcagctgcctaacttatccatctttgaacttctgactacttgttgtatctgctggatatttagttcaactgtatagttttatttacttctgtatgtgtatttttgtgaagtattcacaaaggttaagttaaaataaaaccaagggatatcttgcataattgattacttct

SEQ ID NO: 3588 - DNA, 3009 bp, Homo sapiens
gaggaggaagaggtggccataccgttgaccgctcctccaactaaccagtaagttaagactgctgttcaggaatttgggaagctggctccagaaaagaagtggaaatgaaggggttccatgtgccttgtgaagtcatggttcctcagtataagatcgaggtggtatcacggaaaacttgacagaacgatagcagaagaacgcctcaggcaggcagggaagtctggcagttatcttataagagagagtgatcggaggccagggtcctttgtactttcatttcttagccagatgaatgttgtcaaccattttaggattattgctatgtgtggagattactacattggtggaagacgtttttcttcactgtcagacctaataggttattacagtcatgtttcttgtttgcttaaaggagaaaaattactttacccagttgcaccaccagagccagtagaagatagaaggcgtgtacgagctattctaccttacacaaaagtaccagacactgatgaaataagtttcttaaaaggagatatgttcattgttcataatgaattagaagatggatggatgtgggttacaaatttaagaacagatgaacaaggccttattgttgaagacctagtagaagaggtgggccgggaagaagatccacatgaaggaaaaatatggttccatgggaagatttccaaacaggaagcttataatttactaatgacagttggtcaagtctgcagttttcttgtgaggccctcagataatactcctggcgattattcactttatttccggaccaatgaaaatattcagcgatttaaaatatgtccaacgccaaacaatcagtttatgatgggaggccggtattataacagcattggggacatcatagatcactatcgaaaagaacagattgttgaaggatattatcttaaggaacctgtaccaatgcaggatcaagaacaagtactcaatgacacagtggatggcaaggaaatctataataccatccgtcgtaaaacaaaggatgccttttataaaaacattgttaagaaaggttatcttctgaaaaagggcaaaggaaaacgttggaaaaatttatattttatcttagagggtagtgatgcccaacttatttattttgaaagcgaaaaacgagctaccaaaccaaaaggattaatagatctcagtgtatgttctgtctatgtcgttcatgatagtctctttggcaggccaaactgttttcagatagtagttcagcactttagtgaagaacattacatcttttactttgcaggagaaactccagaacaagcagaggattggatgaaaggtctgcaggcattttgcaatttacggaaaagtagtccagggacatccaataaacgccttcgtcaggtcagcagccttgttttacatattgaagaagcccataaactcccagtaaaacattttactaatccatattgtaacatctacctgaatagtgtccaagtagcaaaaactcatgcaagggaagggcaaaacccagtatggtcagaagagtttgtctttgatgatcttcctcctgacatcaatagatttgaaataactcttagtaataaaacaaagaaaagcaaagatcctgatatcttatttatgcgctgccagttgagccgattacagaaagggcatgccacagatgaatggtttctgctcagctcccatataccattaaaaggtattgaaccagggtccctgcgtgttcgagcacgatactctatggaaaaaatcatgccagaagaagagtacagtgaatttaaagagcttatactgcaaaaggaacttcatgtagtctatgctttatcacatgtatgtggacaagaccgaacactactggccagcatcctactgaggatttttcttcacgaaaagcttgaatcgttgttgttatgcacactaaatgacagagaaataagcatggaagatgaagccactaccctatttcgagccacaacacttgcaagcaccttgatggagcagtatatgaaagccactgctacacagtttgttcatcatgctttgaaagactctattttaaagataatggaaagcaagcagtcttgtgagttaagtccatcaaagttagaaaaaaatgaagatgtgaacactaatttaacacacctattgaacatactttcagagcttgtggagaaaatattcatggcttcagaaatacttccaccgacattgagatatatttatgggtgtttacagaaatctgttcagcataagtggcctacaaataccaccatgagaacaagagttgttagtggttttgtttttcttcgactcatctgtcctgccatcctgaatccacggatgttcaatatcatctcagattctccatctcctattgctgcaagaacactgatattagtggctaaatctgtgcagaacttagcaaatcttgtggaatttggagctaaggagccctacatggaaggtgtcaatccattcatcaaaagcaacaaacatcgtatgatcatgtttttagatgaacttgggaatgtacctgaacttccggacactacagagcattctagaacggacctgtcccgtgatttagcagcattgcatgagatttgcgtggctcattcagatgaacttcgaacgctcagtaatgagcgtggtgcacagcagcacgtattgaaaaagcttctggctataacagaactgcttcaacaaaaacaaaaccagtatacaaaaaccaatgatgtcaggtagcagccttcgccccagtgttctgcatggattcagcatgtccaacatggtaattcacttcagtttaatgtctcctttgctcttgccaaaaaatagcacacttttccacattccagtgatgtgtgagctatgcaaacaaaatccaagattctgctggtgaataactatgccagcaaccttgtaagctatctgtgcaggatatttgcactatttccacatggaatcaatctttaacaacctctgagcctt

SEQ ID NO: 3589 - DNA, 3060 bp, Homo sapiens
gaggaggaagaggtggccataccgttgaccgctcctccaactaaccagtaagttaagactgctgttcaggaatttgggaagctggctccagaaaagaagtggaaatgaaggggcatactacctggcgtcttcctacatttattgctcctctgggaaagtgtaaagtctttaagatggaaagcatgagaaaatgtgtatctaatgagaaccggatatagttctgtcccttccaagttgaggtggtatcacggaaaacttgacagaacgatagcagaagaacgcctcaggcaggcagggaagtctggcagttatcttataagagagagtgatcggaggccagggtcctttgtactttcatttcttagccagatgaatgttgtcaaccattttaggattattgctatgtgtggagattactacattggtggaagacgtttttcttcactgtcagacctaataggttattacagtcatgtttcttgtttgcttaaaggagaaaaattactttacccagttgcaccaccagagccagtagaagatagaaggcgtgtacgagctattctaccttacacaaaagtaccagacactgatgaaataagtttcttaaaaggagatatgttcattgttcataatgaattagaagatggatggatgtgggttacaaatttaagaacagatgaacaaggccttattgttgaagacctagtagaagaggtgggccgggaagaagatccacatgaaggaaaaatatggttccatgggaagatttccaaacaggaagcttataatttactaatgacagttggtcaagtctgcagttttcttgtgaggccctcagataatactcctggcgattattcactttatttccggaccaatgaaaatattcagcgatttaaaatatgtccaacgccaaacaatcagtttatgatgggaggccggtattataacagcattggggacatcatagatcactatcgaaaagaacagattgttgaaggatattatcttaaggaacctgtaccaatgcaggatcaagaacaagtactcaatgacacagtggatggcaaggaaatctataataccatccgtcgtaaaacaaaggatgccttttataaaaacattgttaagaaaggttatcttctgaaaaagggcaaaggaaaacgttggaaaaatttatattttatcttagagggtagtgatgcccaacttatttattttgaaagcgaaaaacgagctaccaaaccaaaaggattaatagatctcagtgtatgttctgtctatgtcgttcatgatagtctctttggcaggccaaactgttttcagatagtagttcagcactttagtgaagaacattacatcttttactttgcaggagaaactccagaacaagcagaggattggatgaaaggtctgcaggcattttgcaatttacggaaaagtagtccagggacatccaataaacgccttcgtcaggtcagcagccttgttttacatattgaagaagcccataaactcccagtaaaacattttactaatccatattgtaacatctacctgaatagtgtccaagtagcaaaaactcatgcaagggaagggcaaaacccagtatggtcagaagagtttgtctttgatgatcttcctcctgacatcaatagatttgaaataactcttagtaataaaacaaagaaaagcaaagatcctgatatcttatttatgcgctgccagttgagccgattacagaaagggcatgccacagatgaatggtttctgctcagctcccatataccattaaaaggtattgaaccagggtccctgcgtgttcgagcacgatactctatggaaaaaatcatgccagaagaagagtacagtgaatttaaagagcttatactgcaaaaggaacttcatgtagtctatgctttatcacatgtatgtggacaagaccgaacactactggccagcatcctactgaggatttttcttcacgaaaagcttgaatcgttgttgttatgcacactaaatgacagagaaataagcatggaagatgaagccactaccctatttcgagccacaacacttgcaagcaccttgatggagcagtatatgaaagccactgctacacagtttgttcatcatgctttgaaagactctattttaaagataatggaaagcaagcagtcttgtgagttaagtccatcaaagttagaaaaaaatgaagatgtgaacactaatttaacacacctattgaacatactttcagagcttgtggagaaaatattcatggcttcagaaatacttccaccgacattgagatatatttatgggtgtttacagaaatctgttcagcataagtggcctacaaataccaccatgagaacaagagttgttagtggttttgtttttcttcgactcatctgtcctgccatcctgaatccacggatgttcaatatcatctcagattctccatctcctattgctgcaagaacactgatattagtggctaaatctgtgcagaacttagcaaatcttgtggaatttggagctaaggagccctacatggaaggtgtcaatccattcatcaaaagcaacaaacatcgtatgatcatgtttttagatgaacttgggaatgtacctgaacttccggacactacagagcattctagaacggacctgtcccgtgatttagcagcattgcatgagatttgcgtggctcattcagatgaacttcgaacgctcagtaatgagcgtggtgcacagcagcacgtattgaaaaagcttctggctataacagaactgcttcaacaaaaacaaaaccagtatacaaaaaccaatgatgtcaggtagcagccttcgccccagtgttctgcatggattcagcatgtccaacatggtaattcacttcagtttaatgtctcctttgctcttgccaaaaaatagcacacttttccacattccagtgatgtgtgagctatgcaaacaaaatccaagattctgctggtgaataactatgccagcaaccttgtaagctatctgtgcaggatatttgcactatttccacat

SEQ ID NO: 3590 - DNA, 2701 bp, Homo sapiens
agctggggagcctgggctgtggccctaggagggggcgcggcggcgggctctctccttttgttgttgtttcctcagcctggggagctgaaggggagacgcgtctgggtggggctgctcggagcccgggcctggtggcccctggggctcccgggcgggcagggtagggcagagtagagcgggcttcaacatgatggcggccgaggccggcagtgaggagggcggcccggtaacagccggagctggaggaggcggcgcggcagcgggctccagtgcctatcccgcagtgtgtcgggtgaagatacccgcggccctgcctgtggcagccgccccctatcctgggctggtggagaccggagtggctggaactctgggtggcggagccgctttggggtcagagttcctaggagccgggtctgtggcaggggcactggggggagctggactgacagggggaggtactgctgctggcgtagctggtgctgctgctggcgtggccggtgctgctgttgctggacctagtggagacatggctctcaccaaactgcccacttcgttgcttgctgagactctcgggccaggcggcggttttccccctctgccccctcccccttacctgccccctttgggggcgggcctcgggacagtggacgaaggtgactctctggatggaccagaatacgaggaggaagaggtggccataccgttgaccgctcctccaactaaccagtggtatcacggaaaacttgacagaacgatagcagaagaacgcctcaggcaggcagggaagtctggcagttatcttataagagagagtgatcggaggccagggtcctttgtactttcatttcttagccagatgaatgttgtcaaccattttaggattattgctatgtgtggagattactacattggtggaagacgtttttcttcactgtcagacctaataggttattacagtcatgtttcttgtttgcttaaaggagaaaaattactttacccagttgcaccaccagagccagtagaagatagaaggcgtgtacgagctattctaccttacacaaaagtaccagacactgatgaaataagtttcttaaaaggagatatgttcattgttcataatgaattagaagatggatggatgtgggttacaaatttaagaacagatgaacaaggccttattgttgaagacctagtagaagaggtgggccgggaagaagatccacatgaaggaaaaatatggttccatgggaagatttccaaacaggaagcttataatttactaatgacagttggtcaagtctgcagttttcttgtgaggccctcagataatactcctggcgattattcactttatttccggaccaatgaaaatattcagcgatttaaaatatgtccaacgccaaacaatcagtttatgatgggaggccggtattataacagcattggggacatcatagatcactatcgaaaagaacagattgttgaaggatattatcttaaggaacctgtaccaatgcaggatcaagaacaagtactcaatgacacagtggatggcaaggaaatctataataccatccgtcgtaaaacaaaggatgccttttataaaaacattgttaagaaaggttatcttctgaaaaagggcaaaggaaaacgttggaaaaatttatattttatcttagagggtagtgatgcccaacttatttattttgaaagcgaaaaacgagctaccaaaccaaaaggattaatagatctcagtgtatgttctgtctatgtcgttcatgatagtctctttggcaggccaaactgttttcagatagtagttcagcactttagtgaagaacattacatcttttactttgcaggagaaactccagaacaagcagaggattggatgaaaggtctgcaggcattttgcaatttacggaaaagtagtccagggacatccaataaacgccttcgtcaggtcagcagccttgttttacatattgaagaagcccataaactcccagtaaaacattttactaatccatattgtaacatctacctgaatagtgtccaagtagcaaaaactcatgcaagggaagggcaaaacccagtatggtcagaagagtttgtctttgatgatcttcctcctgacatcaatagatttgaaataactcttagtaataaaacaaagaaaagcaaagatcctgatatcttatttatgcgctgccagttgagccgattacagaaagggcatgccacagatgaatggtttctgctcagctcccatataccattaaaaggtattgaaccagggtccctgcgtgttcgagcacgatactctatggaaaaaatcatgccagaagaagagtacagtgaatttaaagagcttatactgcaaaaggaacttcatgtagtctatgctttatcacatgtatgtggacaagaccgaacactactggccagcatcctactgaggatttttcttcacgaaaagcttgaatcgttgttgttatgcacactaaatgacagagaaataagcatggaagatgaagccactaccctatttcgagccacaacacttgcaagcaccttgatggagcagtatatgaaagccactgctacacagtttgttcatcatgctttgaaagactctattttaaagataatggaaagcaagcagtcttgtgagcttagtagttccaagctacaaaaggca

SEQ ID NO: 3591 - DNA, 1490 bp, Homo sapiens
ggttacctcatcgccgcctccgggaggccccgctcgctcgcgccggcggctggggcggcgactccaggcgcggaagcgagagaaggatagaggcacagaggctccgggaggcagcgctgccccccgcgccccgcaccgctgcgggacccgcgccgcgagaggggcggacttcggcgcctcgcgcgtccgccggcgcctgggttggcgctgcggggcggaggcggtgtctgagcgccgctccggctctgctctctctcgagcttcggcacccgcccgagccgctcgcgcgcccgccacctgtctgcccactcggctgtctgtctgccctcccgccgccagctcctgcctcgggcctgccctctccggtctcggtgctccgaggggcgacgagaagcgcgacggggccgtggcgcaccgggcagggcgcgcggggcgcacggcctgggggcgcacggtgcggcgccggcccatgaggctttccagcgcggggagcgacagcgccggccggccatggggggtagcctgcgggtggccgttctaggcgccccgggcgtgggcaagacggccatcatccgccagttcctgttcggtgactaccccgagcgccaccggcccacggacgggccgcgcctctaccgacccgcggtgctgctcgacggcgccgtctacgacttgagcatccgcgacggcgacgtcgctggccccggctcgagccccgggggtccggaggagtggccagacgctaaggactggagcttgcaggacacggacgccttcgtgctcgtctacgacatctgcagcccggacagtttcgactacgtgaaggccctgcggcagcgcatcgcggagaccaggccggcgggcgcgcccgaagcgcccatcctcgtggtaggcaacaagcgggacaggcagcggctgcgcttcggaccgcggcgcgcgctggccgccctagtgcgcaggggctggcgctgcggctacctcgagtgctccgccaagtacaactggcacgtgctgcgtctcttccgcgagctgctgcgctgcgctctggtgcgcgcgcgccctgcacacccggccctgcgcctgcagggggcgctgcatcccgcgcgctgcagcctcatgtgacccgatcggacagtgccatccatgggccccaccttgtgactgggacaatcagggacctggattggacgggatcgcccaacttcactgggactggacagggaagtctccgccctgattggatgaggaaagctccaacccagtctcctaagcgactggcccccttttgaacctcattggacccaaccaggtcccaagctccattggagatgaccagtcctttctgggacctcaatgggtcacaatcccattggatggaaaggacttggctatgaacttgactggaaacacgcagcctgctcctggagcttcactggacatattctttatgccacacctaccacgggataataaaagggaaaataatttga

SEQ ID NO: 3592 - DNA, 1720 bp, Homo sapiens
caggcgcggaagcgagagaaggatagaggcacagaggctccgggaggcagcgctgccccccgcgccccgcaccgctgcgggacccgcgccgcgagaggggcggacttcggcgcctcgcgcgtccgccggcgcctgggttggcgctgcggggcggaggcggtgtctgagcgccgctccggctctgctctctctcgagcttcggcacccgcccgagccgctcgcgcgcccgccacctgtctgcccactcggctgtctgtctgccctcccgccgccagctcctgcctcgggcctgccctctccggtctcggtgctccgaggggcgacgagaagcgcgacggggccgtggcgcaccgggcagggcgcgcggggcgcacggcctgggggcgcacggtgcggcgccggcccatgaggctttccagcgcggggagcgacagcgccggccggccatggggggtagcctgcgggtggccgttctaggcgccccgggcgtgggcaagacggccatcatccgccagttcctgttcggtgactaccccgagcgccaccggcccacggacgggccgcgcctctaccgacccgcggtgctgctcgacggcgccgtctacgacttgagcatccgcgacggcgacgtcgctggccccggctcgagccccgggggtccggaggagtggccagacgctaaggactggagcttgcaggacacggacgccttcgtgctcgtctacgacatctgcagcccggacagtttcgactacgtgaaggccctgcggcagcgcatcgcggagaccaggtaggggcccggcagttctggcggtggggagctaggacaggtctggcagggcctttgcctgaggagagtgtgtagggtctcccaacgtcgtgggccgggtcttaggccttcgcccgtgggaaggtcttaagctgtatgtgctctttggcccacatgggcctggggtttcgttggggcggcggggggggcggtgtctctggccgtaggaagggaatgcgcctgcgtgtgtatacccactgggggaattctccggccgtggggtccccgcgtctctcatctccattcggcccccaggccggcgggcgcgcccgaagcgcccatcctcgtggtaggcaacaagcgggacaggcagcggctgcgcttcggaccgcggcgcgcgctggccgccctagtgcgcaggggctggcgctgcggctacctcgagtgctccgccaagtacaactggcacgtgctgcgtctcttccgcgagctgctgcgctgcgctctggtgcgcgcgcgccctgcacacccggccctgcgcctgcagggggcgctgcatcccgcgcgctgcagcctcatgtgacccgatcggacagtgccatccatgggccccaccttgtgactgggacaatcagggacctggattggacgggatcgcccaacttcactgggactggacagggaagtctccgccctgattggatgaggaaagctccaacccagtctcctaagcgactggcccccttttgaacctcattggacccaaccaggtcccaagctccattggagatgaccagtcctttctgggacctcaatgggtcacaatcccattggatggaaaggacttggctatgaacttgactggaaacacgcagcctgctcctggagcttcactggacatattctttatgccacacctaccacgggataataaaagggaaaataatttga

SEQ ID NO: 3593 - DNA, 2323 bp, Homo sapiens
tttcctgtttctctgcagttttcctcagctttgggtggtggccgctgccgggcatcggcttccagtccgcggagggcgaggcggcgtggacagcggccccggcacccagcgccccgccgcccgcaagccgcgcgcccgtccgccgcgccccgagcccgccgcttcctatctcagcgccctgccgccgccgccgcggcccagcgagcggccctgatgcaggccatcaagtgtgtggtggtgggagacggagctgtaggtaaaacttgcctactgatcagttacacaaccaatgcatttcctggagaatatatccctactgtctttgacaattattctgccaatgttatggtagatggaaaaccggtgaatctgggcttatgggatacagctggacaagaagattatgacagattacgccccctatcctatccgcaaacagatgtgttcttaatttgcttttcccttgtgagtcctgcatcatttgaaaatgtccgtgcaaagtggtatcctgaggtgcggcaccactgtcccaacactcccatcatcctagtgggaactaaacttgatcttagggatgataaagacacgatcgagaaactgaaggagaagaagctgactcccatcacctatccgcagggtctagccatggctaaggagattggtgctgtaaaatacctggagtgctcggcgctcacacagcgaggcctcaagacagtgtttgacgaagcgatccgagcagtcctctgcccgcctcccgtgaagaagaggaagagaaaatgcctgctgttgtaaatgtctcagcccctcgttcttggtcctgtcccttggaacctttgtacgctttgctcaaaaaaaaacaaaaaaaaaaaacaaaaaaaaaaaacaacggtggagccttcgcactcaatgccaactttttgttacagattaatttttccataaaaccattttttgaaccaatcagtaattttaaggttttgtttgttctaaatgtaagagttcagactcacattctattaaaatttagccctaaaatgacaagccttcttaaagccttatttttcaaaagcgccccccccattcttgttcagattaagagttgccaaaataccttctgaactacactgcattgttgtgccgagaacaccgagcactgaactttgcaaagaccttcgtctttgagaagacggtagcttctgcagttaggaggtgcagacacttgctctcctatgtagttctcagatgcgtaaagcagaacagcctcccgaatgaagcgttgccattgaactcaccagtgagttagcagcacgtgttcccgacataacattgtactgtaatggagtgagcgtagcagctcagctctttggatcagtctttgtgatttcatagcgagttttctgaccagcttttgcggagattttgaacagaactgctatttcctctaatgaagaattctgtttagctgtgggtgtgccgggtggggtgtgtgtgatcaaaggacaaagacagtattttgacaaaatacgaagtggagatttacactacattgtacaaggaatgaaagtgtcacgggtaaaaactctaaaaggttaatttctgtcaaatgcagtagatgatgaaagaaaggttggtattatcaggaaatgttttcttaagcttttcctttctcttacacctgccatgcctccccaaattgggcatttaattcatctttaaactggttgttctgttagtcgctaacttagtaagtgcttttcttatagaaccccttctgactgagcaatatgcctccttgtattataaaatctttctgataatgcattagaaggtttttttgtcgattagtaaaagtgctttccatgttactttattcagagctaataagtgctttccttagttttctagtaactaggtgtaaaaatcatgtgttgcagctttatagtttttaaaatattttagataattcttaaactatgaaccttcttaacatcactgtcttgccagattaccgacactgtcacttgaccaatactgaccctctttacctcgcccacgcggacacacgcctcctgtagtcgctttgcctattgatgttcctttgggtctgtgaggttctgtaaactgtgctagtgctgacgatgttctgtacaacttaactcactggcgagaatacagcgtgggacccttcagccactacaacagaattttttaaattgacagttgcagaattgtggagtgtttttacattgatcttttgctaatgcaattagcattatgttttgcatgtatgacttaataaatccttgaatcatacgactggtaa

SEQ ID NO: 3594 - DNA, 907 bp, Homo sapiens
agttttcctcagctttgggtggtggccgctgccgggcatcggcttccagtccgcggagggcgaggcggcgtggacagcggccccggcacccagcgccccgccgcccgcaagccgcgcgcccgtccgccgcgccccgagcccgccgcttcctatctcagcgccctgccgccgccgccgcggcccagcgagcggccctgatgcaggccatcaagtgtgtggtggtgggagacggagctgtaggtaaaacttgcctactgatcagttacacaaccaatgcatttcctggagaatatatccctactgtctttgacaattattctgccaatgttatggtagatggaaaaccggtgaatctgggcttatgggatacagctggacaagaagattatgacagattacgccccctatcctatccgcaaacagttggagaaacgtacggtaaggatataacctcccggggcaaagacaagccgattgccgatgtgttcttaatttgcttttcccttgtgagtcctgcatcatttgaaaatgtccgtgcaaagtggtatcctgaggtgcggcaccactgtcccaacactcccatcatcctagtgggaactaaacttgatcttagggatgataaagacacgatcgagaaactgaaggagaagaagctgactcccatcacctatccgcagggtctagccatggctaaggagattggtgctgtaaaatacctggagtgctcggcgctcacacagcgaggcctcaagacagtgtttgacgaagcgatccgagcagtcctctgcccgcctcccgtgaagaagaggaagagaaaatgcctgctgttgtaaatgtctcagcccctcgttcttggtcctgtcccttggaacctttgtacgctttgctcaaaaaaaaacaaaaaaaa

SEQ ID NO: 3595 - DNA, 1482 bp, Homo sapiens
cctcctgccccaccaccgctgctcctcagcaggcgcctcaccagcctccacaccccttgcgcccgcagaaacgcgcctggccctgagctgtcaccaccgacactctccaggctccggacacgatgcaggccatcaagtgtgtggtggtgggagatggggccgtgggcaagacctgccttctcatcagctacaccaccaacgcctttcccggagagtacatccccaccgtgtttgacaactattcagccaatgtgatggtggacagcaagccagtgaacctggggctgtgggacactgctgggcaggaggactacgaccgtctccggccgctctcctatccacagacggacgtcttcctcatctgcttctccctcgtcagcccagcctcttatgagaacgtccgcgccaagtggttcccagaagtgcggcaccactgccccagcacacccatcatcctggtgggcaccaagctggacctgcgggacgacaaggacaccatcgagaaactgaaggagaagaagctggctcccatcacctacccgcagggcctggcactggccaaggagattgactcggtgaaatacctggagtgctcagctctcacccagagaggcctgaaaaccgtgttcgacgaggccatccgggccgtgctgtgccctcagcccacgcggcagcagaagcgcgcctgcagcctcctctaggggttgcaccccagcgctcccacctagatgggtctgatcctccaggatccccacccaaagcctgatggcaccccggctggccatgctgtcccctccctgtggcgtttcttagcagatggctgcagagcttcgttgatggtcttttctgtactggaggcctcctgaggccaggaacgtgcaaatttgcaggtgctgcatcccaagcccctcatgctcctgccttcctgagggccagaggggagccccaggacccattaagccacccccgtgttcctgccgtcagtgccaactgccgcatgtggaagcatctacccgttcactccagtcccaccccacgcctgactcccctctggaaactgcaggccagatggttgctgccacaacttgtgtaccttcagggatggggctcttactccctcctgaggccagctgctctaatatcgatggtcctgcttgccagagagttcctctacccagcaaaaatgagtgtctcagaagtgtgctcctctggcctcagttctcctcttttggaacaacataaaacaaatttaattttctacgcctctggggatatctgctcagccaatggaaaatctgggttcaaccagcccctgccatttcttaagactttctgctgcactcacaggatcctgagctgcacttacctgtgagagtcttcaaacttttaaaccttgccagtcaggacttttgctattgcaaatagaaaacccaactcaacctgcttaagcagaaaataaatttattgattcaagtttggaga

SEQ ID NO: 3596 - DNA, 569 bp, Homo sapiens
tcctcagcaggcgcctcaccagcctccacaccccttgcgcccgcagaaacgcgcctggccctgagctgtcaccaccgacactctccaggctccggacacgatgcaggccatcaagtgtgtggtggtgggagatggggccgtgggcaagacctgccttctcatcagctacaccaccaacgcctttcccggagagtacatccccaccgtgcctgggaggccctgcgctctattgcaggatgcggaggcagggctgtcatcggacgtggagggagcgtgttggtgtcagactcaggagggaaggatgactggggaggcaccagcccctccctggccagccctcaggggtccccatcactcctaggacatttccccgactccctagcatggcactcaaggctcctgatggccttcactcaacctcccacctggccttattacccattactttgcttcacactctgcctcctccggaccctactgttcgccacaagctccctgcacatttctaccccagggcctttgctcaagctgttctctctccccatagtgctttttctccccacatccac

SEQ ID NO: 3597 - DNA, 842 bp, Homo sapiens
caggtctcctgctggagcctccacgcagggggcctgtggggatggccagggctcagcccagcacctgagcgcccctcccaccagctgctctgccagaccgcatgctccgccccctgcaaacgaccgtggggagagcagcttgagtaagttccccttccgtttcctcctgccccaccaccgctgctcctcagcaggcgcctcaccagcctccacaccccttgcgcccgcagaaacgcgcctggccctgagctgtcaccaccgacactctccaggctccggacacgatgcaggccatcaaggccgtgggcaagacctgccttctcatcagctacaccaccaacgcctttcccggagagtacatccccaccgtgtttgacaactattcagccaatgtgatggtggacagcaagccagtgaacctggggctgtgggacactgctgggcaggaggactacgaccgtctccggccgctctcctatccacagacggacgtcttcctcatctgcttctccctcgtcagcccagcctcttatgagaacgtccgcgccaagtggttcccagaagtgcggcaccactgccccagcacacccatcatcctggtgggcaccaagctggacctgcgggacgacaaggacaccatcgagaaactgaaggagaagaagctggctcccatcacctacccgcagggcctggcactggccaaggagattgactcggtgaaatacctggagtgctcagctctcacccagagaggcctgaaaaccgtgttcgacgaggccatccgggccgtgctgtgccctcagcccacgcggcagcagaagcgcgcctgcagcctcctctag

SEQ ID NO: 3598 - DNA, 893 bp, Homo sapiens
cagcacagagggcccccaggtctcctgctggagcctccacgcagggggcctgtggggatggccagggctcagcccagcacctgagcgcccctcccaccagctgctctgccagaccgcatgctccgccccctgcaaacgaccgtggggagagcagcttgaggccgtgggcaagacctgccttctcatcagctacaccaccaacgcctttcccggagagtacatccccaccgtgtttgacaactattcagccaatgtgatggtggacagcaagccagtgaacctggggctgtgggacactgctgggcaggaggactacgaccgtctccggccgctctcctatccacagacggacgtcttcctcatctgcttctccctcgtcagcccagcctcttatgagaacgtccgcgccaagtggttcccagaagtgcggcaccactgccccagcacacccatcatcctggtgggcaccaagctggacctgcgggacgacaaggacaccatcgagaaactgaaggagaagaagctggctcccatcacctacccgcagggcctggcactggccaaggagattgactcggtgaaatacctggagtgctcagctctcacccagagaggcctgaaaaccgtgttcgacgaggccatccgggccgtgctgtgccctcagcccacgcggcagcagaagcgcgcctgcagcctcctctaggggttgcaccccagcgctcccacctagatgggtctgatcctccaggatccccacccaaagcctgatggcaccccggctggccatgctgtcccctccctgtggcgtttcttagcagatggctgcagagcttcgttgatggtcttttctgtactggaggcctcctgaggccaggaacgtgcaaatttgcagg

SEQ ID NO: 3599 - DNA, 705 bp, Homo sapiens
gagggcccccaggtctcctgctggagcctccacgcagggggcctgtggggatggccagggctcagcccagcacctgagcgcccctcccaccagctgctctgccagaccgcatgctccgccccctgcaaacgaccgtggggagagcagcttgaaaacgcgcctggccctgagctgtcaccaccgacactctccaggctccggacacgatgcaggccatcaagtgtgtggtggtgggagatggggccgtgggcaagacctgccttctcatcagctacaccaccaacgcctttcccggagagtacatccccaccgtgtttgacaactattcagccaatgtgatggtggacagcaagccagtgaacctggggctgtgggacactgctgggcaggaggactacgaccgtctccggccgctctcctatccacagacggacgtcttcctcatctgcttctccctcgtcagcccagcctcttatgagaacgtccgcgccaagtggttcccagaagtgcggcaccactgccccagcacacccatcatcctggtgggcaccaagctggacctgcgggacgacaaggacaccatcgagaaactgaaggagaagaagctggctcccatcacctacccgcagggcctggcactggccaaggagattgactcggtgaaatacctggagtgctcagctctcacccagagaggcctgaaaa

SEQ ID NO: 3600 - DNA, 6635 bp, Homo sapiens
gtcgacaataacaaaccaagccgcggcggtgtccgcggccctgccgagccctcggcgttgcctcagaatcccccagtcgcctgggcccctcggctctgacaggccgcggccttctgtcccccggccccagacccagagccgaggggcctgctcgcgtccttgtccgcccggacccctccctgcctcctagagttcggggccgcggcgggcgggcgcccgggacgccggcggttgtgtcggcttagcggtgccgaatgggcggttggtaaccgctgccgaggactaggcggcggcggaagatggtgccgggggtcgctggctctgctgctgccgccggcgaaggaggaggcgttgccggttttctgagtttaaccagtaatgccattcagttgccaatctcaagcaaagcaaacataagccagttttaatctactttttaagaaaagtggtagtccttttcacagtgcctgacgtaactgtatcagagggtgaggtataagctcacagaattcagataaatcatcatgaagttatatgtatttctggttaacactggaactactctaacatttgacactgaacttacagtgcaaactgtggcagaccttaagcatgccattcaaagcaaatacaagattgctattcaacaccaggtgctggtggtcaatggaggagaatgcatggctgcagatcgaagagtgtgtacctacagtgctgggacggatacaaatccaatttttctttttaacaaagaaatgatcttatgtgatcgtccacctgctattcctaaaactaccttttcgacagaaaatgacatggaaataaaagttgaagaatctcttatgatgcctgcagtttttcatactgttgcttcaaggacacagcttgcattggaaatgtatgaagttgccaagaaactttgttctttttgtgaaggtcttgtacatgatgaacatcttcaacaccaaggctgggctgcaatcatggccaacctggaggactgttcaaattcataccaaaagctacttttcaagtttgaaagtatttattcaaattatctgcagtccatagaagacatcaagttaaaacttactcatttaggaactgcagtttcagtaatggccaagattccactgttggagtgcctaaccagacatagttacagagaatgtttgggaagactggattctttacctgaacatgaagactcagaaaaagctgagatgaaaagatccactgaactggtgctctctcctgatatgcctagaacaactaacgaatctttgttaacctcatttcccaagtcagtggaacatgtgtccccagataccgcagatgctgaaagtggcaaagaaattagggaatcttgtcaaagtactgttcatcagcaagatgaaactacgattgacactaaagatggtgatctgcccttttttaatgtctctttgttagactggataaatgttcaagatagacctaatgatgtggaatctttggtcaggaagtgctttgattctatgagcaggcttgatccaaggattattcgaccatttatagcagaatgccgtcaaactattgccaaacttgataatcagaatatgaaagccattaaaggacttgaagatcggctctacgccctggaccagatgattgctagctgtggccgactggtgaatgaacagaaagagcttgctcagggatttttagctaatcagaagagagctgaaaacttaaaggatgcatctgtattacctgatttatgcctgagtcacgcaaatcagttgatgattatgttgcaaaatcatagaaaactgttagatattaagcagaagtgtaccactgccaaacaagaactagcaaataacctacatgtcagactgaagtggtgttgctttgtaatgcttcatgctgatcaagatggagagaagttacaagctttgctccgcctcgtaatagagctgttagaaagagtcaaaattgttgaagctcttagtacagttcctcagatgtactgcttagctgttgttgaggttgtaagaagaaaaatgttcataaaacactacagggagtgggctggtgctttagtcaaagatggaaagagattatatgaagcagaaaaatcaaaaagggaatcctttgggaaattatttaggaagtcttttttaagaaatcgtctgtttaggggactggactcctggcccccttccttttgtactcaaaagcctcgaaagtttgactgtgaacttccagatatttcattaaaagatttacagtttctgcaatcattttgtccttcggaagttcagccattcctcagggttcccttactttgtgactttgaacctctacaccagcatgtacttgctctacataatttggtaaaagcagcacaaagtttggatgaaatgtcacagaccattacagatctactgagtgaacaaaaggcatctgtgagtcagacatccccacagtctgcttcttcaccaaggatggaaagtacagcaggaattacaactactacctcaccgagaactcctccaccactgactgttcaggatcccttatgtcctgcagtttgtcccttagaagaattatctccagatagtattgatgcacatacgtttgattttgaaactattccccatccaaacatagaacagactattcaccaagtttctttagacttggattcattagcagaaagtcctgaatcagattttatgtctgctgtgaatgagtttgtaatagaagaaaatttgtcgtctcctaatcctataagtgatccacaaagcccagaaatgatggtggaatcactttattcatcagttatcaatgcgatagacagtagacgaatgcaggatacaaatgtatgtggtaaggaggattttggagatcatacttctctgaatgtccagttggaaagatgtagagttgttgcccaagactctcacttcagtatacaaaccattaaggaagacctttgccactttagaacatttgtacaaaaagaacagtgtgacttctcaaattcattaaaatgtacagcagtagaaataagaaacattattgaaaaagtaaaatgttctctggaaataacactaaaagaaaaacatcaaaaagaactactgtctttaaaaaatgaatatgaaggtaaacttgacggactaataaaggaaactgaagagaatgaaaacaaaattaaaaaattgaagggagagttagtatgccttgaggaggttttacaaaataaagataatgaatttgctttggttaaacatgaaaaagaagctgtaatctgcctgcagaatgaaaaggatcagaagttgttagagatggaaaatataatgcactctcaaaattgtgaaattaaagaactgaagcagtcacgagaaatagtgttagaagacttaaaaaagctccatgttgaaaatgatgagaagttacagttattgagggcagaacttcagtccttggagcaaagtcatctaaaggaattagaggacacacttcaggttaggcacatacaagagtttgagaaggttatgacagaccacagagtttctttggaggaattaaaaaaggaaaaccaacaaataattaatcaaatacaagaatctcatgctgaaattatccaggaaaaagaaaaacagttacaggaattaaaactcaaggtttctgatttgtcagacacgagatgcaagttagaggttgaacttgcgttgaaggaagcagaaactgatgaaataaaaattttgctggaagaaagcagagcccagcagaaggagaccttgaaatctcttcttgaacaagagacagaaaatttgagaacagaaattagtaaactcaaccaaaagattcaggataataatgaaaattatcaggtgggcttagcagagctaagaactttaatgacaattgaaaaagatcagtgtatttccgagttaattagtagacatgaagaagaatctaatatacttaaagctgaattaaacaaagtaacatctttgcataaccaagcatttgaaatagaaaaaaacctaaaagaacaaataattgaactgcagagtaaattggattcagaattgagtgctcttgaaagacaaaaagatgaaaaaattacccaacaagaagagaaatacgaagctattatccagaaccttgagaaagacagacaaaaattggtcagcagccaggagcaagacagagaacagttaattcagaagcttaattgtgaaaaagatgaagctattcagactgccctaaaagaatttaaattggagagagaagttgttgagaaagagttattagaaaaagttaaacatcttgagaatcaaatagcaaaaagtcctgccattgactctaccagaggagattcttcaagcttagttgctgaacttcaagaaaagcttcaggaagaaaaagctaagtttctagaacaacttgaagagcaagaaaaaagaaagaatgaagaaatgcaaaatgttcgaacatctttgattgcggaacaacagaccaattttaacactgttttaacaagagagaaaatgagaaaagaaaacataataaatgatcttagtgataagttgaaaagtacaatgcagcaacaagaacgggataaagatttgatagagtcactttctgaagatcgagctcgtttgcttgaggaaaagaaaaagcttgaagaagaagtcagtaagttgcgtagtagcagttttgttccttcaccatatgtagctacagccccagaactttatggagcttgtgcacctgaactcccaggtgaatcagatagatccgctgtggaaacagcagatgaaggaagagtggattcagcaatggagacaagcatgatgtctgtacaagaaaatattcatatgttgtctgaagaaaaacagcggataatgctgttagaacgaacattgcaattgaaagaagaagaaaataaacggttaaatcaaagactgatgtctcagagcatgtcttcagtatcttcaaggcattctgaaaagatagctattagagattttcaggtgggagatttggtactcatcatcctagacgaacgccatgacaattatgtgttatttactgttagtcctactttatattttctacattcagagtctctacctgccctggatctcaaaccaggtgagggtgcttcaggtgcatctagaagaccctgggtacttggaaaagtaatggaaaaagaatactgtcaagccaaaaaggcacaaaacagatttaaagttcctttggggacaaagttttacagagtgaaagccgtatcatggaataagaaagtataacttatggacaaaattaatacattctatgacatttttttctgatttgtcctgcagtgctcattcatcactccaaaaacagcaggccatctttttatgcaaaagtcagcgtgacaatatacttcactggtgtacatcgtttactttttaactggcttcattttaggaataataaattcatcagaatccttggctgaattaaaatggtttttgttttttggtttttttttttacccagacaactctagaaatgcggaccaaactacttcattttctcaaagggcataccttgtgcattgtggcttatgatgagccatattaattgcctgttaaatatacactagcttgaacttagatgttaaatgttattattaccagcatttgtccttttgtgaaatcagtatcagaatacttgcactctttaacacattctttataaaatgtataaattattcagaactatttaaaataaagaggagtgttattgcatgctgataatcattttgagtttgcctcagtagatactaaagcaaattgtttcagtttttttaaatgccctttgatgtttcaaaaaaaaaaaggaactgtaatttgattgactgattttaagatcagccataagtaatcagcaatcttcaaaagcactttcagtggattggtcatctgggttctaaagggaagagtctgtgctactaaccatttcaaatgcagactcaaaccttcccaacatctttatgactctagaataatcatattgatgaaatcgtaattcatggttgagtttcagaacaaaagatattcattgcacattaaccatttagaggtcatttaaataacaaaatattgtattgtaaaagaactgtacaattttaaaacaataaagatttgaacctgtaaatgtgtgtgccttttaaagaaggatacatttttaatatatttgagtgattgctgggaagtgtgaaaatattgttatgtatcatatcaaagagaaacatgtttattacaaaaatgttctttaactatatactatgtaacagggtaaacagtgttatgtagaatagaattgtgtaaactagatctttagagaagttgccattgagcaaagttatttaaatgagttagttgagttggatgagaattgtttgaggtttgttgctagagaacaataataaaataattctttttcagaaaatatttaatttcttcataaaaataagttaaatatttttttaaatatgtatatctaatagtacaaaatggaataaacatcatagtgtatagaaaactgaatttgacaagttaatgaataaatgaacaaatgatttcaca

SEQ ID NO: 3601 - DNA, 6614 bp, Homo sapiens
aacaaaccaagccgcggcggtgtccgcggccctgccgagccctcggcgttgcctcagaatcccccagtcgcctgggcccctcggctctgacaggccgcggccttctgtcccccggccccagacccagagccgaggggcctgctcgcgtccttgtccgcccggacccctccctgcctcctagagttcggggccgcggcgggcgggcgcccgggacgccggcggttgtgtcggcttagcggtgccgaatgggcggttggtaaccgctgccgaggactaggcggcggcggaagatggtgccgggggtcgctggctctgctgctgccgccggcgaaggaggaggcgttgccggttttctgagtttaaccagtaatgccattcagttgccaatctcaagcaaagcaaacataagccagttttaatctactttttaagaaaagtggtagtccttttcacagtgcctgacgtaactgtatcagagggtgaggtataagctcacagaattcagataaatcatcatgaagttatatgtatttctggttaacactggaactactctaacatttgacactgaacttacagtgcaaactgtggcagaccttaagcatgccattcaaagcaaatacaagattgctattcaacaccaggtgctggtggtcaatggaggagaatgcatggctgcagatcgaagagtgtgtacctacagtgctgggacggatacaaatccaatttttctttttaacaaagaaatgatcttatgtgatcgtccacctgctattcctaaaactaccttttcgacagaaaatgacatggaaataaaagttgaagaatctcttatgatgcctgcagtttttcatactgttgcttcaaggacacagcttgcattggaaatgtatgaagttgccaagaaactttgttctttttgtgaaggtcttgtacatgatgaacatcttcaacaccaaggctgggctgcaatcatggccaacctggaggactgttcaaattcataccaaaagctacttttcaagtttgaaagtatttattcaaattatctgcagtccatagaagacatcaagttaaaacttactcatttaggaactgcagtttcagtaatggccaagattccactgttggagtgcctaaccagacatagttacagagaatgtttgggaagactggattctttacctgaacatgaagactcagaaaaagctgagatgaaaagatccactgaactggtgctctctcctgatatgcctagaacaactaacgaatctttgttaacctcatttcccaagtcagtggaacatgtgtccccagataccgcagatgctgaaagtggcaaagaaattagggaatcttgtcaaagtactgttcatcagcaagatgaaactacgattgacactaaagatggtgatctgcccttttttaatgtctctttgttagactggataaatgttcaagatagacctaatgatgtggaatctttggtcaggaagtgctttgattctatgagcaggcttgatccaaggattattcgaccatttatagcagaatgccgtcaaactattgccaaacttgataatcagaatatgaaagccattaaaggacttgaagatcggctctacgccctggaccagatgattgctagctgtggccgactggtgaatgaacagaaagagcttgctcagggatttttagctaatcagaagagagctgaaaacttaaaggatgcatctgtattacctgatttatgcctgagtcacgcaaatcagttgatgattatgttgcaaaatcatagaaaactgttagatattaagcagaagtgtaccactgccaaacaagaactagcaaataacctacatgtcagactgaagtggtgttgctttgtaatgcttcatgctgatcaagatggagagaagttacaagctttgctccgcctcgtaatagagctgttagaaagagtcaaaattgttgaagctcttagtacagttcctcagatgtactgcttagctgttgttgaggttgtaagaagaaaaatgttcataaaacactacagggagtgggctggtgctttagtcaaagatggaaagagattatatgaagcagaaaaatcaaaaagggaatcctttgggaaattatttaggaagtcttttttaagaaatcgtctgtttaggggactggactcctggcccccttccttttgtactcaaaagcctcgaaagtttgactgtgaacttccagatatttcattaaaagatttacagtttctgcaatcattttgtccttcggaagttcagccattcctcagggttcccttactttgtgactttgaacctctacaccagcatgtacttgctctacataatttggtaaaagcagcacaaagtttggatgaaatgtcacagaccattacagatctactgagtgaacaaaaggcatctgtgagtcagacatccccacagtctgcttcttcaccaaggatggaaagtacagcaggaattacaactactacctcaccgagaactcctccaccactgactgttcaggatcccttatgtcctgcagtttgtcccttagaagaattatctccagatagtattgatgcacatacgtttgattttgaaactattccccatccaaacatagaacagactattcaccaagtttctttagacttggattcattagcagaaagtcctgaatcagattttatgtctgctgtgaatgagtttgtaatagaagaaaatttgtcgtctcctaatcctataagtgatccacaaagcccagaaatgatggtggaatcactttattcatcagttatcaatgcgatagacagtagacgaatgcaggatacaaatgtatgtggtaaggaggattttggagatcatacttctctgaatgtccagttggaaagatgtagagttgttgcccaagactctcacttcagtatacaaaccattaaggaagacctttgccactttagaacatttgtacaaaaagaacagtgtgacttctcaaattcattaaaatgtacagcagtagaaataagaaacattattgaaaaagtaaaatgttctctggaaataacactaaaagaaaaacatcaaaaagaactactgtctttaaaaaatgaatatgaaggtaaacttgacggactaataaaggaaactgaagagaatgaaaacaaaattaaaaaattgaagggagagttagtatgccttgaggaggttttacaaaataaagataatgaatttgctttggttaaacatgaaaaagaagctgtaatctgcctgcagaatgaaaaggatcagaagttgttagagatggaaaatataatgcactctcaaaattgtgaaattaaagaactgaagcagtcacgagaaatagtgttagaagacttaaaaaagctccatgttgaaaatgatgagaagttacagttattgagggcagaacttcagtccttggagcaaagtcatctaaaggaattagaggacacacttcaggttaggcacatacaagagtttgagaaggttatgacagaccacagagtttctttggaggaattaaaaaaggaaaaccaacaaataattaatcaaatacaagaatctcatgctgaaattatccaggaaaaagaaaaacagttacaggaattaaaactcaaggtttctgatttgtcagacacgagatgcaagttagaggttgaacttgcgttgaaggaagcagaaactgatgaaataaaaattttgctggaagaaagcagagcccagcagaaggagaccttgaaatctcttcttgaacaagagacagaaaatttgagaacagaaattagtaaactcaaccaaaagattcaggataataatgaaaattatcaggtgggcttagcagagctaagaactttaatgacaattgaaaaagatcagtgtatttccgagttaattagtagacatgaagaagaatctaatatacttaaagctgaattaaacaaagtaacatctttgcataaccaagcatttgaaatagaaaaaaacctaaaagaacaaataattgaactgcagagtaaattggattcagaattgagtgctcttgaaagacaaaaagatgaaaaaattacccaacaagaagagaaatacgaagctattatccagaaccttgagaaagacagacaaaaattggtcagcagccaggagcaagacagagaacagttaattcagaagcttaattgtgaaaaagatgaagctattcagactgccctaaaagaatttaaattggagagagaagttgttgagaaagagttattagaaaaagttaaacatcttgagaatcaaatagcaaaaagtcctgccattgactctaccagaggagattcttcaagcttagttgctgaacttcaagaaaagcttcaggaagaaaaagctaagtttctagaacaacttgaagagcaagaaaaaagaaagaatgaagaaatgcaaaatgttcgaacatctttgattgcggaacaacagaccaattttaacactgttttaacaagagagaaaatgagaaaagaaaacataataaatgatcttagtgataagttgaaaagtacaatgcagcaacaagaacgggataaagatttgatagagtcactttctgaagatcgagctcgtttgcttgaggaaaagaaaaagcttgaagaagaagtcagtaagttgcgtagtagcagttttgttccttcaccatatgtagctacagccccagaactttatggagcttgtgcacctgaactcccaggtgaatcagatagatccgctgtggaaacagcagatgaaggaagagtggattcagcaatggagacaagcatgatgtctgtacaagaaaatattcatatgttgtctgaagaaaaacagcggataatgctgttagaacgaacattgcaattgaaagaagaagaaaataaacggttaaatcaaagactgatgtctcagagcatgtcttcagtatcttcaaggcattctgaaaagatagctattagagattttcaggtgggagatttggtactcatcatcctagacgaacgccatgacaattatgtgttatttactgttagtcctactttatattttctacattcagagtctctacctgccctggatctcaaaccagcttcaggtgcatctagaagaccctgggtacttggaaaagtaatggaaaaagaatactgtcaagccaaaaaggcacaaaacagatttaaagttcctttggggacaaagttttacagagtgaaagccgtatcatggaataagaaagtataacttatggacaaaattaatacattctatgacatttttttctgatttgtcctgcagtgctcattcatcactccaaaaacagcaggccatctttttatgcaaaagtcagcgtgacaatatacttcactggtgtacatcgtttactttttaactggcttcattttaggaataataaattcatcagaatccttggctgaattaaaatggtttttgttttttggtttttttttttacccagacaactctagaaatgcggaccaaactacttcattttctcaaagggcataccttgtgcattgtggcttatgatgagccatattaattgcctgttaaatatacactagcttgaacttagatgttaaatgttattattaccagcatttgtccttttgtgaaatcagtatcagaatacttgcactctttaacacattctttataaaatgtataaattattcagaactatttaaaataaagaggagtgttattgcatgctgataatcattttgagtttgcctcagtagatactaaagcaaattgtttcagtttttttaaatgccctttgatgtttcaaaaaaaaaaaggaactgtaatttgattgactgattttaagatcagccataagtaatcagcaatcttcaaaagcactttcagtggattggtcatctgggttctaaagggaagagtctgtgctactaaccatttcaaatgcagactcaaaccttcccaacatctttatgactctagaataatcatattgatgaaatcgtaattcatggttgagtttcagaacaaaagatattcattgcacattaaccatttagaggtcatttaaataacaaaatattgtattgtaaaagaactgtacaattttaaaacaataaagatttgaacctgtaaatgtgtgtgccttttaaagaaggatacatttttaatatatttgagtgattgctgggaagtgtgaaaatattgttatgtatcatatcaaagagaaacatgtttattacaaaaatgttctttaactatatactatgtaacagggtaaacagtgttatgtagaatagaattgtgtaaactagatctttagagaagttgccattgagcaaagttatttaaatgagttagttgagttggatgagaattgtttgaggtttgttgctagagaacaataataaaataattctttttcagaaaatatttaatttcttcataaaaataagttaaatatttttttaaatatgtatatctaatagtacaaaatggaataaacatcatagtgtatagaaaactgaatttgacaagttaatgaataaatgaacaaatgatttc

SEQ ID NO: 3602 - DNA, 551 bp, Homo sapiens
gtttcccggcatgcgccgcggaggaagagacggagtcgacaataacaaaccaagccgcggcggtgtccgcggccctgccgagccctcggcgttgcctcagaatcccccagtcgcctgggcccctcggctctgacaggccgcggccttctgtcccccggccccagacccagagccgaggggcctgctcgcgtccttgtccgcccggacccctccctgcctcctagagttcggggccgcggcgggcgggcgcccgggacgccggcggttgtgtcggcttagcggtgccgaatgggcggttggtaaccgctgccgaggactaggcggcggcggaagatggtgccgggggtcgctggctctgctgctgccgccggcgaaggaggaggcgttgccggtgtggcagaccttaagcatgccattcaaagcaaatacaagattgctattcaacaccaggtgctggtggtcaatggaggagaatgcatggctgcagatcgaagagtgtgtacctacagtgctgggacggatacaaatccaatttttctttttaacaaaga

SEQ ID NO: 3603 - DNA, 507 bp, Homo sapiens
agagagggagcttcgccatgtttctcaggctgatctcgaatttctgacctcaagtaatccgcccgcctcggcctcagaagtgctgagattaggggcttgagccaccgcacccgaccttcttttaaatttaaattagatggccagaggtggggcaaatgcataaataccctaaaaaggatttaaggaagagagttctgaggtgtttattctgaacttagaactaacgtttctacagcatttgctttcgtccgcctctacctccaccacggaaggataagaactagactttgacaagttttctgagtttaaccagtaatgccattcagttgccaatctcaagcaaagcaaacataagccagttttaatctactttttaagaaaagtggtagtccttttcacagtgcctgacgtaactgtatcagagggtgaggtataagctcacagaattcagataaatcatcatgaagttatatgtatttctggttaacactggaactactctaacat

SEQ ID NO: 3604 - DNA, 711 bp, Homo sapiens
caataacaaaccaagccgcggcggtgtccgcggccctgccgagccctcggcgttgcctcagaatcccccagtcgcctgggcccctcggctctgacaggccgcggccttctgtcccccggccccagacccagagccgaggggcctgctcgcgtccttgtccgcccggacccctccctgcctcctagagttcggggccgcggcgggcgggcgcccgggacgccggcggttgtgtcggcttagcggtgccgaatgggcggttggtaaccgctgccgaggactaggcggcggcggaagatggtgccgggggtcgctggctctgctgctgccgccggcgaaggaggaggcgttgccggttttctgagtttaaccagtaatgccattcagttgccaatctcaagcaaagcaaacataagccagttttaatctactttttaagaaaagtggtagtccttttcacagtgcctgacgtgtggcagaccttaagcatgccattcaaagcaaatacaagattgctattcaacaccaggtgctggtggtcaatggaggagaatgcatggctgcagatcgaagagtgtgtacctacagtgctgggacggatacaaatccaatttttctttttaacaaagaaatgatcttatgtgatcgtccacctgctattcctaaaactaccttttcgacagaaaatgacatggaaataaaagttgaagaatc

SEQ ID NO: 3605 - DNA, 470 bp, Homo sapiens
ggataatgctgttagaacgaacattgcaattgaaagaagaagaaaataaacggttaaatcaaagactgatgtctcagagcatgtcttcagtatcttcaaggcattctgaaaagatagctattagagattttcaggtgggagatttggtactcatcatcctagacgaacgccatgacaattatgtgttatttactgttagtcctactttatattttctacattcagagtctctacctgccctggatctcaaaccagcttcaggtgcatctagaagaccctgggtacttggaaaagtaatggaaaaagaatactgtcaagccaaaaagtgctcattcatcactccaaaaacagcaggccatctttttatgcaaaagtcagcgtgacaatatacttcactggtgtacatcgtttactttttaactggcttcattttaggaataataaattcatcagaatccttggctgaatta

SEQ ID NO: 3606 - DNA, 4776 bp, Homo sapiens
atgaagttatatgtatttctggttaacactggaactactctaacatttgacactgaacttacagtgcaaactgtggcagaccttaagcatgccattcaaagcaaatacaagattgctattcaacaccaggtgctggtggtcaatggaggagaatgcatggctgcagatcgaagagtgtgtacctacagtgctgggacggatacaaatccaatttttctttttaacaaagaaatgatcttatgtgatcgtccacctgctattcctaaaactaccttttcgacagaaaatgacatggaaataaaagttgaagaatctcttatgatgcctgcagtttttcatactgttgcttcaaggacacagcttgcattggaaatgtatgaagttgccaagaaactttgttctttttgtgaaggtcttgtacatgatgaacatcttcaacaccaaggctgggctgcaatcatggccaacctggaggactgttcaaattcataccaaaagctacttttcaagtttgaaagtatttattcaaattatctgcagtccatagaagacatcaagttaaaacttactcatttaggaactgcagtttcagtaatggccaagattccactgttggagtgcctaaccagacatagttacagagaatgtttgggaagactggattctttacctgaacatgaagactcagaaaaagctgagatgaaaagatccactgaactggtgctctctcctgatatgcctagaacaactaacgaatctttgttaacctcatttcccaagtcagtggaacatgtgtccccagataccgcagatgctgaaagtggcaaagaaattagggaatcttgtcaaagtactgttcatcagcaagatgaaactacgattgacactaaagatggtgatctgcccttttttaatgtctctttgttagactggataaatgttcaagatagacctaatgatgtggaatctttggtcaggaagtgctttgattctatgagcaggcttgatccaaggattattcgaccatttatagcagaatgccgtcaaactattgccaaacttgataatcagaatatgaaagccattaaaggacttgaagatcggctctacgccctggaccagatgattgctagctgtggccgactggtgaatgaacagaaagagcttgctcagggatttttagctaatcagaagagagctgaaaacttaaaggatgcatctgtattacctgatttatgcctgagtcacgcaaatcagttgatgattatgttgcaaaatcatagaaaactgttagatattaagcagaagtgtaccactgccaaacaagaactagcaaataacctacatgtcagactgaagtggtgttgctttgtaatgcttcatgctgatcaagatggagagaagttacaagctttgctccgcctcgtaatagagctgttagaaagagtcaaaattgttgaagctcttagtacagttcctcagatgtactgcttagctgttgttgaggttgtaagaagaaaaatgttcataaaacactacagggagtgggctggtgctttagtcaaagatggaaagagattatatgaagcagaaaaatcaaaaagggaatcctttgggaaattatttaggaagtcttttttaagaaatcgtctgtttaggggactggactcctggcccccttccttttgtactcaaaagcctcgaaagtttgactgtgaacttccagatatttcattaaaagatttacagtttctgcaatcattttgtccttcggaagttcagccattcctcagggttcccttactttgtgactttgaacctctacaccagcatgtacttgctctacataatttggtaaaagcagcacaaagtttggatgaaatgtcacagaccattacagatctactgagtgaacaaaaggcatctgtgagtcagacatccccacagtctgcttcttcaccaaggatggaaagtacagcaggaattacaactactacctcaccgagaactcctccaccactgactgttcaggatcccttatgtcctgcagtttgtcccttagaagaattatctccagatagtattgatgcacatacgtttgattttgaaactattccccatccaaacatagaacagactattcaccaagtttctttagacttggattcattagcagaaagtcctgaatcagattttatgtctgctgtgaatgagtttgtaatagaagaaaatttgtcgtctcctaatcctataagtgatccacaaagcccagaaatgatggtggaatcactttattcatcagttatcaatgcgatagacagtagacgaatgcaggatacaaatgtatgtggtaaggaggattttggagatcatacttctctgaatgtccagttggaaagatgtagagttgttgcccaagactctcacttcagtatacaaaccattaaggaagacctttgccactttagaacatttgtacaaaaagaacagtgtgacttctcaaattcattaaaatgtacagcagtagaaataagaaacattattgaaaaagtaaaatgttctctggaaataacactaaaagaaaaacatcaaaaagaactactgtctttaaaaaatgaatatgaaggtaaacttgacggactaataaaggaaactgaagagaatgaaaacaaaattaaaaaattgaagggagagttagtatgccttgaggaggttttacaaaataaagataatgaatttgctttggttaaacatgaaaaagaagctgtaatctgcctgcagaatgaaaaggatcagaagttgttagagatggaaaatataatgcactctcaaaattgtgaaattaaagaactgaagcagtcacgagaaatagtgttagaagacttaaaaaagctccatgttgaaaatgatgagaagttacagttattgagggcagaacttcagtccttggagcaaagtcatctaaaggaattagaggacacacttcaggttaggcacatacaagagtttgagaaggttatgacagaccacagagtttctttggaggaattaaaaaaggaaaaccaacaaataattaatcaaatacaagaatctcatgctgaaattatccaggaaaaagaaaaacagttacaggaattaaaactcaaggtttctgatttgtcagacacgagatgcaagttagaggttgaacttgcgttgaaggaagcagaaactgatgaaataaaaattttgctggaagaaagcagagcccagcagaaggagaccttgaaatctcttcttgaacaagagacagaaaatttgagaacagaaattagtaaactcaaccaaaagattcaggataataatgaaaattatcaggtgggcttagcagagctaagaactttaatgacaattgaaaaagatcagtgtatttccgagttaattagtagacatgaagaagaatctaatatacttaaagctgaattaaacaaagtaacatctttgcataaccaagcatttgaaatagaaaaaaacctaaaagaacaaataattgaactgcagagtaaattggattcagaattgagtgctcttgaaagacaaaaagatgaaaaaattacccaacaagaagagaaatacgaagctattatccagaaccttgagaaagacagacaaaaattggtcagcagccaggagcaagacagagaacagttaattcagaagcttaattgtgaaaaagatgaagctattcagactgccctaaaagaatttaaattggagagagaagttgttgagaaagagttattagaaaaagttaaacatcttgagaatcaaatagcaaaaagtcctgccattgactctaccagaggagattcttcaagcttagttgctgaacttcaagaaaagcttcaggaagaaaaagctaagtttctagaacaacttgaagagcaagaaaaaagaaagaatgaagaaatgcaaaatgttcgaacatctttgattgcggaacaacagaccaattttaacactgttttaacaagagagaaaatgagaaaagaaaacataataaatgatcttagtgataagttgaaaagtacaatgcagcaacaagaacgggataaagatttgatagagtcactttctgaagatcgagctcgtttgcttgaggaaaagaaaaagcttgaagaagaagtcagtaagttgcgtagtagcagttttgttccttcaccatatgtagctacagccccagaactttatggagcttgtgcacctgaactcccaggtgaatcagatagatccgctgtggaaacagcagatgaaggaagagtggattcagcaatggagacaagcatgatgtctgtacaagaaaatattcatatgttgtctgaagaaaaacagcggataatgctgttagaacgaacattgcaattgaaagaagaagaaaataaacggttaaatcaaagactgatgtctcagagcatgtcttcagtatcttcaaggcattctgaaaagatagctattagagattttcaggtgggagatttggtactcatcatcctagacgaacgccatgacaattatgtgttatttactgttagtcctactttatattttctacattcagagtctctacctgccctggatctcaaaccagcttcaggtgcatctagaagaccctgggtacttggaaaagtaatggaaaaagaatactgtcaagccaaaaaggcacaaaacagatttaaagttcctttggggacaaagttttacagagtgaaagccgtatcatggaataagaaagtataa

SEQ ID NO: 3607 - DNA, 2584 bp, Homo sapiens
gagctcgggcggccggagctggtcgctgcgcgcgccggggggagggccggggctgcgagagaggaagctctttcgcggcgctacggcgttggcaccagtctctagaaaagaagtcagctctggttcggagaagcagcggctggcgtgggccatccggggaatgggcgccctcgtgacctagtgttgcggggcaaaaagggtcttgccggcctcgctcgtgcaggggcgtatctgggcgcctgagcgcggcgtgggagccttgggagccgccgcagcagggggcacacccggaaccggcctgagcgcccgggaccatgaacggggaggccatctgcagcgccctgcccaccattccctaccacaaactcgccgacctgcgctacctgagccgcggcgcctctggcactgtgtcgtccgcccgccacgcagactggcgcgtccaggtggccgtgaagcacctgcacatccacactccgctgctcgacagtgaaagaaaggatgtcttaagagaagctgaaattttacacaaagctagatttagttacattcttccaattttgggaatttgcaatgagcctgaatttttgggaatagttactgaatacatgccaaatggatcattaaatgaactcctacataggaaaactgaatatcctgatgttgcttggccattgagatttcgcatcctgcatgaaattgcccttggtgtaaattacctgcacaatatgactcctcctttacttcatcatgacttgaagactcagaatatcttattggacaatgaatttcatgttaagattgcagattttggtttatcaaagtggcgcatgatgtccctctcacagtcacgaagtagcaaatctgcaccagaaggagggacaattatctatatgccacctgaaaactatgaacctggacaaaaatcaagggccagtatcaagcacgatatatatagctatgcagttatcacatgggaagtgttatccagaaaacagccttttgaagatgtcaccaatcctttgcagataatgtatagtgtgtcacaaggacatcgacctgttattaatgaagaaagtttgccatatgatatacctcaccgagcacgtatgatctctctaatagaaagtggatgggcacaaaatccagatgaaagaccatctttcttaaaatgtttaatagaacttgaaccagttttgagaacatttgaagagataacttttcttgaagctgttattcagctaaagaaaacaaagttacagagtgtttcaagtgccattcacctatgtgacaagaagaaaatggaattatctctgaacatacctgtaaatcatggtccacaagaggaatcatgtggatcctctcagctccatgaaaatagtggttctcctgaaacttcaaggtccctgccagctcctcaagacaatgattttttatctagaaaagctcaagactgttattttatgaagctgcatcactgtcctggaaatcacagttgggatagcaccatttctggatctcaaagggctgcattctgtgatcacaagaccactccatgctcttcagcaataataaatccactctcaactgcaggaaactcagaacgtctgcagcctggtatagcccagcagtggatccagagcaaaagggaagacattgtgaaccaaatgacagaagcctgccttaaccagtcgctagatgcccttctgtccagggacttgatcatgaaagaggactatgaacttgttagtaccaagcctacaaggacctcaaaagtcagacaattactagacactactgacatccaaggagaagaatttgccaaagttatagtacaaaaattgaaagataacaaacaaatgggtcttcagccttacccggaaatacttgtggtttctagatcaccatctttaaatttacttcaaaataaaagcatgtaagtgactgtttttcaagaagaaatgtgtttcataaaaggatatttatatctctgttgctttgactttttttatataaaatccgtgagtattaaagctttattgaaggttctttgggtaaatattagtctccctccatgacactgcagtattttttttaattaatacaagtaaaaagtttgaattttgctacatagttcaatttttatgtctcttttgttaacagaaaccacttttaaaggatagtaattattcttgtttataacagtgccttaaggtatgatgtatttctgatggaagccattttcacattcatgttcttcatggattatttgttacttgtctaagatgcaatttgattttatgaagtatataccctttacccaccagagacagtacagaatccctgccctaaaatcccaggcttaattgccctacaaagggttattaatttaaaactccattattaggattacattttaaagttttatttatgaattccctttaaaaatgatatttcaaaggtaaaacaatacaatataaagaaaaaaataaatatattaataccggcttcctgtccccatttttaacctcagccttccctactgtcaccaacaaccaagctaaataaagtcaacagcctgatgtgt

SEQ ID NO: 3608 - DNA, 1740 bp, Homo sapiens
gttggcaccagtctctagaaaagaagtcagctctggttcggagaagcagcggctggcgtgggccatccggggaatgggcgccctcgtgacctagtgttgcggggcaaaaagggtcttgccggcctcgctcgtgcaggggcgtatctgggcgcctgagcgcggcgtgggagccttgggagccgccgcagcagggggcacacccggaaccggcctgagcgcccgggaccatgaacggggaggccatctgcagcgccctgcccaccattccctaccacaaactcgccgacctgcgctacctgagccgcggcgcctctggcactgtgtcgtccgcccgccacgcagactggcgcgtccaggtggccgtgaagcacctgcacatccacactccgctgctcgacagaaaactgaatatcctgatgttgcttggccattgagatttcgcatcctgcatgaaattgcccttggtgtaaattacctgcacaatatgactcctcctttacttcatcatgacttgaagactcagaatatcttattggacaatgaatttcatgttaagattgcagattttggtttatcaaagtggcgcatgatgtccctctcacagtcacgaagtagcaaatctgcaccagaaggagggacaattatctatatgccacctgaaaactatgaacctggacaaaaatcaagggccagtatcaagcacgatatatatagctatgcagttatcacatgggaagtgttatccagaaaacagccttttgaagatgtcaccaatcctttgcagataatgtatagtgtgtcacaaggacatcgacctgttattaatgaagaaagtttgccatatgatatacctcaccgagcacgtatgatctctctaatagaaagtggatgggcacaaaatccagatgaaagaccatctttcttaaaatgtttaatagaacttgaaccagttttgagaacatttgaagagataacttttcttgaagctgttattcagctaaagaaaacaaagttacagagtgtttcaagtgccattcacctatgtgacaagaagaaaatggaattatctctgaacatacctgtaaatcatggtccacaagaggaatcatgtggatcctctcagctccatgaaaatagtggttctcctgaaacttcaaggtccctgccagctcctcaagacaatgattttttatctagaaaagctcaagactgttattttatgaagctgcatcactgtcctggaaatcacagttgggatagcaccatttctggatctcaaagggctgcattctgtgatcacaagaccactccatgctcttcagcaataataaatccactctcaactgcaggaaactcagaacgtctgcagcctggtatagcccagcagtggatccagagcaaaagggaagacattgtgaaccaaatgacagaagcctgccttaaccagtcgctagatgcccttctgtccagggacttgatcatgaaagaggactatgaacttgttagtaccaagcctacaaggacctcaaaagtcagacaattactagacactactgacatccaaggagaagaatttgccaaagttatagtacaaaaattgaaagataacaaacaaatgggtcttcagccttacccggaaatacttgtggtttctagatcaccatctttaaatttacttcaaaataaaagcatgtaagtgactgtttttcaagaagaaatgtgtttcataaaaggatattt

SEQ ID NO: 3609 - DNA, 11565 bp, Homo sapiens
ctcggcgggggcccgctcccaggcccgctcccgagcccgttccgctcccgtccgccttcttctcgccttctctccgcgtggctcctccgtcccggcgtctccaaaactgaatgagcgagcggcgcgtagggcgcgcggcggcggcggcggcggcggcggcatggagcgcagtggctgggcccggcagactttcctcctagcgctgttgctgggggcgacgctgagggcgcgcgcggcggctggctattacccccgcttttcgcccttctttttcctgtgcacccaccacggggagctggaaggggatggggagcagggcgaggtgctcatttccctgcatattgcgggcaaccccacctactacgttccgggacaagaataccatgtgacaatttcaacaagcaccttttttgacggcttgctggtgacaggactatacacatctacaagtgttcaggcatcacagagcattggaggttccagtgctttcggatttgggatcatgtctgaccaccagtttggtaaccagtttatgtgcagtgtggtagcctctcacgtgagtcacctgcccacaaccaacctcagtttcatctggattgctccacctgcgggcacaggctgtgtgaatttcatggctacagcaacacaccggggccaggttattttcaaagatgctttagcccagcagttgtgtgaacaaggagctccaacagatgtcactgtgcacccacatctagctgaaatacatagtgacagcattatcctgagagatgactttgactcctaccaccaactgcaattaaatccaaatatatgggttgaatgtaacaactgtgagactggagaacagtgtggcgcgattatgcatggcaatgccgtcaccttctgtgaaccatatggcccacgagaactgattaccacaggccttaatacaacaacagcttctgtcctccaattttccattgggtcaggttcatgtcgctttagttattcagaccccagcatcatcgtgttatatgccaagaataactctgcggactggattcagctagagaaaattagagccccttccaatgtcagcacaatcatccatatcctctaccttcctgaggacgccaaaggggagaatgtccaatttcagtggaagcaggaaaatcttcgtgtaggtgaagtgtatgaagcctgctgggccttagataacatcttgatcatcaattcagctcacagacaagtcgttttagaagatagtctcgacccagtggacacaggcaactggcttttcttcccaggagctacagttaagcatagctgtcagtcagatgggaactccatttatttccatggaaatgaaggcagcgagttcaattttgccaccaccagggatgtagatctttccacagaagatattcaagagcaatggtcagaagaatttgagagccagcctacaggatgggatgtcttgggagctgtcattggtacagaatgtggaacgatagaatcaggcttatcaatggtcttcctcaaagatggagagaggaaattatgcactccatccatggacactaccggttatgggaacctgaggttttactttgtgatgggaggaatttgtgaccctggaaattctcatgaaaatgacataatcctgtatgcaaaaattgaaggaagaaaagagcatataacactggataccctttcctattcctcatataaggttccgtctttggtttctgtggtcatcaatcctgaacttcagactcctgctaccaaattttgtctcaggcaaaagaaccatcaaggacataataggaatgtctgggctgtagactttttccatgtcttgcctgttctcccttctacaatgtctcacatgatacagttttccatcaatctgggatgtggaacgcatcagcctggtaacagtgtcagcttggaattttctaccaaccatgggcgctcctggtccctccttcacactgaatgcttacctgagatctgtgctggaccccacctcccccacagcactgtctactcctctgaaaactacagtgggtggaaccgaataacaattccccttcctaacgcagcactaacccggaacaccaggattcgctggagacaaacaggaccaatccttggaaacatgtgggcaattgataatgtttatattggcccgtcatgtctcaaattctgttctggcagaggacagtgcactagacatggttgcaagtgtgaccctggattttctggcccagcttgtgagatggcatcccagacattcccaatgtttatttctgaaagctttggcagttccaggctctcctcttaccataacttttactctatccgtggtgctgaagtcagctttggttgtggtgtcttggccagtggtaaggccctggttttcaacaaagatgggcggcgtcagctaattacatctttccttgacagctcacaatccaggtttctccagttcacactgagactggggagcaaatctgttctgagcacgtgcagagcccctgatcagcctggtgaaggagttttgttgcattattcttatgataatgggataacttggaaactcctggagcattattcatatctcagctatcatgagcccagaataatctccgtagaactaccaggtgatgcaaagcagtttggaattcagttcagatggtggcaaccgtatcattcttcccagagagaagatgtatgggctattgatgagattatcatgacatctgtgcttttcaacagcattagtcttgactttaccaatcttgtggaggtcactcagtctctgggattctaccttggaaatgttcagccatactgtggccacgactggaccctttgttttacaggagattctaaacttgcctcaagtatgcgctatgtggaaacacaatcaatgcagataggagcatcctatatgattcagttcagtttggtgatgggatgtggccagaaatacaccccacacatggacaaccaggtgaagctggagtactcaaccaaccacggccttacctggcacctcgtccaagaagaatgccttccaagtatgccaagttgtcaggaatttacatcagcaagtatttaccatgccagtgagtttacacagtggaggagagtcatagtgcttcttccccagaaaacttggtccagtgctacccgtttccgctggagccagagctattacacagctcaagacgagtgggctttggacagcatttacattgggcagcagtgccccaacatgtgcagtgggcatggctcatgcgatcatggcatatgcaggtgtgaccaggggtaccaaggcactgaatgccacccagaagctgcccttccgtccacaattatgtcagattttgagaaccagaatggctgggagtctgactggcaagaagttattgggggagaaattgtaaaaccagaacaagggtgtggtgtcatctcttctggatcatctctgtacttcagcaaggctgggaaaagacagctggtgagttgggacctggatacttcttgggtggactttgtccagttctacatccagataggcggagagagtgcttcatgcaacaagcctgacagcagagaggagggcgtcctccttcagtacagcaacaatgggggcatccagtggcacctgctagcagagatgtacttttcagacttcagcaaacccagatttgtctatctggagcttccagctgctgccaagaccccttgcaccaggttccgctggtggcagcccgtgttctcaggggaggactatgaccagtgggcagtcgatgacatcatcattctgtccgagaagcagaagcagatcatcccagttatcaatccaactttacctcagaacttttatgagaagccagcttttgattaccctatgaatcagatgagtgtgtggttgatgttggctaatgaaggaatggttaaaaatgaaaccttctgtgctgccacaccatcagcaatgatatttggaaaatcagatggagatcgatttgcagtaactcgagatttgaccctgaaacctggatatgtgctacagttcaagctaaacataggttgtgccaatcaattcagcagtactgctccagttcttcttcagtactctcatgatgctggtatgtcctggtttctggtgaaagaaggctgttacccggcttctgcaggcaaaggatgcgaaggaaactccagagaactaagtgagcccaccatgtatcacacaggggactttgaagaatggacaagaatcaccattgttattccaaggtctcttgcatccagcaagaccagattccgatggatccaggagagcagctcacagaaaaacgtgcctccatttggtttagatggagtgtacatatccgagccttgtcccagttactgcagtggccatggggactgcatttcaggagtgtgtttctgtgacctgggatatactgctgcacaaggaacctgtgtgtcaaatgtccccaatcacaatgagatgttcgataggtttgaggggaagctcagccctctgtggtacaagataacaggtgcccaggttggaactggctgtggaacacttaacgatggcaaatctctctacttcaatggccctgggaaaagggaagcccggacggtccctctggacaccaggaatatcagacttgttcaattttatatacaaattggaagcaaaacttcaggcattacctgcatcaaaccaagaactagaaatgaagggcttattgttcagtattcaaatgacaatgggatactctggcatttgcttcgagagttggacttcatgtccttcctggaaccacagatcatttccattgacctgccacaggacgcgaagacacctgcaacggcatttcgatggtggcaaccgcaacatgggaagcattcagcccagtgggctttggatgatgttcttataggaatgaatgacagctctcaaactggatttcaagacaaatttgatggctctatagatttgcaagccaactggtatcgaatccaaggaggtcaagttgatattgactgtctctctatggatactgctctgatattcactgaaaacataggaaaacctcgttatgctgagacctgggattttcatgtgtcagcatctacctttttgcagtttgaaatgagcatgggctgtagcaagcccttcagcaactcccacagtgtacagctccagtattctctgaacaatggcaaggactggcatcttgtcaccgaagagtgtgttcctccaaccattggctgtctgcattacacggaaagttcaatttacacctcggaaagattccagaattggaagcggatcactgtctaccttccactctccaccatttctcccaggacccggttcagatggattcaggccaactacactgtgggggctgattcctgggcgattgataatgttgtactggcctcagggtgcccttggatgtgctcaggacgagggatttgtgatgctggacgctgtgtgtgtgaccggggctttggtggaccctattgtgttcctgttgttcctctgccctcgattcttaaagacgatttcaatgggaatttacatcctgacctttggcctgaagtgtatggtgcagagagggggaatctgaatggtgaaaccatcaaatctggaacatctctaatttttaaaggggaaggactaaggatgcttatttcaagagatctagattgtacaaatacaatgtatgtccagttttcacttagatttatagcaaaaagtaccccagagagatctcactctattctgttacaattctccatcagtggaggaatcacttggcacctgatggatgaattttactttcctcaaacaacgaatatacttttcatcaatgttcccttgccatacactgcccaaaccaatgctacaagattcagactctggcaaccttataataacggtaagaaagaagaaatctggattgttgatgacttcattatcgatggaaataatgtaaacaaccctgtgatgctcttggatacatttgattttgggcccagagaagacaattggtttttctatcctggtggtaacatcggtctttattgtccatattcttcaaagggggcacctgaagaagattcagctatggtgtttgtttcaaatgaagttggtgagcattccattaccacccgtgacctaaatgtgaatgagaacaccatcatacaatttgagatcaacgttggctgttcgactgatagctcatccgcggatccagtgagactggaattttcaagggacttcggggcgacctggcaccttctgctgcccctctgctaccacagcagcagccacgtcagctctttatgctccaccgagcaccaccccagcagcacctactacgcaggaaccatgcagggctggaggagggaggtcgtgcactttgggaagctgcacctttgtggatctgtccgtttcagatggtaccagggattttaccctgccggctctcagccagtgacatgggccattgataatgtctacatcggtccccagtgtgaggagatgtgtaatggacaggggagctgtatcaatggaaccaaatgtatatgtgaccctggctactcaggtccaacctgtaaaataagcaccaaaaatcctgattttctcaaagatgatttcgaaggtcagctagaatctgatagattcttattaatgagtggtgggaaaccatctcgaaagtgtggaatcctttctagtggaaacaacctctttttcaatgaagatggcttgcgcatgttgatgacacgagacctggatttatcacatgctagatttgtgcagttcttcatgagactgggatgtggtaaaggcgttcctgaccccaggagtcaacccgtgctcctacagtattctctcaacggtggcctctcgtggagtcttcttcaggagttccttttcagcaattccagcaatgtgggcaggtacattgccctggagatacccttgaaagcccgttctggttctactcgccttcgctggtggcaaccgtctgagaatgggcacttctacagcccctgggttatcgatcagattcttattggaggaaatatttctggtaatacggtcttggaagatgatttcacaacccttgatagtaggaaatggctgcttcacccaggaggcaccaagatgcccgtgtgtggctctactggtgatgccctggtcttcattgaaaaggccagcacccgttacgtggtcagcacagacgttgccgtgaatgaggattccttcctacagatagacttcgctgcctcctgctcagtcacagactcttgttatgcgattgaattggaatactcagtagatcttggattgtcatggcacccattggtaagggactgtctgcctaccaatgtggaatgcagtcgctatcatctgcaacggatcctggtgtcagacactttcaacaagtggactagaatcactctgcctctccctccttataccaggtcccaagccactcgtttccgttggcatcaaccagctccttttgacaagcagcagacatgggcaatagataatgtctatatcggggatggctgcatagacatgtgcagtggccatgggagatgcatccagggaaactgcgtctgtgatgaacagtggggtggcctgtactgtgatgaccccgagacctctcttccaacccaactcaaagacaacttcaatcgagctccatccagtcagaactggctgactgtgaacggagggaaattgagtacagtgtgtggagccgtggcgtcgggaatggctctccatttcagtgggggttgtagtcgattattagtcactgtggatctaaacctcactaatgctgagttcatccaattttacttcatgtatgggtgcctgattacaccaaacaaccgtaaccaaggtgttctcttggaatattctgtcaatggaggcattacctggaacctgctcatggagattttctatgaccagtacagtaagcccggatttgtgaatatccttctccctcctgatgctaaagagattgccactcgcttccgctggtggcagccaagacatgacggcctggatcagaacgactgggccattgacaatgtcctcatctcaggctctgctgaccaaaggaccgttatgctggacaccttcagcagcgccccagtaccccagcatgagcgctcccctgcagatgccggccctgtcgggaggatcgcctttgacatgtttatggaagacaaaacttcagtgaatgagcactggctattccatgatgattgtacagtagaaagattctgtgactcccctgatggtgtgatgctctgtggcagtcatgatggacgggaggtgtatgcagtgacccatgacctgactcccactgaaggctggattatgcaattcaagatctcagttggatgtaaggtgtctgaaaaaattgcccagaatcaaattcatgtgcagtattctactgacttcggtgtgagttggaattatctggtccctcagtgcttgcctgctgacccaaaatgctctggaagtgtttctcagccatctgtattctttccaactaaagggtggaaaaggatcacctacccacttcctgaaagcttagtgggaaatccggtaaggtttaggttctatcagaagtactcagacatgcagtgggcaatcgataatttctacctgggccctggatgcttggacaactgcaggggccatggagattgcttaagggaacagtgcatctgtgatccgggatactcagggccaaactgctacttgacccacactctgaagactttcctgaaggaacgctttgacagtgaagaaatcaaacctgacttatggatgtccttagaaggtggaagtacttgcactgagtgtggaattcttgccgaggacactgcactctattttgggggatccactgtgagacaagcggttacacaagatttggatcttcgaggtgcaaagttcctgcaatactgggggcgcatcggtagtgagaacaacatgacctcttgccatcgtcccatctgccggaaggaaggcgtgctgttggactactctaccgatggaggaattacctggactttgctccatgagatggattaccagaaatacatttctgttagacacgactacatacttcttcctgaagatgccctcaccaacacaactcgacttcgctggtggcagccttttgtgatcagcaatggaattgtggtctctggggtggagcgtgctcagtgggcactggacaacattttgattggtggagcagaaatcaatcccagccaattggtggacacttttgatgatgaaggcacttcccatgaagaaaactggagtttttaccctaatgctgtaaggacagcaggattttgtggcaatccatcctttcacctctattggccaaataaaaagaaggacaagactcacaatgctctctcctcccgagaactcattatacagccaggatacatgatgcagtttaaaattgtggtgggttgtgaagccacttcttgtggtgaccttcattccgtaatgctggaatacactaaggatgcaagatcggattcctggcagctcgtacagacccagtgccttccttcctcttctaacagcattggctgctcccctttccagttccatgaagccaccatctacaactctgtcaacagctcaagctggaaaagaatcaccatccagctgcctgaccatgtctcctctagtgcaacacagttccgctggatccagaagggagaagaaactgagaagcaaagctgggcaattgaccacgtgtacattggagaggcttgccccaagctctgcagcgggcacggatactgcacgaccggtgccatctgcatctgcgacgagagcttccaaggtgatgactgctctgttttcagtcacgaccttcccagttatattaaagataattttgagtccgcaagagtcaccgaggcaaactgggagaccattcaaggtggagtcataggaagtggctgtgggcagctggccccctacgcccatggagactcactgtactttaatggctgtcagatcaggcaagcagctaccaagcctctggatctcactcgagcaagcaaaatcatgtttgttttgcaaattgggagcatgtcgcagacggacagctgcaacagtgacctgagtggcccccacgctgtggacaaggcagtgctgctgcaatacagcgtcaacaacgggatcacctggcatgtcatcgcccagcaccagccaaaggacttcacacaagctcagagagtgtcttacaatgtccccctggaggcacggatgaaaggagtcttactgcgctggtggcaaccacgccacaatggaacaggtcatgatcaatgggctttggaccatgtggaggtcgtcctcactcgcaaacaaaattacatgatgaatttttcacgacaacatgggctcagacatttctacaacagaagacgaaggtcacttaggcgatacccatgaagaatcaaaaagtttattttttttcttccaacatgtgatgtgttgctctccattcttttaaatctcgcactacatctgatatcaggaaatatctgtgaaggacttggtgattacctgaaagcccttctcaagaccgagtgtacaccactttcccacactgtgaactaatgacaagtgacttatttgctcataagtaaatgtcttcatgttgatgtgtccgtgaaagttgtgatctgttgtaatatcagttacagtggcagtattgacaataagaaacagtttaacagaaaaatgaaatttaagcacaaaaaatttaagagattttatgtttaaaatggcatttagcacagtatttaacattcttggtcacaaagctatttaagtggactgtatttcggctatgtctcatgttttatatgattaaattatcattgtttgtcctttatgtattctcttctacaatacaacacattgaaactgtatttacttgttatgttgtaatattttgctgctgaatttggggctacttatattctgcagaaaattaattgaaatacctattcaagaagatagttgtaaagatattgtatctcctttaatatactccttaaaaatgtatgttggtttagcgttgttttgtggataagaaaaatgcttgaccctgaaatattttctactttaaattgtggatgaagaccctatctcccacaaataagttcccatttccttgtctaaagatctttttttaagtgttctgtggctgatttactaacagtaactgccattttttgtctgtgataacagagtgatttgtaaaacagtggttgttttttcattgtgttttcttcgtggattgttttttctgcgggtcatattcataccttctgatgaagttgtacaacaccagcaacattataatggccctgtagctctgaatgctatttgtgtaactgaaaggttgcactctagggtgaaccaagctataaaagcccatgcttaaataaaaattatgtccaaaagccattgaa

SEQ ID NO: 3610 - DNA, 11571 bp, Homo sapiens
ctcggcgggggcccgctcccaggcccgctcccgagcccgttccgctcccgtccgccttcttctcgccttctctccgcgtggctcctccgtcccggcgtctccaaaactgaatgagcgagcggcgcgtagggcgcgcggcggcggcggcggcggcggcggcatggagcgcagtggctgggcccggcagactttcctcctagcgctgttgctgggggcgacgctgagggcgcgcgcggcggctggctattacccccgcttttcgcccttctttttcctgtgcacccaccacggggagctggaaggggatggggagcagggcgaggtgctcatttccctgcatattgcgggcaaccccacctactacgttccgggacaagaataccatgtgacaatttcaacaagcaccttttttgacggcttgctggtgacaggactatacacatctacaagtgttcaggcatcacagagcattggaggttccagtgctttcggatttgggatcatgtctgaccaccagtttggtaaccagtttatgtgcagtgtggtagcctctcacgtgagtcacctgcccacaaccaacctcagtttcatctggattgctccacctgcgggcacaggctgtgtgaatttcatggctacagcaacacaccggggccaggttattttcaaagatgctttagcccagcagttgtgtgaacaaggagctccaacagatgtcactgtgcacccacatctagctgaaatacatagtgacagcattatcctgagagatgactttgactcctaccaccaactgcaattaaatccaaatatatgggttgaatgtaacaactgtgagactggagaacagtgtggcgcgattatgcatggcaatgccgtcaccttctgtgaaccatatggcccacgagaactgattaccacaggccttaatacaacaacagcttctgtcctccaattttccattgggtcaggttcatgtcgctttagttattcagaccccagcatcatcgtgttatatgccaagaataactctgcggactggattcagctagagaaaattagagccccttccaatgtcagcacaatcatccatatcctctaccttcctgaggacgccaaaggggagaatgtccaatttcagtggaagcaggaaaatcttcgtgtaggtgaagtgtatgaagcctgctgggccttagataacatcttgatcatcaattcagctcacagacaagtcgttttagaagatagtctcgacccagtggacacaggcaactggcttttcttcccaggagctacagttaagcatagctgtcagtcagatgggaactccatttatttccatggaaatgaaggcagcgagttcaattttgccaccaccagggatgtagatctttccacagaagatattcaagagcaatggtcagaagaatttgagagccagcctacaggatgggatgtcttgggagctgtcattggtacagaatgtggaacgatagaatcaggcttatcaatggtcttcctcaaagatggagagaggaaattatgcactccatccatggacactaccggttatgggaacctgaggttttactttgtgatgggaggaatttgtgaccctggaaattctcatgaaaatgacataatcctgtatgcaaaaattgaaggaagaaaagagcatataacactggataccctttcctattcctcatataaggttccgtctttggtttctgtggtcatcaatcctgaacttcagactcctgctaccaaattttgtctcaggcaaaagaaccatcaaggacataataggaatgtctgggctgtagactttttccatgtcttgcctgttctcccttctacaatgtctcacatgatacagttttccatcaatctgggatgtggaacgcatcagcctggtaacagtgtcagcttggaattttctaccaaccatgggcgctcctggtccctccttcacactgaatgcttacctgagatctgtgctggaccccacctcccccacagcactgtctactcctctgaaaactacagtgggtggaaccgaataacaattccccttcctaacgcagcactaacccggaacaccaggattcgctggagacaaacaggaccaatccttggaaacatgtgggcaattgataatgtttatattggcccgtcatgtctcaaattctgttctggcagaggacagtgcactagacatggttgcaagtgtgaccctggattttctggcccagcttgtgagatggcatcccagacattcccaatgtttatttctgaaagctttggcagttccaggctctcctcttaccataacttttactctatccgtggtgctgaagtcagctttggttgtggtgtcttggccagtggtaaggccctggttttcaacaaagatgggcggcgtcagctaattacatctttccttgacagctcacaatccaggtttctccagttcacactgagactggggagcaaatctgttctgagcacgtgcagagcccctgatcagcctggtgaaggagttttgttgcattattcttatgataatgggataacttggaaactcctggagcattattcatatctcagctatcatgagcccagaataatctccgtagaactaccaggtgatgcaaagcagtttggaattcagttcagatggtggcaaccgtatcattcttcccagagagaagatgtatgggctattgatgagattatcatgacatctgtgcttttcaacagcattagtcttgactttaccaatcttgtggaggtcactcagtctctgggattctaccttggaaatgttcagccatactgtggccacgactggaccctttgttttacaggagattctaaacttgcctcaagtatgcgctatgtggaaacacaatcaatgcagataggagcatcctatatgattcagttcagtttggtgatgggatgtggccagaaatacaccccacacatggacaaccaggtgaagctggagtactcaaccaaccacggccttacctggcacctcgtccaagaagaatgccttccaagtatgccaagttgtcaggaatttacatcagcaagtatttaccatgccagtgagtttacacagtggaggagagtcatagtgcttcttccccagaaaacttggtccagtgctacccgtttccgctggagccagagctattacacagctcaagacgagtgggctttggacagcatttacattgggcagcagtgccccaacatgtgcagtgggcatggctcatgcgatcatggcatatgcaggtgtgaccaggggtaccaaggcactgaatgccacccagaagctgcccttccgtccacaattatgtcagattttgagaaccagaatggctgggagtctgactggcaagaagttattgggggagaaattgtaaaaccagaacaagggtgtggtgtcatctcttctggatcatctctgtacttcagcaaggctgggaaaagacagctggtgagttgggacctggatacttcttgggtggactttgtccagttctacatccagataggcggagagagtgcttcatgcaacaagcctgacagcagagaggagggcgtcctccttcagtacagcaacaatgggggcatccagtggcacctgctagcagagatgtacttttcagacttcagcaaacccagatttgtctatctggagcttccagctgctgccaagaccccttgcaccaggttccgctggtggcagcccgtgttctcaggggaggactatgaccagtgggcagtcgatgacatcatcattctgtccgagaagcagaagcagatcatcccagttatcaatccaactttacctcagaacttttatgagaagccagcttttgattaccctatgaatcagatgagtgtgtggttgatgttggctaatgaaggaatggttaaaaatgaaaccttctgtgctgccacaccatcagcaatgatatttggaaaatcagatggagatcgatttgcagtaactcgagatttgaccctgaaacctggatatgtgctacagttcaagctaaacataggttgtgccaatcaattcagcagtactgctccagttcttcttcagtactctcatgatgctggtatgtcctggtttctggtgaaagaaggctgttacccggcttctgcaggcaaaggatgcgaaggaaactccagagaactaagtgagcccaccatgtatcacacaggggactttgaagaatggacaagaatcaccattgttattccaaggtctcttgcatccagcaagaccagattccgatggatccaggagagcagctcacagaaaaacgtgcctccatttggtttagatggagtgtacatatccgagccttgtcccagttactgcagtggccatggggactgcatttcaggagtgtgtttctgtgacctgggatatactgctgcacaaggaacctgtgtgtcaaatgtccccaatcacaatgagatgttcgataggtttgaggggaagctcagccctctgtggtacaagataacaggtgcccaggttggaactggctgtggaacacttaacgatggcaaatctctctacttcaatggccctgggaaaagggaagcccggacggtccctctggacaccaggaatatcagacttgttcaattttatatacaaattggaagcaaaacttcaggcattacctgcatcaaaccaagaactagaaatgaagggcttattgttcagtattcaaatgacaatgggatactctggcatttgcttcgagagttggacttcatgtccttcctggaaccacagatcatttccattgacctgccacaggacgcgaagacacctgcaacggcatttcgatggtggcaaccgcaacatgggaagcattcagcccagtgggctttggatgatgttcttataggaatgaatgacagctctcaaactggatttcaagacaaatttgatggctctatagatttgcaagccaactggtatcgaatccaaggaggtcaagttgatattgactgtctctctatggatactgctctgatattcactgaaaacataggaaaacctcgttatgctgagacctgggattttcatgtgtcagcatctacctttttgcagtttgaaatgagcatgggctgtagcaagcccttcagcaactcccacagtgtacagctccagtattctctgaacaatggcaaggactggcatcttgtcaccgaagagtgtgttcctccaaccattggctgtctgcattacacggaaagttcaatttacacctcggaaagattccagaattggaagcggatcactgtctaccttccactctccaccatttctcccaggacccggttcagatggattcaggccaactacactgtgggggctgattcctgggcgattgataatgttgtactggcctcagggtgcccttggatgtgctcaggacgagggatttgtgatgctggacgctgtgtgtgtgaccggggctttggtggaccctattgtgttcctgttgttcctctgccctcgattcttaaagacgatttcaatgggaatttacatcctgacctttggcctgaagtgtatggtgcagagagggggaatctgaatggtgaaaccatcaaatctggaacatctctaatttttaaaggggaaggactaaggatgcttatttcaagagatctagattgtacaaatacaatgtatgtccagttttcacttagatttatagcaaaaagtaccccagagagatctcactctattctgttacaattctccatcagtggaggaatcacttggcacctgatggatgaattttactttcctcaaacaacgaatatacttttcatcaatgttcccttgccatacactgcccaaaccaatgctacaagattcagactctggcaaccttataataacggtaagaaagaagaaatctggattgttgatgacttcattatcgatggaaataatgtaaacaaccctgtgatgctcttggatacatttgattttgggcccagagaagacaattggtttttctatcctggtggtaacatcggtctttattgtccatattcttcaaagggggcacctgaagaagattcagctatggtgtttgtttcaaatgaagttggtgagcattccattaccacccgtgacctaaatgtgaatgagaacaccatcatacaatttgagatcaacgttggctgttcgactgatagctcatccgcggatccagtgagactggaattttcaagggacttcggggcgacctggcaccttctgctgcccctctgctaccacagcagcagccacgtcagctctttatgctccaccgagcaccaccccagcagcacctactacgcaggaaccatgcagggctggaggagggaggtcgtgcactttgggaagctgcacctttgtggatctgtccgtttcagatggtaccagggattttaccctgccggctctcagccagtgacatgggccattgataatgtctacatcggtccccagtgtgaggagatgtgtaatggacaggggagctgtatcaatggaaccaaatgtatatgtgaccctggctactcaggtccaacctgtaaaataagcaccaaaaatcctgattttctcaaagatgatttcgaaggtcagctagaatctgatagattcttattaatgagtggtgggaaaccatctcgaaagtgtggaatcctttctagtggaaacaacctctttttcaatgaagatggcttgcgcatgttgatgacacgagacctggatttatcacatgctagatttgtgcagttcttcatgagactgggatgtggtaaaggcgttcctgaccccaggagtcaacccgtgctcctacagtattctctcaacggtggcctctcgtggagtcttcttcaggagttccttttcagcaattccagcaatgtgggcaggtacattgccctggagatacccttgaaagcccgttctggttctactcgccttcgctggtggcaaccgtctgagaatgggcacttctacagcccctgggttatcgatcagattcttattggaggaaatatttctggtaatacggtcttggaagatgatttcacaacccttgatagtaggaaatggctgcttcacccaggaggcaccaagatgcccgtgtgtggctctactggtgatgccctggtcttcattgaaaaggccagcacccgttacgtggtcagcacagacgttgccgtgaatgaggattccttcctacagatagacttcgctgcctcctgctcagtcacagactcttgttatgcgattgaattggaatactcagtagatcttggattgtcatggcacccattggtaagggactgtctgcctaccaatgtggaatgcagtcgctatcatctgcaacggatcctggtgtcagacactttcaacaagtggactagaatcactctgcctctccctccttataccaggtcccaagccactcgtttccgttggcatcaaccagctccttttgacaagcagcagacatgggcaatagataatgtctatatcggggatggctgcatagacatgtgcagtggccatgggagatgcatccagggaaactgcgtctgtgatgaacagtggggtggcctgtactgtgatgaccccgagacctctcttccaacccaactcaaagacaacttcaatcgagctccatccagtcagaactggctgactgtgaacggagggaaattgagtacagtgtgtggagccgtggcgtcgggaatggctctccatttcagtgggggttgtagtcgattattagtcactgtggatctaaacctcactaatgctgagttcatccaattttacttcatgtatgggtgcctgattacaccaaacaaccgtaaccaaggtgttctcttggaatattctgtcaatggaggcattacctggaacctgctcatggagattttctatgaccagtacagtaagcccggatttgtgaatatccttctccctcctgatgctaaagagattgccactcgcttccgctggtggcagccaagacatgacggcctggatcagaacgactgggccattgacaatgtcctcatctcaggctctgctgaccaaaggaccgttatgctggacaccttcagcagcgccccagtaccccagcatgagcgctcccctgcagatgccggccctgtcgggaggatcgcctttgacatgtttatggaagacaaaacttcagtgaatgagcactggctattccatgatgattgtacagtagaaagattctgtgactcccctgatggtgtgatgctctgtggcagtcatgatggacgggaggtgtatgcagtgacccatgacctgactcccactgaaggctggattatgcaattcaagatctcagttggatgtaaggtgtctgaaaaaattgcccagaatcaaattcatgtgcagtattctactgacttcggtgtgagttggaattatctggtccctcagtgcttgcctgctgacccaaaatgctctggaagtgtttctcagccatctgtattctttccaactaaagggtggaaaaggatcacctacccacttcctgaaagcttagtgggaaatccggtaaggtttaggttctatcagaagtactcagacatgcagtgggcaatcgataatttctacctgggccctggatgcttggacaactgcaggggccatggagattgcttaagggaacagtgcatctgtgatccgggatactcagggccaaactgctacttgacccacactctgaagactttcctgaaggaacgctttgacagtgaagaaatcaaacctgacttatggatgtccttagaaggtggaagtacttgcactgagtgtggaattcttgccgaggacactgcactctattttgggggatccactgtgagacaagcggttacacaagatttggatcttcgaggtgcaaagttcctgcaatactgggggcgcatcggtagtgagaacaacatgacctcttgccatcgtcccatctgccggaaggaaggcgtgctgttggactactctaccgatggaggaattacctggactttgctccatgagatggattaccagaaatacatttctgttagacacgactacatacttcttcctgaagatgccctcaccaacacaactcgacttcgctggtggcagccttttgtgatcagcaatggaattgtggtctctggggtggagcgtgctcagtgggcactggacaacattttgattggtggagcagaaatcaatcccagccaattggtggacacttttgatgatgaaggcacttcccatgaagaaaactggagtttttaccctaatgctgtaaggacagcaggattttgtggcaatccatcctttcacctctattggccaaataaaaagaaggacaagactcacaatgctctctcctcccgagaactcattatacagccaggatacatgatgcagtttaaaattgtggtgggttgtgaagccacttcttgtggtgaccttcattccgtaatgctggaatacactaaggatgcaagatcggattcctggcagctcgtacagacccagtgccttccttcctcttctaacagcattggctgctcccctttccagttccatgaagccaccatctacaactctgtcaacagctcaagctggaaaagaatcaccatccagctgcctgaccatgtctcctctagtgcaacacagttccgctggatccagaagggagaagaaactgagaagcaaagctgggcaattgaccacgtgtacattggagaggcttgccccaagctctgcagcgggcacggatactgcacgaccggtgccatctgcatctgcgacgagagcttccaaggtgatgactgctctgttttcagtcacgaccttcccagttatattaaagataattttgagtccgcaagagtcaccgaggcaaactgggagaccattcaaggtggagtcataggaagtggctgtgggcagctggccccctacgcccatggagactcactgtactttaatggctgtcagatcaggcaagcagctaccaagcctctggatctcactcgagcaagcaaaatcatgtttgttttgcaaattgggagcatgtcgcagacggacagctgcaacagtgacctgagtggcccccacgctgtggacaaggcagtgctgctgcaatacagcgtcaacaacgggatcacctggcatgtcatcgcccagcaccagccaaaggacttcacacaagctcagagagtgtcttacaatgtccccctggaggcacggatgaaaggagtcttactgcgctggtggcaaccacgccacaatggaacaggtcatgatcaatgggctttggaccatgtggaggtcgtcctatttagcactcgcaaacaaaattacatgatgaatttttcacgacaacatgggctcagacatttctacaacagaagacgaaggtcacttaggcgatacccatgaagaatcaaaaagtttattttttttcttccaacatgtgatgtgttgctctccattcttttaaatctcgcactacatctgatatcaggaaatatctgtgaaggacttggtgattacctgaaagcccttctcaagaccgagtgtacaccactttcccacactgtgaactaatgacaagtgacttatttgctcataagtaaatgtcttcatgttgatgtgtccgtgaaagttgtgatctgttgtaatatcagttacagtggcagtattgacaataagaaacagtttaacagaaaaatgaaatttaagcacaaaaaatttaagagattttatgtttaaaatggcatttagcacagtatttaacattcttggtcacaaagctatttaagtggactgtatttcggctatgtctcatgttttatatgattaaattatcattgtttgtcctttatgtattctcttctacaatacaacacattgaaactgtatttacttgttatgttgtaatattttgctgctgaatttggggctacttatattctgcagaaaattaattgaaatacctattcaagaagatagttgtaaagatattgtatctcctttaatatactccttaaaaatgtatgttggtttagcgttgttttgtggataagaaaaatgcttgaccctgaaatattttctactttaaattgtggatgaagaccctatctcccacaaataagttcccatttccttgtctaaagatctttttttaagtgttctgtggctgatttactaacagtaactgccattttttgtctgtgataacagagtgatttgtaaaacagtggttgttttttcattgtgttttcttcgtggattgttttttctgcgggtcatattcataccttctgatgaagttgtacaacaccagcaacattataatggccctgtagctctgaatgctatttgtgtaactgaaaggttgcactctagggtgaaccaagctataaaagcccatgcttaaataaaaattatgtccaaaagccattgaa

SEQ ID NO: 3611 - DNA, 11571 bp, Homo sapiens
ctcggcgggggcccgctcccaggcccgctcccgagcccgttccgctcccgtccgccttcttctcgccttctctccgcgtggctcctccgtcccggcgtctccaaaactgaatgagcgagcggcgcgtagggcgcgcggcggcggcggcggcggcggcggcatggagcgcagtggctgggcccggcagactttcctcctagcgctgttgctgggggcgacgctgagggcgcgcgcggcggctggctattacccccgcttttcgcccttctttttcctgtgcacccaccacggggagctggaaggggatggggagcagggcgaggtgctcatttccctgcatattgcgggcaaccccacctactacgttccgggacaagaataccatgtgacaatttcaacaagcaccttttttgacggcttgctggtgacaggactatacacatctacaagtgttcaggcatcacagagcattggaggttccagtgctttcggatttgggatcatgtctgaccaccagtttggtaaccagtttatgtgcagtgtggtagcctctcacgtgagtcacctgcccacaaccaacctcagtttcatctggattgctccacctgcgggcacaggctgtgtgaatttcatggctacagcaacacaccggggccaggttattttcaaagatgctttagcccagcagttgtgtgaacaaggagctccaacagatgtcactgtgcacccacatctagctgaaatacatagtgacagcattatcctgagagatgactttgactcctaccaccaactgcaattaaatccaaatatatgggttgaatgtaacaactgtgagactggagaacagtgtggcgcgattatgcatggcaatgccgtcaccttctgtgaaccatatggcccacgagaactgattaccacaggccttaatacaacaacagcttctgtcctccaattttccattgggtcaggttcatgtcgctttagttattcagaccccagcatcatcgtgttatatgccaagaataactctgcggactggattcagctagagaaaattagagccccttccaatgtcagcacaatcatccatatcctctaccttcctgaggacgccaaaggggagaatgtccaatttcagtggaagcaggaaaatcttcgtgtaggtgaagtgtatgaagcctgctgggccttagataacatcttgatcatcaattcagctcacagacaagtcgttttagaagatagtctcgacccagtggacacaggcaactggcttttcttcccaggagctacagttaagcatagctgtcagtcagatgggaactccatttatttccatggaaatgaaggcagcgagttcaattttgccaccaccagggatgtagatctttccacagaagatattcaagagcaatggtcagaagaatttgagagccagcctacaggatgggatgtcttgggagctgtcattggtacagaatgtggaacgatagaatcaggcttatcaatggtcttcctcaaagatggagagaggaaattatgcactccatccatggacactaccggttatgggaacctgaggttttactttgtgatgggaggaatttgtgaccctggaaattctcatgaaaatgacataatcctgtatgcaaaaattgaaggaagaaaagagcatataacactggataccctttcctattcctcatataaggttccgtctttggtttctgtggtcatcaatcctgaacttcagactcctgctaccaaattttgtctcaggcaaaagaaccatcaaggacataataggaatgtctgggctgtagactttttccatgtcttgcctgttctcccttctacaatgtctcacatgatacagttttccatcaatctgggatgtggaacgcatcagcctggtaacagtgtcagcttggaattttctaccaaccatgggcgctcctggtccctccttcacactgaatgcttacctgagatctgtgctggaccccacctcccccacagcactgtctactcctctgaaaactacagtgggtggaaccgaataacaattccccttcctaacgcagcactaacccggaacaccaggattcgctggagacaaacaggaccaatccttggaaacatgtgggcaattgataatgtttatattggcccgtcatgtctcaaattctgttctggcagaggacagtgcactagacatggttgcaagtgtgaccctggattttctggcccagcttgtgagatggcatcccagacattcccaatgtttatttctgaaagctttggcagttccaggctctcctcttaccataacttttactctatccgtggtgctgaagtcagctttggttgtggtgtcttggccagtggtaaggccctggttttcaacaaagatgggcggcgtcagctaattacatctttccttgacagctcacaatccaggtttctccagttcacactgagactggggagcaaatctgttctgagcacgtgcagagcccctgatcagcctggtgaaggagttttgttgcattattcttatgataatgggataacttggaaactcctggagcattattcatatctcagctatcatgagcccagaataatctccgtagaactaccaggtgatgcaaagcagtttggaattcagttcagatggtggcaaccgtatcattcttcccagagagaagatgtatgggctattgatgagattatcatgacatctgtgcttttcaacagcattagtcttgactttaccaatcttgtggaggtcactcagtctctgggattctaccttggaaatgttcagccatactgtggccacgactggaccctttgttttacaggagattctaaacttgcctcaagtatgcgctatgtggaaacacaatcaatgcagataggagcatcctatatgattcagttcagtttggtgatgggatgtggccagaaatacaccccacacatggacaaccaggtgaagctggagtactcaaccaaccacggccttacctggcacctcgtccaagaagaatgccttccaagtatgccaagttgtcaggaatttacatcagcaagtatttaccatgccagtgagtttacacagtggaggagagtcatagtgcttcttccccagaaaacttggtccagtgctacccgtttccgctggagccagagctattacacagctcaagacgagtgggctttggacagcatttacattgggcagcagtgccccaacatgtgcagtgggcatggctcatgcgatcatggcatatgcaggtgtgaccaggggtaccaaggcactgaatgccacccagaagctgcccttccgtccacaattatgtcagattttgagaaccagaatggctgggagtctgactggcaagaagttattgggggagaaattgtaaaaccagaacaagggtgtggtgtcatctcttctggatcatctctgtacttcagcaaggctgggaaaagacagctggtgagttgggacctggatacttcttgggtggactttgtccagttctacatccagataggcggagagagtgcttcatgcaacaagcctgacagcagagaggagggcgtcctccttcagtacagcaacaatgggggcatccagtggcacctgctagcagagatgtacttttcagacttcagcaaacccagatttgtctatctggagcttccagctgctgccaagaccccttgcaccaggttccgctggtggcagcccgtgttctcaggggaggactatgaccagtgggcagtcgatgacatcatcattctgtccgagaagcagaagcagatcatcccagttatcaatccaactttacctcagaacttttatgagaagccagcttttgattaccctatgaatcagatgagtgtgtggttgatgttggctaatgaaggaatggttaaaaatgaaaccttctgtgctgccacaccatcagcaatgatatttggaaaatcagatggagatcgatttgcagtaactcgagatttgaccctgaaacctggatatgtgctacagttcaagctaaacataggttgtgccaatcaattcagcagtactgctccagttcttcttcagtactctcatgatgctggtatgtcctggtttctggtgaaagaaggctgttacccggcttctgcaggcaaaggatgcgaaggaaactccagagaactaagtgagcccaccatgtatcacacaggggactttgaagaatggacaagaatcaccattgttattccaaggtctcttgcatccagcaagaccagattccgatggatccaggagagcagctcacagaaaaacgtgcctccatttggtttagatggagtgtacatatccgagccttgtcccagttactgcagtggccatggggactgcatttcaggagtgtgtttctgtgacctgggatatactgctgcacaaggaacctgtgtgtcaaatgtccccaatcacaatgagatgttcgataggtttgaggggaagctcagccctctgtggtacaagataacaggtgcccaggttggaactggctgtggaacacttaacgatggcaaatctctctacttcaatggccctgggaaaagggaagcccggacggtccctctggacaccaggaatatcagacttgttcaattttatatacaaattggaagcaaaacttcaggcattacctgcatcaaaccaagaactagaaatgaagggcttattgttcagtattcaaatgacaatgggatactctggcatttgcttcgagagttggacttcatgtccttcctggaaccacagatcatttccattgacctgccacaggacgcgaagacacctgcaacggcatttcgatggtggcaaccgcaacatgggaagcattcagcccagtgggctttggatgatgttcttataggaatgaatgacagctctcaaactggatttcaagacaaatttgatggctctatagatttgcaagccaactggtatcgaatccaaggaggtcaagttgatattgactgtctctctatggatactgctctgatattcactgaaaacataggaaaacctcgttatgctgagacctgggattttcatgtgtcagcatctacctttttgcagtttgaaatgagcatgggctgtagcaagcccttcagcaactcccacagtgtacagctccagtattctctgaacaatggcaaggactggcatcttgtcaccgaagagtgtgttcctccaaccattggctgtctgcattacacggaaagttcaatttacacctcggaaagattccagaattggaagcggatcactgtctaccttccactctccaccatttctcccaggacccggttcagatggattcaggccaactacactgtgggggctgattcctgggcgattgataatgttgtactggcctcagggtgcccttggatgtgctcaggacgagggatttgtgatgctggacgctgtgtgtgtgaccggggctttggtggaccctattgtgttcctgttgttcctctgccctcgattcttaaagacgatttcaatgggaatttacatcctgacctttggcctgaagtgtatggtgcagagagggggaatctgaatggtgaaaccatcaaatctggaacatctctaatttttaaaggggaaggactaaggatgcttatttcaagagatctagattgtacaaatacaatgtatgtccagttttcacttagatttatagcaaaaagtaccccagagagatctcactctattctgttacaattctccatcagtggaggaatcacttggcacctgatggatgaattttactttcctcaaacaacgaatatacttttcatcaatgttcccttgccatacactgcccaaaccaatgctacaagattcagactctggcaaccttataataacggtaagaaagaagaaatctggattgttgatgacttcattatcgatggaaataatgtaaacaaccctgtgatgctcttggatacatttgattttgggcccagagaagacaattggtttttctatcctggtggtaacatcggtctttattgtccatattcttcaaagggggcacctgaagaagattcagctatggtgtttgtttcaaatgaagttggtgagcattccattaccacccgtgacctaaatgtgaatgagaacaccatcatacaatttgagatcaacgttggctgttcgactgatagctcatccgcggatccagtgagactggaattttcaagggacttcggggcgacctggcaccttctgctgcccctctgctaccacagcagcagccacgtcagctctttatgctccaccgagcaccaccccagcagcacctactacgcaggaaccatgcagggctggaggagggaggtcgtgcactttgggaagctgcacctttgtggatctgtccgtttcagatggtaccagggattttaccctgccggctctcagccagtgacatgggccattgataatgtctacatcggtccccagtgtgaggagatgtgtaatggacaggggagctgtatcaatggaaccaaatgtatatgtgaccctggctactcaggtccaacctgtaaaataagcaccaaaaatcctgattttctcaaagatgatttcgaaggtcagctagaatctgatagattcttattaatgagtggtgggaaaccatctcgaaagtgtggaatcctttctagtggaaacaacctctttttcaatgaagatggcttgcgcatgttgatgacacgagacctggatttatcacatgctagatttgtgcagttcttcatgagactgggatgtggtaaaggcgttcctgaccccaggagtcaacccgtgctcctacagtattctctcaacggtggcctctcgtggagtcttcttcaggagttccttttcagcaattccagcaatgtgggcaggtacattgccctggagatacccttgaaagcccgttctggttctactcgccttcgctggtggcaaccgtctgagaatgggcacttctacagcccctgggttatcgatcagattcttattggaggaaatatttctggtaatacggtcttggaagatgatttcacaacccttgatagtaggaaatggctgcttcacccaggaggcaccaagatgcccgtgtgtggctctactggtgatgccctggtcttcattgaaaaggccagcacccgttacgtggtcagcacagacgttgccgtgaatgaggattccttcctacagatagacttcgctgcctcctgctcagtcacagactcttgttatgcgattgaattggaatactcagtagatcttggattgtcatggcacccattggtaagggactgtctgcctaccaatgtggaatgcagtcgctatcatctgcaacggatcctggtgtcagacactttcaacaagtggactagaatcactctgcctctccctccttataccaggtcccaagccactcgtttccgttggcatcaaccagctccttttgacaagcagcagacatgggcaatagataatgtctatatcggggatggctgcatagacatgtgcagtggccatgggagatgcatccagggaaactgcgtctgtgatgaacagtggggtggcctgtactgtgatgaccccgagacctctcttccaacccaactcaaagacaacttcaatcgagctccatccagtcagaactggctgactgtgaacggagggaaattgagtacagtgtgtggagccgtggcgtcgggaatggctctccatttcagtgggggttgtagtcgattattagtcactgtggatctaaacctcactaatgctgagttcatccaattttacttcatgtatgggtgcctgattacaccaaacaaccgtaaccaaggtgttctcttggaatattctgtcaatggaggcattacctggaacctgctcatggagattttctatgaccagtacagtaagcccggatttgtgaatatccttctccctcctgatgctaaagagattgccactcgcttccgctggtggcagccaagacatgacggcctggatcagaacgactgggccattgacaatgtcctcatctcaggctctgctgaccaaaggaccgttatgctggacaccttcagcagcgccccagtaccccagcatgagcgctcccctgcagatgccggccctgtcgggaggatcgcctttgacatgtttatggaagacaaaacttcagtgaatgagcactggctattccatgatgattgtacagtagaaagattctgtgactcccctgatggtgtgatgctctgtggcagtcatgatggacgggaggtgtatgcagtgacccatgacctgactcccactgaaggctggattatgcaattcaagatctcagttggatgtaaggtgtctgaaaaaattgcccagaatcaaattcatgtgcagtattctactgacttcggtgtgagttggaattatctggtccctcagtgcttgcctgctgacccaaaatgctctggaagtgtttctcagccatctgtattctttccaactaaagggtggaaaaggatcacctacccacttcctgaaagcttagtgggaaatccggtaaggtttaggttctatcagaagtactcagacatgcagtgggcaatcgataatttctacctgggccctggatgcttggacaactgcaggggccatggagattgcttaagggaacagtgcatctgtgatccgggatactcagggccaaactgctacttgacccacactctgaagactttcctgaaggaacgctttgacagtgaagaaatcaaacctgacttatggatgtccttagaaggtggaagtacttgcactgagtgtggaattcttgccgaggacactgcactctattttgggggatccactgtgagacaagcggttacacaagatttggatcttcgaggtgcaaagttcctgcaatactgggggcgcatcggtagtgagaacaacatgacctcttgccatcgtcccatctgccggaaggaaggcgtgctgttggactactctaccgatggaggaattacctggactttgctccatgagatggattaccagaaatacatttctgttagacacgactacatacttcttcctgaagatgccctcaccaacacaactcgacttcgctggtggcagccttttgtgatcagcaatggaattgtggtctctggggtggagcgtgctcagtgggcactggacaacattttgattggtggagcagaaatcaatcccagccaattggtggacacttttgatgatgaaggcacttcccatgaagaaaactggagtttttaccctaatgctgtaaggacagcaggattttgtggcaatccatcctttcacctctattggccaaataaaaagaaggacaagactcacaatgctctctcctcccgagaactcattatacagccaggatacatgatgcagtttaaaattgtggtgggttgtgaagccacttcttgtggtgaccttcattccgtaatgctggaatacactaaggatgcaagatcggattcctggcagctcgtacagacccagtgccttccttcctcttctaacagcattggctgctcccctttccagttccatgaagccaccatctacaactctgtcaacagctcaagctggaaaagaatcaccatccagctgcctgaccatgtctcctctagtgcaacacagttccgctggatccagaagggagaagaaactgagaagcaaagctgggcaattgaccacgtgtacattggagaggcttgccccaagctctgcagcgggcacggatactgcacgaccggtgccatctgcatctgcgacgagagcttccaaggtgatgactgctctgttttcagtcacgaccttcccagttatattaaagataattttgagtccgcaagagtcaccgaggcaaactgggagaccattcaaggtggagtcataggaagtggctgtgggcagctggccccctacgcccatggagactcactgtactttaatggctgtcagatcaggcaagcagctaccaagcctctggatctcactcgagcaagcaaaatcatgtttgttttgcaaattgggagcatgtcgcagacggacagctgcaacagtgacctgagtggcccccacgctgtggacaaggcagtgctgctgcaatacagcgtcaacaacgggatcacctggcatgtcatcgcccagcaccagccaaaggacttcacacaagctcagagagtgtcttacaatgtccccctggaggcacggatgaaaggagtcttactgcgctggtggcaaccacgccacaatggaacaggtcatgatcaatgggctttggaccatgtggaggtcgtcctagtaaccactcgcaaacaaaattacatgatgaatttttcacgacaacatgggctcagacatttctacaacagaagacgaaggtcacttaggcgatacccatgaagaatcaaaaagtttattttttttcttccaacatgtgatgtgttgctctccattcttttaaatctcgcactacatctgatatcaggaaatatctgtgaaggacttggtgattacctgaaagcccttctcaagaccgagtgtacaccactttcccacactgtgaactaatgacaagtgacttatttgctcataagtaaatgtcttcatgttgatgtgtccgtgaaagttgtgatctgttgtaatatcagttacagtggcagtattgacaataagaaacagtttaacagaaaaatgaaatttaagcacaaaaaatttaagagattttatgtttaaaatggcatttagcacagtatttaacattcttggtcacaaagctatttaagtggactgtatttcggctatgtctcatgttttatatgattaaattatcattgtttgtcctttatgtattctcttctacaatacaacacattgaaactgtatttacttgttatgttgtaatattttgctgctgaatttggggctacttatattctgcagaaaattaattgaaatacctattcaagaagatagttgtaaagatattgtatctcctttaatatactccttaaaaatgtatgttggtttagcgttgttttgtggataagaaaaatgcttgaccctgaaatattttctactttaaattgtggatgaagaccctatctcccacaaataagttcccatttccttgtctaaagatctttttttaagtgttctgtggctgatttactaacagtaactgccattttttgtctgtgataacagagtgatttgtaaaacagtggttgttttttcattgtgttttcttcgtggattgttttttctgcgggtcatattcataccttctgatgaagttgtacaacaccagcaacattataatggccctgtagctctgaatgctatttgtgtaactgaaaggttgcactctagggtgaaccaagctataaaagcccatgcttaaataaaaattatgtccaaaagccattgaa

SEQ ID NO: 3612 - DNA, 11571 bp, Homo sapiens
ctcggcgggggcccgctcccaggcccgctcccgagcccgttccgctcccgtccgccttcttctcgccttctctccgcgtggctcctccgtcccggcgtctccaaaactgaatgagcgagcggcgcgtagggcgcgcggcggcggcggcggcggcggcggcatggagcgcagtggctgggcccggcagactttcctcctagcgctgttgctgggggcgacgctgagggcgcgcgcggcggctggctattacccccgcttttcgcccttctttttcctgtgcacccaccacggggagctggaaggggatggggagcagggcgaggtgctcatttccctgcatattgcgggcaaccccacctactacgttccgggacaagaataccatgtgacaatttcaacaagcaccttttttgacggcttgctggtgacaggactatacacatctacaagtgttcaggcatcacagagcattggaggttccagtgctttcggatttgggatcatgtctgaccaccagtttggtaaccagtttatgtgcagtgtggtagcctctcacgtgagtcacctgcccacaaccaacctcagtttcatctggattgctccacctgcgggcacaggctgtgtgaatttcatggctacagcaacacaccggggccaggttattttcaaagatgctttagcccagcagttgtgtgaacaaggagctccaacagatgtcactgtgcacccacatctagctgaaatacatagtgacagcattatcctgagagatgactttgactcctaccaccaactgcaattaaatccaaatatatgggttgaatgtaacaactgtgagactggagaacagtgtggcgcgattatgcatggcaatgccgtcaccttctgtgaaccatatggcccacgagaactgattaccacaggccttaatacaacaacagcttctgtcctccaattttccattgggtcaggttcatgtcgctttagttattcagaccccagcatcatcgtgttatatgccaagaataactctgcggactggattcagctagagaaaattagagccccttccaatgtcagcacaatcatccatatcctctaccttcctgaggacgccaaaggggagaatgtccaatttcagtggaagcaggaaaatcttcgtgtaggtgaagtgtatgaagcctgctgggccttagataacatcttgatcatcaattcagctcacagacaagtcgttttagaagatagtctcgacccagtggacacaggcaactggcttttcttcccaggagctacagttaagcatagctgtcagtcagatgggaactccatttatttccatggaaatgaaggcagcgagttcaattttgccaccaccagggatgtagatctttccacagaagatattcaagagcaatggtcagaagaatttgagagccagcctacaggatgggatgtcttgggagctgtcattggtacagaatgtggaacgatagaatcaggcttatcaatggtcttcctcaaagatggagagaggaaattatgcactccatccatggacactaccggttatgggaacctgaggttttactttgtgatgggaggaatttgtgaccctggaaattctcatgaaaatgacataatcctgtatgcaaaaattgaaggaagaaaagagcatataacactggataccctttcctattcctcatataaggttccgtctttggtttctgtggtcatcaatcctgaacttcagactcctgctaccaaattttgtctcaggcaaaagaaccatcaaggacataataggaatgtctgggctgtagactttttccatgtcttgcctgttctcccttctacaatgtctcacatgatacagttttccatcaatctgggatgtggaacgcatcagcctggtaacagtgtcagcttggaattttctaccaaccatgggcgctcctggtccctccttcacactgaatgcttacctgagatctgtgctggaccccacctcccccacagcactgtctactcctctgaaaactacagtgggtggaaccgaataacaattccccttcctaacgcagcactaacccggaacaccaggattcgctggagacaaacaggaccaatccttggaaacatgtgggcaattgataatgtttatattggcccgtcatgtctcaaattctgttctggcagaggacagtgcactagacatggttgcaagtgtgaccctggattttctggcccagcttgtgagatggcatcccagacattcccaatgtttatttctgaaagctttggcagttccaggctctcctcttaccataacttttactctatccgtggtgctgaagtcagctttggttgtggtgtcttggccagtggtaaggccctggttttcaacaaagatgggcggcgtcagctaattacatctttccttgacagctcacaatccaggtttctccagttcacactgagactggggagcaaatctgttctgagcacgtgcagagcccctgatcagcctggtgaaggagttttgttgcattattcttatgataatgggataacttggaaactcctggagcattattcatatctcagctatcatgagcccagaataatctccgtagaactaccaggtgatgcaaagcagtttggaattcagttcagatggtggcaaccgtatcattcttcccagagagaagatgtatgggctattgatgagattatcatgacatctgtgcttttcaacagcattagtcttgactttaccaatcttgtggaggtcactcagtctctgggattctaccttggaaatgttcagccatactgtggccacgactggaccctttgttttacaggagattctaaacttgcctcaagtatgcgctatgtggaaacacaatcaatgcagataggagcatcctatatgattcagttcagtttggtgatgggatgtggccagaaatacaccccacacatggacaaccaggtgaagctggagtactcaaccaaccacggccttacctggcacctcgtccaagaagaatgccttccaagtatgccaagttgtcaggaatttacatcagcaagtatttaccatgccagtgagtttacacagtggaggagagtcatagtgcttcttccccagaaaacttggtccagtgctacccgtttccgctggagccagagctattacacagctcaagacgagtgggctttggacagcatttacattgggcagcagtgccccaacatgtgcagtgggcatggctcatgcgatcatggcatatgcaggtgtgaccaggggtaccaaggcactgaatgccacccagaagctgcccttccgtccacaattatgtcagattttgagaaccagaatggctgggagtctgactggcaagaagttattgggggagaaattgtaaaaccagaacaagggtgtggtgtcatctcttctggatcatctctgtacttcagcaaggctgggaaaagacagctggtgagttgggacctggatacttcttgggtggactttgtccagttctacatccagataggcggagagagtgcttcatgcaacaagcctgacagcagagaggagggcgtcctccttcagtacagcaacaatgggggcatccagtggcacctgctagcagagatgtacttttcagacttcagcaaacccagatttgtctatctggagcttccagctgctgccaagaccccttgcaccaggttccgctggtggcagcccgtgttctcaggggaggactatgaccagtgggcagtcgatgacatcatcattctgtccgagaagcagaagcagatcatcccagttatcaatccaactttacctcagaacttttatgagaagccagcttttgattaccctatgaatcagatgagtgtgtggttgatgttggctaatgaaggaatggttaaaaatgaaaccttctgtgctgccacaccatcagcaatgatatttggaaaatcagatggagatcgatttgcagtaactcgagatttgaccctgaaacctggatatgtgctacagttcaagctaaacataggttgtgccaatcaattcagcagtactgctccagttcttcttcagtactctcatgatgctggtatgtcctggtttctggtgaaagaaggctgttacccggcttctgcaggcaaaggatgcgaaggaaactccagagaactaagtgagcccaccatgtatcacacaggggactttgaagaatggacaagaatcaccattgttattccaaggtctcttgcatccagcaagaccagattccgatggatccaggagagcagctcacagaaaaacgtgcctccatttggtttagatggagtgtacatatccgagccttgtcccagttactgcagtggccatggggactgcatttcaggagtgtgtttctgtgacctgggatatactgctgcacaaggaacctgtgtgtcaaatgtccccaatcacaatgagatgttcgataggtttgaggggaagctcagccctctgtggtacaagataacaggtgcccaggttggaactggctgtggaacacttaacgatggcaaatctctctacttcaatggccctgggaaaagggaagcccggacggtccctctggacaccaggaatatcagacttgttcaattttatatacaaattggaagcaaaacttcaggcattacctgcatcaaaccaagaactagaaatgaagggcttattgttcagtattcaaatgacaatgggatactctggcatttgcttcgagagttggacttcatgtccttcctggaaccacagatcatttccattgacctgccacaggacgcgaagacacctgcaacggcatttcgatggtggcaaccgcaacatgggaagcattcagcccagtgggctttggatgatgttcttataggaatgaatgacagctctcaaactggatttcaagacaaatttgatggctctatagatttgcaagccaactggtatcgaatccaaggaggtcaagttgatattgactgtctctctatggatactgctctgatattcactgaaaacataggaaaacctcgttatgctgagacctgggattttcatgtgtcagcatctacctttttgcagtttgaaatgagcatgggctgtagcaagcccttcagcaactcccacagtgtacagctccagtattctctgaacaatggcaaggactggcatcttgtcaccgaagagtgtgttcctccaaccattggctgtctgcattacacggaaagttcaatttacacctcggaaagattccagaattggaagcggatcactgtctaccttccactctccaccatttctcccaggacccggttcagatggattcaggccaactacactgtgggggctgattcctgggcgattgataatgttgtactggcctcagggtgcccttggatgtgctcaggacgagggatttgtgatgctggacgctgtgtgtgtgaccggggctttggtggaccctattgtgttcctgttgttcctctgccctcgattcttaaagacgatttcaatgggaatttacatcctgacctttggcctgaagtgtatggtgcagagagggggaatctgaatggtgaaaccatcaaatctggaacatctctaatttttaaaggggaaggactaaggatgcttatttcaagagatctagattgtacaaatacaatgtatgtccagttttcacttagatttatagcaaaaagtaccccagagagatctcactctattctgttacaattctccatcagtggaggaatcacttggcacctgatggatgaattttactttcctcaaacaacgaatatacttttcatcaatgttcccttgccatacactgcccaaaccaatgctacaagattcagactctggcaaccttataataacggtaagaaagaagaaatctggattgttgatgacttcattatcgatggaaataatgtaaacaaccctgtgatgctcttggatacatttgattttgggcccagagaagacaattggtttttctatcctggtggtaacatcggtctttattgtccatattcttcaaagggggcacctgaagaagattcagctatggtgtttgtttcaaatgaagttggtgagcattccattaccacccgtgacctaaatgtgaatgagaacaccatcatacaatttgagatcaacgttggctgttcgactgatagctcatccgcggatccagtgagactggaattttcaagggacttcggggcgacctggcaccttctgctgcccctctgctaccacagcagcagccacgtcagctctttatgctccaccgagcaccaccccagcagcacctactacgcaggaaccatgcagggctggaggagggaggtcgtgcactttgggaagctgcacctttgtggatctgtccgtttcagatggtaccagggattttaccctgccggctctcagccagtgacatgggccattgataatgtctacatcggtccccagtgtgaggagatgtgtaatggacaggggagctgtatcaatggaaccaaatgtatatgtgaccctggctactcaggtccaacctgtaaaataagcaccaaaaatcctgattttctcaaagatgatttcgaaggtcagctagaatctgatagattcttattaatgagtggtgggaaaccatctcgaaagtgtggaatcctttctagtggaaacaacctctttttcaatgaagatggcttgcgcatgttgatgacacgagacctggatttatcacatgctagatttgtgcagttcttcatgagactgggatgtggtaaaggcgttcctgaccccaggagtcaacccgtgctcctacagtattctctcaacggtggcctctcgtggagtcttcttcaggagttccttttcagcaattccagcaatgtgggcaggtacattgccctggagatacccttgaaagcccgttctggttctactcgccttcgctggtggcaaccgtctgagaatgggcacttctacagcccctgggttatcgatcagattcttattggaggaaatatttctggtaatacggtcttggaagatgatttcacaacccttgatagtaggaaatggctgcttcacccaggaggcaccaagatgcccgtgtgtggctctactggtgatgccctggtcttcattgaaaaggccagcacccgttacgtggtcagcacagacgttgccgtgaatgaggattccttcctacagatagacttcgctgcctcctgctcagtcacagactcttgttatgcgattgaattggaatactcagtagatcttggattgtcatggcacccattggtaagggactgtctgcctaccaatgtggaatgcagtcgctatcatctgcaacggatcctggtgtcagacactttcaacaagtggactagaatcactctgcctctccctccttataccaggtcccaagccactcgtttccgttggcatcaaccagctccttttgacaagcagcagacatgggcaatagataatgtctatatcggggatggctgcatagacatgtgcagtggccatgggagatgcatccagggaaactgcgtctgtgatgaacagtggggtggcctgtactgtgatgaccccgagacctctcttccaacccaactcaaagacaacttcaatcgagctccatccagtcagaactggctgactgtgaacggagggaaattgagtacagtgtgtggagccgtggcgtcgggaatggctctccatttcagtgggggttgtagtcgattattagtcactgtggatctaaacctcactaatgctgagttcatccaattttacttcatgtatgggtgcctgattacaccaaacaaccgtaaccaaggtgttctcttggaatattctgtcaatggaggcattacctggaacctgctcatggagattttctatgaccagtacagtaagcccggatttgtgaatatccttctccctcctgatgctaaagagattgccactcgcttccgctggtggcagccaagacatgacggcctggatcagaacgactgggccattgacaatgtcctcatctcaggctctgctgaccaaaggaccgttatgctggacaccttcagcagcgccccagtaccccagcatgagcgctcccctgcagatgccggccctgtcgggaggatcgcctttgacatgtttatggaagacaaaacttcagtgaatgagcactggctattccatgatgattgtacagtagaaagattctgtgactcccctgatggtgtgatgctctgtggcagtcatgatggacgggaggtgtatgcagtgacccatgacctgactcccactgaaggctggattatgcaattcaagatctcagttggatgtaaggtgtctgaaaaaattgcccagaatcaaattcatgtgcagtattctactgacttcggtgtgagttggaattatctggtccctcagtgcttgcctgctgacccaaaatgctctggaagtgtttctcagccatctgtattctttccaactaaagggtggaaaaggatcacctacccacttcctgaaagcttagtgggaaatccggtaaggtttaggttctatcagaagtactcagacatgcagtgggcaatcgataatttctacctgggccctggatgcttggacaactgcaggggccatggagattgcttaagggaacagtgcatctgtgatccgggatactcagggccaaactgctacttgacccacactctgaagactttcctgaaggaacgctttgacagtgaagaaatcaaacctgacttatggatgtccttagaaggtggaagtacttgcactgagtgtggaattcttgccgaggacactgcactctattttgggggatccactgtgagacaagcggttacacaagatttggatcttcgaggtgcaaagttcctgcaatactgggggcgcatcggtagtgagaacaacatgacctcttgccatcgtcccatctgccggaaggaaggcgtgctgttggactactctaccgatggaggaattacctggactttgctccatgagatggattaccagaaatacatttctgttagacacgactacatacttcttcctgaagatgccctcaccaacacaactcgacttcgctggtggcagccttttgtgatcagcaatggaattgtggtctctggggtggagcgtgctcagtgggcactggacaacattttgattggtggagcagaaatcaatcccagccaattggtggacacttttgatgatgaaggcacttcccatgaagaaaactggagtttttaccctaatgctgtaaggacagcaggattttgtggcaatccatcctttcacctctattggccaaataaaaagaaggacaagactcacaatgctctctcctcccgagaactcattatacagccaggatacatgatgcagtttaaaattgtggtgggttgtgaagccacttcttgtggtgaccttcattccgtaatgctggaatacactaaggatgcaagatcggattcctggcagctcgtacagacccagtgccttccttcctcttctaacagcattggctgctcccctttccagttccatgaagccaccatctacaactctgtcaacagctcaagctggaaaagaatcaccatccagctgcctgaccatgtctcctctagtgcaacacagttccgctggatccagaagggagaagaaactgagaagcaaagctgggcaattgaccacgtgtacattggagaggcttgccccaagctctgcagcgggcacggatactgcacgaccggtgccatctgcatctgcgacgagagcttccaaggtgatgactgctctgttttcagtcacgaccttcccagttatattaaagataattttgagtccgcaagagtcaccgaggcaaactgggagaccattcaaggtggagtcataggaagtggctgtgggcagctggccccctacgcccatggagactcactgtactttaatggctgtcagatcaggcaagcagctaccaagcctctggatctcactcgagcaagcaaaatcatgtttgttttgcaaattgggagcatgtcgcagacggacagctgcaacagtgacctgagtggcccccacgctgtggacaaggcagtgctgctgcaatacagcgtcaacaacgggatcacctggcatgtcatcgcccagcaccagccaaaggacttcacacaagctcagagagtgtcttacaatgtccccctggaggcacggatgaaaggagtcttactgcgctggtggcaaccacgccacaatggaacaggtcatgatcaatgggctttggaccatgtggaggtcgtcctagtaagcactcgcaaacaaaattacatgatgaatttttcacgacaacatgggctcagacatttctacaacagaagacgaaggtcacttaggcgatacccatgaagaatcaaaaagtttattttttttcttccaacatgtgatgtgttgctctccattcttttaaatctcgcactacatctgatatcaggaaatatctgtgaaggacttggtgattacctgaaagcccttctcaagaccgagtgtacaccactttcccacactgtgaactaatgacaagtgacttatttgctcataagtaaatgtcttcatgttgatgtgtccgtgaaagttgtgatctgttgtaatatcagttacagtggcagtattgacaataagaaacagtttaacagaaaaatgaaatttaagcacaaaaaatttaagagattttatgtttaaaatggcatttagcacagtatttaacattcttggtcacaaagctatttaagtggactgtatttcggctatgtctcatgttttatatgattaaattatcattgtttgtcctttatgtattctcttctacaatacaacacattgaaactgtatttacttgttatgttgtaatattttgctgctgaatttggggctacttatattctgcagaaaattaattgaaatacctattcaagaagatagttgtaaagatattgtatctcctttaatatactccttaaaaatgtatgttggtttagcgttgttttgtggataagaaaaatgcttgaccctgaaatattttctactttaaattgtggatgaagaccctatctcccacaaataagttcccatttccttgtctaaagatctttttttaagtgttctgtggctgatttactaacagtaactgccattttttgtctgtgataacagagtgatttgtaaaacagtggttgttttttcattgtgttttcttcgtggattgttttttctgcgggtcatattcataccttctgatgaagttgtacaacaccagcaacattataatggccctgtagctctgaatgctatttgtgtaactgaaaggttgcactctagggtgaaccaagctataaaagcccatgcttaaataaaaattatgtccaaaagccattgaa

SEQ ID NO: 3613 - DNA, 11571 bp, Homo sapiens
ctcggcgggggcccgctcccaggcccgctcccgagcccgttccgctcccgtccgccttcttctcgccttctctccgcgtggctcctccgtcccggcgtctccaaaactgaatgagcgagcggcgcgtagggcgcgcggcggcggcggcggcggcggcggcatggagcgcagtggctgggcccggcagactttcctcctagcgctgttgctgggggcgacgctgagggcgcgcgcggcggctggctattacccccgcttttcgcccttctttttcctgtgcacccaccacggggagctggaaggggatggggagcagggcgaggtgctcatttccctgcatattgcgggcaaccccacctactacgttccgggacaagaataccatgtgacaatttcaacaagcaccttttttgacggcttgctggtgacaggactatacacatctacaagtgttcaggcatcacagagcattggaggttccagtgctttcggatttgggatcatgtctgaccaccagtttggtaaccagtttatgtgcagtgtggtagcctctcacgtgagtcacctgcccacaaccaacctcagtttcatctggattgctccacctgcgggcacaggctgtgtgaatttcatggctacagcaacacaccggggccaggttattttcaaagatgctttagcccagcagttgtgtgaacaaggagctccaacagatgtcactgtgcacccacatctagctgaaatacatagtgacagcattatcctgagagatgactttgactcctaccaccaactgcaattaaatccaaatatatgggttgaatgtaacaactgtgagactggagaacagtgtggcgcgattatgcatggcaatgccgtcaccttctgtgaaccatatggcccacgagaactgattaccacaggccttaatacaacaacagcttctgtcctccaattttccattgggtcaggttcatgtcgctttagttattcagaccccagcatcatcgtgttatatgccaagaataactctgcggactggattcagctagagaaaattagagccccttccaatgtcagcacaatcatccatatcctctaccttcctgaggacgccaaaggggagaatgtccaatttcagtggaagcaggaaaatcttcgtgtaggtgaagtgtatgaagcctgctgggccttagataacatcttgatcatcaattcagctcacagacaagtcgttttagaagatagtctcgacccagtggacacaggcaactggcttttcttcccaggagctacagttaagcatagctgtcagtcagatgggaactccatttatttccatggaaatgaaggcagcgagttcaattttgccaccaccagggatgtagatctttccacagaagatattcaagagcaatggtcagaagaatttgagagccagcctacaggatgggatgtcttgggagctgtcattggtacagaatgtggaacgatagaatcaggcttatcaatggtcttcctcaaagatggagagaggaaattatgcactccatccatggacactaccggttatgggaacctgaggttttactttgtgatgggaggaatttgtgaccctggaaattctcatgaaaatgacataatcctgtatgcaaaaattgaaggaagaaaagagcatataacactggataccctttcctattcctcatataaggttccgtctttggtttctgtggtcatcaatcctgaacttcagactcctgctaccaaattttgtctcaggcaaaagaaccatcaaggacataataggaatgtctgggctgtagactttttccatgtcttgcctgttctcccttctacaatgtctcacatgatacagttttccatcaatctgggatgtggaacgcatcagcctggtaacagtgtcagcttggaattttctaccaaccatgggcgctcctggtccctccttcacactgaatgcttacctgagatctgtgctggaccccacctcccccacagcactgtctactcctctgaaaactacagtgggtggaaccgaataacaattccccttcctaacgcagcactaacccggaacaccaggattcgctggagacaaacaggaccaatccttggaaacatgtgggcaattgataatgtttatattggcccgtcatgtctcaaattctgttctggcagaggacagtgcactagacatggttgcaagtgtgaccctggattttctggcccagcttgtgagatggcatcccagacattcccaatgtttatttctgaaagctttggcagttccaggctctcctcttaccataacttttactctatccgtggtgctgaagtcagctttggttgtggtgtcttggccagtggtaaggccctggttttcaacaaagatgggcggcgtcagctaattacatctttccttgacagctcacaatccaggtttctccagttcacactgagactggggagcaaatctgttctgagcacgtgcagagcccctgatcagcctggtgaaggagttttgttgcattattcttatgataatgggataacttggaaactcctggagcattattcatatctcagctatcatgagcccagaataatctccgtagaactaccaggtgatgcaaagcagtttggaattcagttcagatggtggcaaccgtatcattcttcccagagagaagatgtatgggctattgatgagattatcatgacatctgtgcttttcaacagcattagtcttgactttaccaatcttgtggaggtcactcagtctctgggattctaccttggaaatgttcagccatactgtggccacgactggaccctttgttttacaggagattctaaacttgcctcaagtatgcgctatgtggaaacacaatcaatgcagataggagcatcctatatgattcagttcagtttggtgatgggatgtggccagaaatacaccccacacatggacaaccaggtgaagctggagtactcaaccaaccacggccttacctggcacctcgtccaagaagaatgccttccaagtatgccaagttgtcaggaatttacatcagcaagtatttaccatgccagtgagtttacacagtggaggagagtcatagtgcttcttccccagaaaacttggtccagtgctacccgtttccgctggagccagagctattacacagctcaagacgagtgggctttggacagcatttacattgggcagcagtgccccaacatgtgcagtgggcatggctcatgcgatcatggcatatgcaggtgtgaccaggggtaccaaggcactgaatgccacccagaagctgcccttccgtccacaattatgtcagattttgagaaccagaatggctgggagtctgactggcaagaagttattgggggagaaattgtaaaaccagaacaagggtgtggtgtcatctcttctggatcatctctgtacttcagcaaggctgggaaaagacagctggtgagttgggacctggatacttcttgggtggactttgtccagttctacatccagataggcggagagagtgcttcatgcaacaagcctgacagcagagaggagggcgtcctccttcagtacagcaacaatgggggcatccagtggcacctgctagcagagatgtacttttcagacttcagcaaacccagatttgtctatctggagcttccagctgctgccaagaccccttgcaccaggttccgctggtggcagcccgtgttctcaggggaggactatgaccagtgggcagtcgatgacatcatcattctgtccgagaagcagaagcagatcatcccagttatcaatccaactttacctcagaacttttatgagaagccagcttttgattaccctatgaatcagatgagtgtgtggttgatgttggctaatgaaggaatggttaaaaatgaaaccttctgtgctgccacaccatcagcaatgatatttggaaaatcagatggagatcgatttgcagtaactcgagatttgaccctgaaacctggatatgtgctacagttcaagctaaacataggttgtgccaatcaattcagcagtactgctccagttcttcttcagtactctcatgatgctggtatgtcctggtttctggtgaaagaaggctgttacccggcttctgcaggcaaaggatgcgaaggaaactccagagaactaagtgagcccaccatgtatcacacaggggactttgaagaatggacaagaatcaccattgttattccaaggtctcttgcatccagcaagaccagattccgatggatccaggagagcagctcacagaaaaacgtgcctccatttggtttagatggagtgtacatatccgagccttgtcccagttactgcagtggccatggggactgcatttcaggagtgtgtttctgtgacctgggatatactgctgcacaaggaacctgtgtgtcaaatgtccccaatcacaatgagatgttcgataggtttgaggggaagctcagccctctgtggtacaagataacaggtgcccaggttggaactggctgtggaacacttaacgatggcaaatctctctacttcaatggccctgggaaaagggaagcccggacggtccctctggacaccaggaatatcagacttgttcaattttatatacaaattggaagcaaaacttcaggcattacctgcatcaaaccaagaactagaaatgaagggcttattgttcagtattcaaatgacaatgggatactctggcatttgcttcgagagttggacttcatgtccttcctggaaccacagatcatttccattgacctgccacaggacgcgaagacacctgcaacggcatttcgatggtggcaaccgcaacatgggaagcattcagcccagtgggctttggatgatgttcttataggaatgaatgacagctctcaaactggatttcaagacaaatttgatggctctatagatttgcaagccaactggtatcgaatccaaggaggtcaagttgatattgactgtctctctatggatactgctctgatattcactgaaaacataggaaaacctcgttatgctgagacctgggattttcatgtgtcagcatctacctttttgcagtttgaaatgagcatgggctgtagcaagcccttcagcaactcccacagtgtacagctccagtattctctgaacaatggcaaggactggcatcttgtcaccgaagagtgtgttcctccaaccattggctgtctgcattacacggaaagttcaatttacacctcggaaagattccagaattggaagcggatcactgtctaccttccactctccaccatttctcccaggacccggttcagatggattcaggccaactacactgtgggggctgattcctgggcgattgataatgttgtactggcctcagggtgcccttggatgtgctcaggacgagggatttgtgatgctggacgctgtgtgtgtgaccggggctttggtggaccctattgtgttcctgttgttcctctgccctcgattcttaaagacgatttcaatgggaatttacatcctgacctttggcctgaagtgtatggtgcagagagggggaatctgaatggtgaaaccatcaaatctggaacatctctaatttttaaaggggaaggactaaggatgcttatttcaagagatctagattgtacaaatacaatgtatgtccagttttcacttagatttatagcaaaaagtaccccagagagatctcactctattctgttacaattctccatcagtggaggaatcacttggcacctgatggatgaattttactttcctcaaacaacgaatatacttttcatcaatgttcccttgccatacactgcccaaaccaatgctacaagattcagactctggcaaccttataataacggtaagaaagaagaaatctggattgttgatgacttcattatcgatggaaataatgtaaacaaccctgtgatgctcttggatacatttgattttgggcccagagaagacaattggtttttctatcctggtggtaacatcggtctttattgtccatattcttcaaagggggcacctgaagaagattcagctatggtgtttgtttcaaatgaagttggtgagcattccattaccacccgtgacctaaatgtgaatgagaacaccatcatacaatttgagatcaacgttggctgttcgactgatagctcatccgcggatccagtgagactggaattttcaagggacttcggggcgacctggcaccttctgctgcccctctgctaccacagcagcagccacgtcagctctttatgctccaccgagcaccaccccagcagcacctactacgcaggaaccatgcagggctggaggagggaggtcgtgcactttgggaagctgcacctttgtggatctgtccgtttcagatggtaccagggattttaccctgccggctctcagccagtgacatgggccattgataatgtctacatcggtccccagtgtgaggagatgtgtaatggacaggggagctgtatcaatggaaccaaatgtatatgtgaccctggctactcaggtccaacctgtaaaataagcaccaaaaatcctgattttctcaaagatgatttcgaaggtcagctagaatctgatagattcttattaatgagtggtgggaaaccatctcgaaagtgtggaatcctttctagtggaaacaacctctttttcaatgaagatggcttgcgcatgttgatgacacgagacctggatttatcacatgctagatttgtgcagttcttcatgagactgggatgtggtaaaggcgttcctgaccccaggagtcaacccgtgctcctacagtattctctcaacggtggcctctcgtggagtcttcttcaggagttccttttcagcaattccagcaatgtgggcaggtacattgccctggagatacccttgaaagcccgttctggttctactcgccttcgctggtggcaaccgtctgagaatgggcacttctacagcccctgggttatcgatcagattcttattggaggaaatatttctggtaatacggtcttggaagatgatttcacaacccttgatagtaggaaatggctgcttcacccaggaggcaccaagatgcccgtgtgtggctctactggtgatgccctggtcttcattgaaaaggccagcacccgttacgtggtcagcacagacgttgccgtgaatgaggattccttcctacagatagacttcgctgcctcctgctcagtcacagactcttgttatgcgattgaattggaatactcagtagatcttggattgtcatggcacccattggtaagggactgtctgcctaccaatgtggaatgcagtcgctatcatctgcaacggatcctggtgtcagacactttcaacaagtggactagaatcactctgcctctccctccttataccaggtcccaagccactcgtttccgttggcatcaaccagctccttttgacaagcagcagacatgggcaatagataatgtctatatcggggatggctgcatagacatgtgcagtggccatgggagatgcatccagggaaactgcgtctgtgatgaacagtggggtggcctgtactgtgatgaccccgagacctctcttccaacccaactcaaagacaacttcaatcgagctccatccagtcagaactggctgactgtgaacggagggaaattgagtacagtgtgtggagccgtggcgtcgggaatggctctccatttcagtgggggttgtagtcgattattagtcactgtggatctaaacctcactaatgctgagttcatccaattttacttcatgtatgggtgcctgattacaccaaacaaccgtaaccaaggtgttctcttggaatattctgtcaatggaggcattacctggaacctgctcatggagattttctatgaccagtacagtaagcccggatttgtgaatatccttctccctcctgatgctaaagagattgccactcgcttccgctggtggcagccaagacatgacggcctggatcagaacgactgggccattgacaatgtcctcatctcaggctctgctgaccaaaggaccgttatgctggacaccttcagcagcgccccagtaccccagcatgagcgctcccctgcagatgccggccctgtcgggaggatcgcctttgacatgtttatggaagacaaaacttcagtgaatgagcactggctattccatgatgattgtacagtagaaagattctgtgactcccctgatggtgtgatgctctgtggcagtcatgatggacgggaggtgtatgcagtgacccatgacctgactcccactgaaggctggattatgcaattcaagatctcagttggatgtaaggtgtctgaaaaaattgcccagaatcaaattcatgtgcagtattctactgacttcggtgtgagttggaattatctggtccctcagtgcttgcctgctgacccaaaatgctctggaagtgtttctcagccatctgtattctttccaactaaagggtggaaaaggatcacctacccacttcctgaaagcttagtgggaaatccggtaaggtttaggttctatcagaagtactcagacatgcagtgggcaatcgataatttctacctgggccctggatgcttggacaactgcaggggccatggagattgcttaagggaacagtgcatctgtgatccgggatactcagggccaaactgctacttgacccacactctgaagactttcctgaaggaacgctttgacagtgaagaaatcaaacctgacttatggatgtccttagaaggtggaagtacttgcactgagtgtggaattcttgccgaggacactgcactctattttgggggatccactgtgagacaagcggttacacaagatttggatcttcgaggtgcaaagttcctgcaatactgggggcgcatcggtagtgagaacaacatgacctcttgccatcgtcccatctgccggaaggaaggcgtgctgttggactactctaccgatggaggaattacctggactttgctccatgagatggattaccagaaatacatttctgttagacacgactacatacttcttcctgaagatgccctcaccaacacaactcgacttcgctggtggcagccttttgtgatcagcaatggaattgtggtctctggggtggagcgtgctcagtgggcactggacaacattttgattggtggagcagaaatcaatcccagccaattggtggacacttttgatgatgaaggcacttcccatgaagaaaactggagtttttaccctaatgctgtaaggacagcaggattttgtggcaatccatcctttcacctctattggccaaataaaaagaaggacaagactcacaatgctctctcctcccgagaactcattatacagccaggatacatgatgcagtttaaaattgtggtgggttgtgaagccacttcttgtggtgaccttcattccgtaatgctggaatacactaaggatgcaagatcggattcctggcagctcgtacagacccagtgccttccttcctcttctaacagcattggctgctcccctttccagttccatgaagccaccatctacaactctgtcaacagctcaagctggaaaagaatcaccatccagctgcctgaccatgtctcctctagtgcaacacagttccgctggatccagaagggagaagaaactgagaagcaaagctgggcaattgaccacgtgtacattggagaggcttgccccaagctctgcagcgggcacggatactgcacgaccggtgccatctgcatctgcgacgagagcttccaaggtgatgactgctctgttttcagtcacgaccttcccagttatattaaagataattttgagtccgcaagagtcaccgaggcaaactgggagaccattcaaggtggagtcataggaagtggctgtgggcagctggccccctacgcccatggagactcactgtactttaatggctgtcagatcaggcaagcagctaccaagcctctggatctcactcgagcaagcaaaatcatgtttgttttgcaaattgggagcatgtcgcagacggacagctgcaacagtgacctgagtggcccccacgctgtggacaaggcagtgctgctgcaatacagcgtcaacaacgggatcacctggcatgtcatcgcccagcaccagccaaaggacttcacacaagctcagagagtgtcttacaatgtccccctggaggcacggatgaaaggagtcttactgcgctggtggcaaccacgccacaatggaacaggtcatgatcaatgggctttggaccatgtggaggtcgtcctgtgaagcactcgcaaacaaaattacatgatgaatttttcacgacaacatgggctcagacatttctacaacagaagacgaaggtcacttaggcgatacccatgaagaatcaaaaagtttattttttttcttccaacatgtgatgtgttgctctccattcttttaaatctcgcactacatctgatatcaggaaatatctgtgaaggacttggtgattacctgaaagcccttctcaagaccgagtgtacaccactttcccacactgtgaactaatgacaagtgacttatttgctcataagtaaatgtcttcatgttgatgtgtccgtgaaagttgtgatctgttgtaatatcagttacagtggcagtattgacaataagaaacagtttaacagaaaaatgaaatttaagcacaaaaaatttaagagattttatgtttaaaatggcatttagcacagtatttaacattcttggtcacaaagctatttaagtggactgtatttcggctatgtctcatgttttatatgattaaattatcattgtttgtcctttatgtattctcttctacaatacaacacattgaaactgtatttacttgttatgttgtaatattttgctgctgaatttggggctacttatattctgcagaaaattaattgaaatacctattcaagaagatagttgtaaagatattgtatctcctttaatatactccttaaaaatgtatgttggtttagcgttgttttgtggataagaaaaatgcttgaccctgaaatattttctactttaaattgtggatgaagaccctatctcccacaaataagttcccatttccttgtctaaagatctttttttaagtgttctgtggctgatttactaacagtaactgccattttttgtctgtgataacagagtgatttgtaaaacagtggttgttttttcattgtgttttcttcgtggattgttttttctgcgggtcatattcataccttctgatgaagttgtacaacaccagcaacattataatggccctgtagctctgaatgctatttgtgtaactgaaaggttgcactctagggtgaaccaagctataaaagcccatgcttaaataaaaattatgtccaaaagccattgaa

SEQ ID NO: 3614 - DNA, 1863 bp, Homo sapiens
gccggagttggttgggtcttcagacaccagctgaatgcttagggattctttcatttcctaaagtgcttacaaaattatgaaaaagcacgactttgctgaaaacctgccttcatctttactaatcatcatactagtcatctttactctcagtggctcaaaatttgggcggggaactggactcactcagccttctcaacgcacgtctgctcggagatcatttgggagatccaagagattcagtatcactcgctcccttgatgatcttgagtctgcaactgtgtctgatggcgagttgacgggcgccgacctgaaggactgcgtcagcaacaacagcctgagcagcaatgccagcctccccagcgtgcagagctgccggcgcctgcgtgagaggagggtcgccagctgggccgtgtcctttgagcgcctgctgcaggaccccgtcggtgtccgctacttctctgattttctaaggaaagaattcagtgaagaaaacattttattctggcaggcctgtgaatattttaatcatgttcctgcacatgacaaaaaggagctttcctacagggcccgggagattttcagtaagtttctctgcagcaaagccaccaccccggtcaacatcgacagccaggcccagctagcagacgacgtcctccgcgcacctcacccagacatgttcaaggagcagcagctgcagatcttcaatctcatgaagtttgatagctacactcgctttctgaagtccccgctgtaccaggaatgcatcctggcggaagtggagggccgtgcactcccggactcgcagcaggtccccagcagcccggcttccaagcacagcctcggttcagaccactccagtgtgtccacgccaaaaaagttaagtggaaaatcaaaatccggccgatccctgaatgaagagctgggggatgaggacagcgagaagaagcggaaaggcgcgtttttctcgtggtcgcggaccaggagcaccgggaggtcccagaaaaagagggagcacggggaccacgcagacgacgccctgcatgccaatggaggcctgtgtcgccgagagtcgcagggctctgtgtcctctgcggggagcctggacctgtcggaggcctgcaggactttggcacccgagaaggacaaggccaccaagcactgctgcattcatctcccggatgggacatcctgcgtggtggctgtcaaggcgggcttctccatcaaagacatcctgtccggactctgtgagcggcatggcatcaacggggcggccgcggacctcttcctggtgggcggggacaagcctctggtgctgcaccaagacagtagcatcttggagtcaagggacctgcgcctagaaaagcgcaccttgtttcggctggatcttgttccgattaaccggtcagtgggactcaaggccaagcccaccaagcccgtcacggaggtgctgcggcccgtggtggccagatacggcctggacctcagtggcctgctggtgaggctgagtggagagaaggagcccctggaccttggcgcccctatatcgagtctggacggacagcgggttgtcttggaggagaaggatccttccagaggaaaggcatccgcagataaacagaaaggtgtgccagtgaaacagaacacagctgtaaattccagctccagaaaccactcggctacgagttttttgagcttatttccaaagctcagagcaacagagcagatgaccaacgtgggctgctaaggaaggaagacctggtgttgccagagttcctccgtttacctcctggttccacagaactcaccctccccactccagctgctgtggccaagggctttagcaagagaagcgccacaggcaac

SEQ ID NO: 3615 - DNA, 6240 bp, Homo sapiens
atttatattcattttttactcttttccatcaaaacataattttactaagtacgcatgttctgtgtccgtgttttgtcatcactgaagccacttttggagtcacctagtaatagcctttccactctatctagttctgtagcttttatgtgtgtaaattacttcaaatctgtttatgatcctattgctggaaactttatcccaagacacaaaaatcttttctattagaagttattaactttaaaacaattatttattttattttattttattttttgagacagagtctcgctttgtcacccaggctggagtgcagtggcacgatctcggctcactgcaagctccacctcccgagttcatgccattctcctgcctcagcctcccgagtagctgggactacgggcgtccgccaccatgcccagctaattttttttgtatttttggtagagacaaggtttcaccgtgttagccaggatggtcttgatctcctgacctcgtggtccacctgcctcggcctcccaaagcgctgggattataggcgtgagccaccgcacctggcctaaaacaattatttctttaaaaaaacataccctctattctattttgtgtcttcacaacacaatcacttactgtattgctttttaaagtgatctttaaagagtcttgcagaagagactacacagcaggcccgagaccatcctgagaggcctgtgtgcaaggctggccccccgctggtgtcaggacggtgcccaccaccctcaatgaagaggggctccctgtgcttagctgcttgtgtggggaacaagggcactgtttgaagaagcaaacatggtagcatcaagcattccttgaaatatggctccaagggaacaatgagacgtgctcttggtcttggaagctcatcagaatgtttagagctggggaggcctccaaacgcccattgcctgggccgtcgcccccaagggtgcggagtgtggaggttgcccgggggagggccggctacggattcacgctttcgggacaggcaccctgtgtgctcagctgcgtcatgagagggagccctgcggatttcgtgggcctccgagctggagaccagatacttgctgtcaatgaaatcaacgtgaaaaaagcatctcatgaagatgtagtgaaattaattgggaagtgctctggtgtccttcacatggtgattgctgaaggcgtcggccgcttcgaatcctgttccagtgatgaagaagggggactctatgaaggaaaaggctggctgaagcccaagctggattctaaagcactaggtataaacagagcagagcgagtcgtggaggaaatgcagtctggtggaattttcaatatgatttttgaaaacccgagcctttgtgcgagcaattcagagcccttgaaattgaaacaaagatccctttcagagtcggccgcaactcgatttgatgttggacatgaaagtataaataatccaaatcccaacatgctttctaaggaggaaatatcaaaagttattcatgatgattcggttttcagcattggactagaaagtcatgacgattttgcattggatgcaagtattttaaacgtggcgatgatcgtgggctacttaggctccattgagcttccttccacgagctccaacctggagtccgacagcttgcaagccatccgcggctgcatgcggcgcctgcgggcagagcagaaaatccactcgctggtgaccatgaagatcatgcacgactgtgtgcagctgagcactgacaaggctggagtcgtggccgagtacccggccgagaagctggccttcagcgccgtgtgcccggacgaccggcgatttttcgggttggttaccatgcagacgaatgacgacgggagcctggcccaggaggaggagggcgccctgcggacttcctgccacgtgttcatggtggacccagacttgtttaatcacaagatccaccaaggcattgctcggcggtttgggtttgagtgcacggccgacccagacaccaatggctgtctggaattcccggcgtcctccctccccgtcctgcagttcatctctgtcctgtaccgagacatgggtgagctgattgagggcatgcgggcccgcgcctttctggacggggacgccgatgcccaccagaacaacagcaccagcagcaacagtgacagcggcattgggaacttccaccaggaggagaagagcaaccgggtccttgtggtggacctgggtgggagctcgagcagacacggccccggaggcagcgcgtgggacggtgtgggtgggaggggtgcccagccctggggtgctccctggactgggcccttctgtccggaccccgaagggagccccccatttgaggccgctcatcagactgacaggttctgggacctaaacaagcacctagggccagcctctcctgtggaggtgcccccagcttccttgaggagctcagtccccccttccaagaggggcaccgtgggtgctggctgtggtttcaaccagcgctggctcccggtccacgtgctccgggagtggcagtgcggacacaccagcgaccaggactcttacacagattccaccgatggctggtccagcatcaactgcggcacactgccccctcctatgagcaagatccccgcagaccgctacagggtggagggcagcttcgcgcagcccccgctgaatgccccgaagagggagtggtccaggaaggcctttggaatgcaaagcatttttggtccccatcgaaatgttcgaaagactaaggaagataaaaagggctcaaaatttgggcggggaactggactcactcagccttctcaacgcacgtctgctcggagatcatttgggagatccaagagattcagtatcactcgctcccttgatgatcttgagtctgcaactgtgtctgatggcgagttgacgggcgccgacctgaaggactgcgtcagcaacaacagcctgagcagcaatgccagcctccccagcgtgcagagctgccggcgcctgcgtgagaggagggtcgccagctgggccgtgtcctttgagcgcctgctgcaggaccccgtcggtgtccgctacttctctgattttctaaggaaagaattcagtgaagaaaacattttattctggcaggcctgtgaatattttaatcatgttcctgcacatgacaaaaaggagctttcctacagggcccgggagattttcagtaagtttctctgcagcaaagccaccaccccggtcaacatcgacagccaggcccagctagcagacgacgtcctccgcgcacctcacccagacatgttcaaggagcagcagctgcagatcttcaatctcatgaagtttgatagctacactcgctttctgaagtccccgctgtaccaggaatgcatcctggcggaagtggagggccgtgcactcccggactcgcagcaggtccccagcagcccggcttccaagcacagcctcggttcagaccactccagtgtgtccacgccaaaaaagttaagtggaaaatcaaaatccggccgatccctgaatgaagagctgggggatgaggacagcgagaagaagcggaaaggcgcgtttttctcgtggtcgcggaccaggagcaccgggaggtcccagaaaaagagggagcacggggaccacgcagacgacgccctgcatgccaatggaggcctgtgtcgccgagagtcgcagggctctgtgtcctctgcggggagcctggacctgtcggaggcctgcaggactttggcacccgagaaggacaaggccaccaagcactgctgcattcatctcccggatgggacatcctgcgtggtggctgtcaaggcgggcttctccatcaaagacatcctgtccggactctgtgagcggcatggcatcaacggggcggccgcggacctcttcctggtgggcggggacaagcctctggtgctgcaccaagacagtagcatcttggagtcaagggacctgcgcctagaaaagcgcaccttgtttcggctggatcttgttccgattaaccggtcagtgggactcaaggccaagcccaccaagcccgtcacggaggtgctgcggcccgtggtggccagatacggcctggacctcagtggcctgctggtgaggctgagtggagagaaggagcccctggaccttggcgcccctatatcgagtctggacggacagcgggttgtcttggaggagaaggatccttccagaggaaaggcatccgcagataaacagaaaggtgtgccagtgaaacagaacacagctgtaaattccagctccagaaaccactcggctacgggagaggaaagaacactaggcaagtctaattctattaaaataaaaggagaaaatggaaaaaatgctagggatccccggctttcaaagagagaagaatctattgcaaagattgggaaaaaaaaatatcagaaaattaatttggacgaagcagaggagttttttgagcttatttccaaagctcagagcaacagagcagatgaccaacgtgggctgctaaggaaggaagacctggtgttgccagagttcctccgtttacctcctggttccacagaactcaccctccccactccagctgctgtggccaagggctttagcaagagaagcgccacaggcaacggccgggagagcgcctcccagcctggcgagcagtgggagccagtccaggagagcagcgacagcccgtccaccagcccgggctcagcctccagcccccctggacctcctgggacgaccccccccgggcagaagtctcccagcgggcccttctgcactccccagtcccccgtctccctcgcgcaggagggcaccgcccagatctggaagaggcagtctcaggaagtggaggccgggggcatccagacggtggaggatgagcacgtggccgagctgaccctgatgggggagggggacatcagcagccccaacagcaccttgctgccgccgccctccaccccccaggaagtgccaggaccttccagaccaggtacctccaggttctgatccctccaccttggccccgtaagcgtggtctgctcagcttccagtcagaaaggacagtgggcccccggctgccactgtttgctggtggtctccgtgaccccctcctcacctgctggttgggggcttccttggccctcttggaaaggaggggctcgtgtggccccaggccagtgtctgtcaggatggtccccccgaggcgctctgggcaggcatcctggtgtcctgagaggctcttgcaggaatgatacgtggcagtgcctgcagcgaggtctgggaacaccctgggtgaggcctgggggtttccgaaaatggaggcattcctttccaaatctggacagcgatcgtttttagtgtttctgtctcaagactggaaaacaatagcatttgtcttgagtgaggaagtgaagcccgctgtgttcatagcaggagagggctcccagacacaggcccgtcctcggaagagccttgagagtgcagctcggacccaccggcggcccccgtagcaggtggtgtgggtgctcgggagtggaggtgacgtcagcagcgctctctgaccgcgggtgtcacgggcatttctcaaaggaagcaggggattcagtgagtgtgaaggtgaacaggatggcctggcagcagggatgtttccgtgagccacaaataccagaaactgaggcgaggctcccagcagccggtagggaaaggtgtttccaggggtccgagggccgtggcctgcgtggccatcccctggagagaggagccgctcagggtgcgcgtcatggagtgtgctcaggggtgcgtggacacctctgctgtggtttgctgctgggggcgatgggagcgcctctccgtcctgtgccctggtccaggatgctgacagcagtgagaggcctgccgtgaggtttggtcttgtcagacctgtagcctggacctcgccgggggaccagggagtgcacgtctgtagatctgtacatatctgggcctttggaggccacgtgtggcatgggaggggctacctggtccctttcacagccaggacacgcctggatgagaaagcctgaggtgcctggcatgcccaccggtgccactctgcagcctccacccctggcctgagtccccctccatccgtcttggtggacacctgtgtggctctcacctgcgttttgagtctgttcttccaggagtaataaattctggacatcatcactgga

SEQ ID NO: 3616 - DNA, 3010 bp, Homo sapiens
agaatagattcattggcagctgtaattaaggttgtgaactgcaccacgatgctaaaaaaaacaaattctctgcagctgttttactgactgagaaattacccctgtcggccgaagttttattcttctgatttggtagaggaaatagtttaaaaatgatctcacagcgtgatttatgtaaacggcgcttctttctttggatgagacaattgagatagagtctgaaaccctggcaagccacagcttcctgcagtgtcctgttgccatgggttacgaagggagcgagagggaacttcatcggaaatgcctttaaacttttctcacacgcacaagctgcggtgttgaatggtgtgtcttagacccgggtgcctagtgtggctcggtgccttacaatgaatttggggaaagagttgtcaaacgaaacccatgtttctaatgaccagcagtctgcaactgtgtctgatggcgagttgacgggcgccgacctgaaggactgcgtcagcaacaacagcctgagcagcaatgccagcctccccagcgtgcagagctgccggcgcctgcgtgagaggagggtcgccagctgggccgtgtcctttgagcgcctgctgcaggaccccgtcggtgtccgctacttctctgattttctaaggaaagaattcagtgaagaaaacattttattctggcaggcctgtgaatattttaatcatgttcctgcacatgacaaaaaggagctttcctacagggcccgggagattttcagtaagtttctctgcagcaaagccaccaccccggtcaacatcgacagccaggcccagctagcagacgacgtcctccgcgcacctcacccagacatgttcaaggagcagcagctgcagatcttcaatctcatgaagtttgatagctacactcgctttctgaagtccccgctgtaccaggaatgcatcctggcggaagtggagggccgtgcactcccggactcgcagcaggtccccagcagcccggcttccaagcacagcctcggttcagaccactccagtgtgtccacgccaaaaaagttaagtggaaaatcaaaatccggccgatccctgaatgaagagctgggggatgaggacagcgagaagaagcggaaaggcgcgtttttctcgtggtcgcggaccaggagcaccgggaggtcccagaaaaagagggagcacggggaccacgcagacgacgccctgcatgccaatggaggcctgtgtcgccgagagtcgcagggctctgtgtcctctgcggggagcctggacctgtcggaggcctgcaggactttggcacccgagaaggacaaggccaccaagcactgctgcattcatctcccggatgggacatcctgcgtggtggctgtcaaggcgggcttctccatcaaagacatcctgtccggactctgtgagcggcatggcatcaacggggcggccgcggacctcttcctggtgggcggggacaagcctctggtgctgcaccaagacagtagcatcttggagtcaagggacctgcgcctagaaaagcgcaccttgtttcggctggatcttgttccgattaaccggtcagtgggactcaaggccaagcccaccaagcccgtcacggaggtgctgcggcccgtggtggccagatacggcctggacctcagtggcctgctggtgaggctgagtggagagaaggagcccctggaccttggcgcccctatatcgagtctggacggacagcgggttgtcttggaggagaaggatccttccagaggaaaggcatccgcagataaacagaaaggtgtgccagtgaaacagaacacagctgtaaattccagctccagaaaccactcggctacgggagaggaaagaacactaggcaagtctaattctattaaaataaaaggagaaaatggaaaaaatgctagggatccccggctttcaaagagagaagaatctattgcaaagattgggaaaaaaaaatatcagaaaattaatttggacgaagcagaggagttttttgagcttatttccaaagctcagagcaacagagcagatgaccaacgtgggctgctaaggaaggaagacctggtgttgccagagttcctccgtttacctcctggttccacagaactcaccctccccactccagctgctgtggccaagggctttagcaagagaagcgccacaggcaacggccgggagagcgcctcccagcctggcgagcagtgggagccagtccaggagagcagcgacagcccgtccaccagcccgggctcagcctccagcccccctggacctcctgggacgaccccccccgggcagaagtctcccagcgggcccttctgcactccccagtcccccgtctccctcgcgcaggagggcaccgcccagatctggaagaggcagtctcaggaagtggaggccgggggcatccagacggtggaggatgagcacgtggccgagctgaccctgatgggggagggggacatcagcagccccaacagcaccttgctgccgccgccctccaccccccaggaagtgccaggaccttccagaccaggaagtgggacccatggcagccgagacctcccagtcaacagaatcatcgatgtggatcttgtaactggctcggcgcccgggcgggatggtggcatagcgggggcacaggctggccctgggaggtcgcaggccagtggtgggcctcctacatcagacctccctggcttgggccccgtcccgggtgagcctgctaagcccaagaccagcgctcaccacgccaccttcgtctgagctgccctggcctggccaactctcctgtggacatgtcggggtggggcagcccaggtggattctgtgggcctcaggggggccaccctggccaccacaccctcaggagcccagccaggagggcagggggtgacctcgctggaggcactggccccggacattcgccatgctggccatggggctccctggccctggcctcctgctgcccaataaagcatttctga

SEQ ID NO: 3617 - DNA, 5469 bp, Homo sapiens
atttatattcattttttactcttttccatcaaaacataattttactaagtacgcatgttctgtgtccgtgttttgtcatcactgaagccacttttggagtcacctagtaatagcctttccactctatctagttctgtagcttttatgtgtgtaaattacttcaaatctgtttatgatcctattgctggaaactttatcccaagacacaaaaatcttttctattagaagttattaactttaaaacaattatttattttattttattttattttttgagacagagtctcgctttgtcacccaggctggagtgcagtggcacgatctcggctcactgcaagctccacctcccgagttcatgccattctcctgcctcagcctcccgagtagctgggactacgggcgtccgccaccatgcccagctaattttttttgtatttttggtagagacaaggtttcaccgtgttagccaggatggtcttgatctcctgacctcgtggtccacctgcctcggcctcccaaagcgctgggattataggcgtgagccaccgcacctggcctaaaacaattatttctttaaaaaaacataccctctattctattttgtgtcttcacaacacaatcacttactgtattgctttttaaagtgatctttaaagagtcttgcagaagagactacacagcaggcccgagaccatcctgagaggcctgtgtgcaaggctggccccccgctggtgtcaggacggtgcccaccaccctcaatgaagaggggctccctgtgcttagctgcttgtgtggggaacaagggcactgtttgaagaagcaaacatggtagcatcaagcattccttgaaatatggctccaagggaacaatgagacgtgctcttggtcttggaagctcatcagaatgtttagagctggggaggcctccaaacgcccattgcctgggccgtcgcccccaagggtgcggagtgtggaggttgcccgggggagggccggctacggattcacgctttcgggacaggcaccctgtgtgctcagctgcgtcatgagagggagccctgcggatttcgtgggcctccgagctggagaccagatacttgctgtcaatgaaatcaacgtgaaaaaagcatctcatgaagatgtagtgaaattaattgggaagtgctctggtgtccttcacatggtgattgctgaaggcgtcggccgcttcgaatcctgttccagtgatgaagaagggggactctatgaaggaaaaggctggctgaagcccaagctggattctaaagcactaggtataaacagagcagagcgagtcgtggaggaaatgcagtctggtggaattttcaatatgatttttgaaaacccgagcctttgtgcgagcaattcagagcccttgaaattgaaacaaagatccctttcagagtcggccgcaactcgatttgatgttggacatgaaagtataaataatccaaatcccaacatgctttctaaggaggaaatatcaaaagttattcatgatgattcggttttcagcattggactagaaagtcatgacgattttgcattggatgcaagtattttaaacgtggcgatgatcgtgggctacttaggctccattgagcttccttccacgagctccaacctggagtccgacagcttgcaagccatccgcggctgcatgcggcgcctgcgggcagagcagaaaatccactcgctggtgaccatgaagatcatgcacgactgtgtgcagctgagcactgacaaggctggagtcgtggccgagtacccggccgagaagctggccttcagcgccgtgtgcccggacgaccggcgatttttcgggttggttaccatgcagacgaatgacgacgggagcctggcccaggaggaggagggcgccctgcggacttcctgccacgtgttcatggtggacccagacttgtttaatcacaagatccaccaaggcattgctcggcggtttgggtttgagtgcacggccgacccagacaccaatggctgtctggaattcccggcgtcctccctccccgtcctgcagttcatctctgtcctgtaccgagacatgggtgagctgattgagggcatgcgggcccgcgcctttctggacggggacgccgatgcccaccagaacaacagcaccagcagcaacagtgacagcggcattgggaacttccaccaggaggagaagagcaaccgggtccttgtggtggacctgggtgggagctcgagcagacacggccccggaggcagcgcgtgggacggtgtgggtgggaggggtgcccagccctggggtgctccctggactgggcccttctgtccggaccccgaagggagccccccatttgaggccgctcatcagactgacaggttctgggacctaaacaagcacctagggccagcctctcctgtggaggtgcccccagcttccttgaggagctcagtccccccttccaagaggggcaccgtgggtgctggctgtggtttcaaccagcgctggctcccggtccacgtgctccgggagtggcagtgcggacacaccagcgaccaggactcttacacagattccaccgatggctggtccagcatcaactgcggcacactgccccctcctatgagcaagatccccgcagaccgctacagggtggagggcagcttcgcgcagcccccgctgaatgccccgaagagggagtggtccaggaaggcctttggaatgcaaagcatttttggtccccatcgaaatgttcgaaagactaaggaagataaaaagggctcaaaatttgggcggggaactggactcactcagccttctcaacgcacgtctgctcggagatcatttgggagatccaagagattcagtatcactcgctcccttgatgatcttgagtctgcaactgtgtctgatggcgagttgacgggcgccgacctgaaggactgcgtcagcaacaacagcctgagcagcaatgccagcctccccagcgtgcagagctgccggcgcctgcgtgagaggagggtcgccagctgggccgtgtcctttgagcgcctgctgcaggaccccgtcggtgtccgctacttctctgattttctaaggaaagaattcagtgaagaaaacattttattctggcaggcctgtgaatattttaatcatgttcctgcacatgacaaaaaggagctttcctacagggcccgggagattttcagtaagtttctctgcagcaaagccaccaccccggtcaacatcgacagccaggcccagctagcagacgacgtcctccgcgcacctcacccagacatgttcaaggagcagcagctgcagatcttcaatctcatgaagtttgatagctacactcgctttctgaagtccccgctgtaccaggaatgcatcctggcggaagtggagggccgtgcactcccggactcgcagcaggtccccagcagcccggcttccaagcacagcctcggttcagaccactccagtgtgtccacgccaaaaaagttaagtggaaaatcaaaatccggccgatccctgaatgaagagctgggggatgaggacagcgagaagaagcggaaaggcgcgtttttctcgtggtcgcggaccaggagcaccgggaggtcccagaaaaagagggagcacggggaccacgcagacgacgccctgcatgccaatggaggcctgtgtcgccgagagtcgcagggctctgtgtcctctgcggggagcctggacctgtcggaggcctgcaggactttggcacccgagaaggacaaggccaccaagcactgctgcattcatctcccggatgggacatcctgcgtggtggctgtcaaggcgggcttctccatcaaagacatcctgtccggactctgtgagcggcatggcatcaacggggcggccgcggacctcttcctggtgggcggggacaagcctctggtgctgcaccaagacagtagcatcttggagtcaagggacctgcgcctagaaaagcgcaccttgtttcggctggatcttgttccgattaaccggtcagtgggactcaaggccaagcccaccaagcccgtcacggaggtgctgcggcccgtggtggccagatacggcctggacctcagtggcctgctggtgaggctgagtggagagaaggagcccctggaccttggcgcccctatatcgagtctggacggacagcgggttgtcttggaggagaaggatccttccagaggaaaggcatccgcagataaacagaaaggtgtgccagtgaaacagaacacagctgtaaattccagctccagaaaccactcggctacgggagaggaaagaacactaggcaagtctaattctattaaaataaaaggagaaaatggaaaaaatgctagggatccccggctttcaaagagagaagaatctattgcaaagattgggaaaaaaaaatatcagaaaattaatttggacgaagcagaggagttttttgagcttatttccaaagctcagagcaacagagcagatgaccaacgtgggctgctaaggaaggaagacctggtgttgccagagttcctccgtttacctcctggttccacagaactcaccctccccactccagctgctgtggccaagggctttagcaagagaagcgccacaggcaacggccgggagagcgcctcccagcctggcgagcagtgggagccagtccaggagagcagcgacagcccgtccaccagcccgggctcagcctccagcccccctggacctcctgggacgaccccccccgggcagaagtctcccagcgggcccttctgcactccccagtcccccgtctccctcgcgcaggagggcaccgcccagatctggaagaggcagtctcaggaagtggaggccgggggcatccagacggtggaggatgagcacgtggccgagctgaccctgatgggggagggggacatcagcagccccaacagcaccttgctgccgccgccctccaccccccaggaagtgccaggaccttccagaccaggaagtgggacccatggcagccgagacctcccagtcaacagaatcatcgatgtggatcttgtaactggctcggcgcccgggcgggatggtggcatagcgggggcacaggctggccctgggaggtcgcaggccagtggtgggcctcctacatcagacctccctggcttgggccccgtcccgggtgagcctgctaagcccaagaccagcgctcaccacgccaccttcgtctgagctgccctggcctggccaactctcctgtggacatgtcggggtggggcagcccaggtggattctgtgggcctcaggggggccaccctggccaccacaccctcaggagcccagccaggagggcagggggtgacctcgctggaggcactggccccggacattcgccatgctggccatggggctccctggccctggcctcctgctgcccaataaagcatttctga

SEQ ID NO: 3618 - DNA, 5512 bp, Homo sapiens
agggcactgtttgaagaagcaaacatggtagcatcaagcattccttgaaatatggctccaagggaacaatgagacgtgctcttggtcttggaagctcatcagaatgtttagagctggggaggcctccaaacgcccattgcctgggccgtcgcccccaagggtgcggagtgtggaggttgcccgggggagggccggctacggattcacgctttcgggacaggcaccctgtgtgctcagctgcgtcatgagagggagccctgcggatttcgtgggcctccgagctggagaccagatacttgctgtcaatgaaatcaacgtgaaaaaagcatctcatgaagatgtagtgaaattaattgggaagtgctctggtgtccttcacatggtgattgctgaaggcgtcggccgcttcgaatcctgttccagtgatgaagaagggggactctatgaaggaaaaggctggctgaagcccaagctggattctaaagcactaggtataaacagagcagagcgagtcgtggaggaaatgcagtctggtggaattttcaatatgatttttgaaaacccgagcctttgtgcgagcaattcagagcccttgaaattgaaacaaagatccctttcagagtcggccgcaactcgatttgatgttggacatgaaagtataaataatccaaatcccaacatgctttctaaggaggaaatatcaaaagttattcatgatgattcggttttcagcattggactagaaagtcatgacgattttgcattggatgcaagtattttaaacgtggcgatgatcgtgggctacttaggctccattgagcttccttccacgagctccaacctggagtccgacagcttgcaagccatccgcggctgcatgcggcgcctgcgggcagagcagaaaatccactcgctggtgaccatgaagatcatgcacgactgtgtgcagctgagcactgacaaggctggagtcgtggccgagtacccggccgagaagctggccttcagcgccgtgtgcccggacgaccggcgatttttcgggttggttaccatgcagacgaatgacgacgggagcctggcccaggaggaggagggcgccctgcggacttcctgccacgtgttcatggtggacccagacttgtttaatcacaagatccaccaaggcattgctcggcggtttgggtttgagtgcacggccgacccagacaccaatggctgtctggaattcccggcgtcctccctccccgtcctgcagttcatctctgtcctgtaccgagacatgggtgagctgattgagggcatgcgggcccgcgcctttctggacggggacgccgatgcccaccagaacaacagcaccagcagcaacagtgacagcggcattgggaacttccaccaggaggagaagagcaaccgggtccttgtggtggacctgggtgggagctcgagcagacacggccccggaggcagcgcgtgggacggtgtgggtgggaggggtgcccagccctggggtgctccctggactgggcccttctgtccggaccccgaagggagccccccatttgaggccgctcatcagactgacaggttctgggacctaaacaagcacctagggccagcctctcctgtggaggtgcccccagcttccttgaggagctcagtccccccttccaagaggggcaccgtgggtgctggctgtggtttcaaccagcgctggctcccggtccacgtgctccgggagtggcagtgcggacacaccagcgaccaggactcttacacagattccaccgatggctggtccagcatcaactgcggcacactgccccctcctatgagcaagatccccgcagaccgctacagggtggagggcagcttcgcgcagcccccgctgaatgccccgaagagggagtggtccaggaaggcctttggaatgcaaagcatttttggtccccatcgaaatgttcgaaagactaaggaagataaaaagggctcaaaatttgggcggggaactggactcactcagccttctcaacgcacgtctgctcggagatcatttgggagatccaagagattcagtatcactcgctcccttgatgatcttgagtctgcaactgtgtctgatggcgagttgacgggcgccgacctgaaggactgcgtcagcaacaacagcctgagcagcaatgccagcctccccagcgtgcagagctgccggcgcctgcgtgagaggagggtcgccagctgggccgtgtcctttgagcgcctgctgcaggaccccgtcggtgtccgctacttctctgattttctaaggaaagaattcagtgaagaaaacattttattctggcaggcctgtgaatattttaatcatgttcctgcacatgacaaaaaggagctttcctacagggcccgggagattttcagtaagtttctctgcagcaaagccaccaccccggtcaacatcgacagccaggcccagctagcagacgacgtcctccgcgcacctcacccagacatgttcaaggagcagcagctgcagatcttcaatctcatgaagtttgatagctacactcgctttctgaagtccccgctgtaccaggaatgcatcctggcggaagtggagggccgtgcactcccggactcgcagcaggtccccagcagcccggcttccaagcacagcctcggttcagaccactccagtgtgtccacgccaaaaaagttaagtggaaaatcaaaatccggccgatccctgaatgaagagctgggggatgaggacagcgagaagaagcggaaaggcgcgtttttctcgtggtcgcggaccaggagcaccgggaggtcccagaaaaagagggagcacggggaccacgcagacgacgccctgcatgccaatggaggcctgtgtcgccgagagtcgcagggctctgtgtcctctgcggggagcctggacctgtcggaggcctgcaggactttggcacccgagaaggacaaggccaccaagcactgctgcattcatctcccggatgggacatcctgcgtggtggctgtcaaggcgggcttctccatcaaagacatcctgtccggactctgtgagcggcatggcatcaacggggcggccgcggacctcttcctggtgggcggggacaagcctctggtgctgcaccaagacagtagcatcttggagtcaagggacctgcgcctagaaaagcgcaccttgtttcggctggatcttgttccgattaaccggtcagtgggactcaaggccaagcccaccaagcccgtcacggaggtgctgcggcccgtggtggccagatacggcctggacctcagtggcctgctggtgaggctgagtggagagaaggagcccctggaccttggcgcccctatatcgagtctggacggacagcgggttgtcttggaggagaaggatccttccagaggaaaggcatccgcagataaacagaaaggtgtgccagtgaaacagaacacagctgtaaattccagctccagaaaccactcggctacgggagaggaaagaacactaggcaagtctaattctattaaaataaaaggagaaaatggaaaaaatgctagggatccccggctttcaaagagagaagaatctattgcaaagattgggaaaaaaaaatatcagaaaattaatttggacgaagcagaggagttttttgagcttatttccaaagctcagagcaacagagcagatgaccaacgtgggctgctaaggaaggaagacctggtgttgccagagttcctccgtttacctcctggttccacagaactcaccctccccactccagctgctgtggccaagggctttagcaagagaagcgccacaggcaacggccgggagagcgcctcccagcctggcgagcagtgggagccagtccaggagagcagcgacagcccgtccaccagcccgggctcagcctccagcccccctggacctcctgggacgaccccccccgggcagaagtctcccagcgggcccttctgcactccccagtcccccgtctccctcgcgcaggagggcaccgcccagatctggaagaggcagtctcaggaagtggaggccgggggcatccagacggtggaggatgagcacgtggccgagctgaccctgatgggggagggggacatcagcagccccaacagcaccttgctgccgccgccctccaccccccaggaagtgccaggaccttccagaccaggtacctccaggttctgatccctccaccttggccccgtaagcgtggtctgctcagcttccagtcagaaaggacagtgggcccccggctgccactgtttgctggtggtctccgtgaccccctcctcacctgctggttgggggcttccttggccctcttggaaaggaggggctcgtgtggccccaggccagtgtctgtcaggatggtccccccgaggcgctctgggcaggcatcctggtgtcctgagaggctcttgcaggaatgatacgtggcagtgcctgcagcgaggtctgggaacaccctgggtgaggcctgggggtttccgaaaatggaggcattcctttccaaatctggacagcgatcgtttttagtgtttctgtctcaagactggaaaacaatagcatttgtcttgagtgaggaagtgaagcccgctgtgttcatagcaggagagggctcccagacacaggcccgtcctcggaagagccttgagagtgcagctcggacccaccggcggcccccgtagcaggtggtgtgggtgctcgggagtggaggtgacgtcagcagcgctctctgaccgcgggtgtcacgggcatttctcaaaggaagcaggggattcagtgagtgtgaaggtgaacaggatggcctggcagcagggatgtttccgtgagccacaaataccagaaactgaggcgaggctcccagcagccggtagggaaaggtgtttccaggggtccgagggccgtggcctgcgtggccatcccctggagagaggagccgctcagggtgcgcgtcatggagtgtgctcaggggtgcgtggacacctctgctgtggtttgctgctgggggcgatgggagcgcctctccgtcctgtgccctggtccaggatgctgacagcagtgagaggcctgccgtgaggtttggtcttgtcagacctgtagcctggacctcgccgggggaccagggagtgcacgtctgtagatctgtacatatctgggcctttggaggccacgtgtggcatgggaggggctacctggtccctttcacagccaggacacgcctggatgagaaagcctgaggtgcctggcatgcccaccggtgccactctgcagcctccacccctggcctgagtccccctccatccgtcttggtggacacctgtgtggctctcacctgcgttttgagtctgttcttccaggagtaataaattctggacatcatcactggactggcttacaacttttctttctcatttgaaactttgtttccactttagaaaataataaaagtattttaatcta

SEQ ID NO: 3619 - DNA, 2193 bp, Homo sapiens
gtgttcctcagatggacttttcgtttcctggagttttgtcatgaggcttaattaactcatgtctctctctcttttctttcagtctgcaactgtgtctgatggcgagttgacgggcgccgacctgaaggactgcgtcagcaacaacagcctgagcagcaatgccagcctccccagcgtgcagagctgccggcgcctgcgtgagaggagggtcgccagctgggccgtgtcctttgagcgcctgctgcaggaccccgtcggtgtccgctacttctctgattttctaaggaaagaattcagtgaagaaaacattttattctggcaggcctgtgaatattttaatcatgttcctgcacatgacaaaaaggagctttcctacagggcccgggagattttcagtaagtttctctgcagcaaagccaccaccccggtcaacatcgacagccaggcccagctagcagacgacgtcctccgcgcacctcacccagacatgttcaaggagcagcagctgcagatcttcaatctcatgaagtttgatagctacactcgctttctgaagtccccgctgtaccaggaatgcatcctggcggaagtggagggccgtgcactcccggactcgcagcaggtccccagcagcccggcttccaagcacagcctcggttcagaccactccagtgtgtccacgccaaaaaagttaagtggaaaatcaaaatccggccgatccctgaatgaagagctgggggatgaggacagcgagaagaagcggaaaggcgcgtttttctcgtggtcgcggaccaggagcaccgggaggtcccagaaaaagagggagcacggggaccacgcagacgacgccctgcatgccaatggaggcctgtgtcgccgagagtcgcagggctctgtgtcctctgcggggagcctggacctgtcggaggcctgcaggactttggcacccgagaaggacaaggccaccaagcactgctgcattcatctcccggatgggacatcctgcgtggtggctgtcaaggcgggcttctccatcaaagacatcctgtccggactctgtgagcggcatggcatcaacggggcggccgcggacctcttcctggtgggcggggacaagcctctggtgctgcaccaagacagtagcatcttggagtcaagggacctgcgcctagaaaagcgcaccttgtttcggctggatcttgttccgattaaccggtcagtgggactcaaggccaagcccaccaagcccgtcacggaggtgctgcggcccgtggtggccagatacggcctggacctcagtggcctgctggtgaggctgagtggagagaaggagcccctggaccttggcgcccctatatcgagtctggacggacagcgggttgtcttggaggagaaggatccttccagaggaaaggcatccgcagataaacagaaaggtgtgccagtgaaacagaacacagctgtaaattccagctccagaaaccactcggctacgagttttttgagcttatttccaaagctcagagcaacagagcagatgaccaacgtgggctgctaaggaaggaagacctggtgttgccagagttcctccgtttacctcctggttccacagaactcaccctccccactccagctgctgtggccaagggctttagcaagagaagcgccacaggcaacggccgggagagcgcctcccagcctggcgagcagtgggagccagtccaggagagcagcgacagcccgtccaccagcccgggctcagcctccagcccccctggacctcctgggacgaccccccccgggcagaagtctcccagcgggcccttctgcactccccagtcccccgtctccctcgcgcaggagggcaccgcccagatctggaagaggcagtctcaggaagtggaggccgggggcatccagacggtggaggatgagcacgtggccgagctgaccctgatgggggagggggacatcagcagccccaacagcaccttgctgccgccgccctccaccccccaggaagtgccaggaccttccagaccaggtacctccaggttctgatccctccaccttggccccgtaagcgtggtctgctcagcttccagtcagaaaggacagtgggcccccggctgccactgtttgctggtggtctccgtgaccccctcctcacctgctggttgggggcttccttgg

SEQ ID NO: 3620 - DNA, 2804 bp, Homo sapiens
aggtgtcctctgaggagagctgagcaggagaggagctgggactcgggaatggcagggcactgtttgaagaagcaaacatggtagcatcaagcattccttgaaatatggctccaagggaacaatgagacgtgctcttggtcttggaagctcatcagaatgtttagagctggggaggcctccaaacgcccattgcctgggccgtcgcccccaagggtgcggagtgtggaggttgcccgggggagggccggctacggattcacgctttcgggacaggcaccctgtgtgctcagctgcgtcatgagagggagccctgcggatttcgtgggcctccgagctggagaccagatacttgctgtcaatgaaatcaacgtgaaaaaagcatctcatgaagatgtagtgaaattaattgggaagtgctctggtgtccttcacatggtgattgctgaaggcgtcggccgcttcgaatcctgttccagtgatgaagaagggggactctatgaaggaaaaggctggctgaagcccaagctggattctaaagcactaggtataaacagagcagagcgagtcgtggaggaaatgcagtctggtggaattttcaatatgatttttgaaaacccgagcctttgtgcgagcaattcagagcccttgaaattgaaacaaagatccctttcagagtcggccgcaactcgatttgatgttggacatgaaagtataaataatccaaatcccaacatgctttctaaggaggaaatatcaaaagttattcatgatgattcggttttcagcattggactagaaagtcatgacgattttgcattggatgcaagtattttaaacgtggcgatgatcgtgggctacttaggctccattgagcttccttccacgagctccaacctggagtccgacagcttgcaagccatccgcggctgcatgcggcgcctgcgggcagagcagaaaatccactcgctggtgaccatgaagatcatgcacgactgtgtgcagctgagcactgacaaggctggagtcgtggccgagtacccggccgagaagctggccttcagcgccgtgtgcccggacgaccggcgatttttcgggttggttaccatgcagacgaatgacgacgggagcctggcccaggaggaggagggcgccctgcggacttcctgccacgtgttcatggtggacccagacttgtttaatcacaagatccaccaaggcattgctcggcggtttgggtttgagtgcacggccgacccagacaccaatggctgtctggaattcccggcgtcctccctccccgtcctgcagttcatctctgtcctgtaccgagacatgggtgagctgattgagggcatgcgggcccgcgcctttctggacggggacgccgatgcccaccagaacaacagcaccagcagcaacagtgacagcggcattgggaacttccaccaggaggagaagagcaaccgggtccttgtggtggacctgggtgggagctcgagcagacacggccccggaggcagcgcgtgggacggtgtgggtgggaggggtgcccagccctggggtgctccctggactgggcccttctgtccggaccccgaagggagccccccatttgaggccgctcatcagactgacaggttctgggacctaaacaagcacctagggccagcctctcctgtggaggtgcccccagcttccttgaggagctcagtccccccttccaagaggggcaccgtgggtgctggctgtggtttcaaccagcgctggctcccggtccacgtgctccgggagtggcagtgcggacacaccagcgaccaggactcttacacagattccaccgatggctggtccagcatcaactgcggcacactgccccctcctatgagcaagatccccgcagaccgctacagggtggagggcagcttcgcgcagcccccgctgaatgccccgaagagggagtggtccaggaaggcctttggaatgcaaagcatttttggtccccatcgaaatgttcgaaagactaaggaagataaaaagggctcaaaatttgggcggggaactggactcactcagccttctcaacgcacgtctgctcggagatcatttgggagatccaagagattcagtatcactcgctcccttgatgatcttgagagttgacgggcgccgacctgaaggactgcgtcagcaacaacagcctgagcagcaatgccagcctccccagcgtgcagagctgccggcgcctgcgtgagaggagggtcgccagctgggccgtgtcctttgagcgcctgctgcaggaccccgtcggtgtccgctacttctctgattttctaaggaaagaattcagtgaagaaaacattttattctggcaggcctgtgaatattttaatcatgttcctgcacatgacaaaaaggagctttcctacagggcccgggagattttcagtaagtttctctgcagcaaagccaccaccccggtcaacatcgacagccaggcccagctagcagacgacgtcctccgcgcacctcacccagacatgttcaaggagcagcagctgcagatcttcaatctcatgaagtttgatagctacactcgctttctgaagtccccgctgtaccaggaatgcatcctggcggaagtggagggccgtgcactcccggactcgcagcaggtccccagcagcccggcttccaagcacagcctcggttcagaccactccagtgtgtccacgccaaaaaagttaagtggaaaatcaaaatccggccgatccctgaatgaagagctgggggatgaggacagcgag

SEQ ID NO: 3621 - DNA, 1344 bp, Homo sapiens
aaacagccggggctccagcgggagaacgataatgcaaagtgctatgttcttggctgttcaacacgactgcagacccatggacaagagcgcaggcagtggccacaagagcgaggagaagcgagaaaagatgaaacggacccttttaaaagattggaagacccgtttgagctacttcttacaaaattcctctactcctgggaagcccaaaaccggcaaaaaaagcaaacagcaagctttcatcaagccttctcctgaggaagcacagctgtggtcagaagcatttgacgagctgctagccagcaaatatggtcttgctgcattcagggcttttttaaagtcggaattctgtgaagaaaatattgaattctggctggcctgtgaagacttcaaaaaaaccaaatcaccccaaaagctgtcctcaaaagcaaggaaaatatatactgacttcatagaaaaggaagctccaaaagagataaacatagattttcaaaccaaaactctgattgcccagaatatacaagaagctacaagtggctgctttacaactgcccagaaaagggtatacagcttgatggagaacaactcttatcctcgtttcttggagtcagaattctaccaggacttgtgtaaaaagccacaaatcaccacagagcctcatgctacatgaaatgtaaaagggagcccagaaatggaggacatttcattctttttcctgaggggaaggactgtgacctgccataaagactgaccttgaattcagcctgggtgttcaggaaacatcactcagaactattgattcaaagttgggtagtgaatcaggaagccagtaactgactaggagaagctggtatcagaacagcttccctcactgtgtacagaacgcaagaagggaataggtggtctgaacgtggtgtctcactctgaaaagcaggaatgtaagatgatgaaagagacaatgtaatactgttggtccaaaagcatttaaaatcaatagatctgggattatgtggccttaggtagctggttgtacatctttccctaaatcgatccatgttaccacatagtagttttagtttaggattcagtaacagtgaagtgtttactatgtgcaacggtattgaagttcttatgaccacagatcatcagtactgttgtctcatgtaatgctaaaactgaaatggtccgtgtttgcattgttaaaaatgatgtgtgaaatagaatgagtgctatggtgttgaaaactgcagtgtccgttatgagtgccaaaaatctgtcttgaaggcagctacactttgaagtggtctttgaatacttttaataaatttattttgataaataatattg

SEQ ID NO: 3622 - DNA, 5030 bp, Homo sapiens
agtcagccctgctgccagccagtgccgggtgctggggactcagggaggcccgccgggaccactgcgggacagtgagccgagcagaagctggaacgcaggagaggaaggagagggggcggtcagggctctcaggagccgggtcctgggcaaggcgcagccgttttcaaattttcaggaaagcggtcggctcacactcgagcagtaaaaagatgcctctggggaggaggcccgtgcagctctccgggcaatggtggtggctcggcctagagaggcggtagtggaacgcagaccctggtgggggaatgacatcaagggaggagacgggcgggaccccagatttctgcctgtgggcgatggaagtgaggttcactggccagcggagccggacacagaacgcgcaaaacgccgtgtaggcctggaggagccgaagagcaggcggaccccctccgcgggggaacagtttccgccgggagcacaaagcaacggaccggaagtggggggcggaagtgcagtgggctcagcgccgactgcgcgcctctgcccgcgaaaactctgagctggctgacagctggggacgggtggcggccctcgactggagtcggttgagttcctgagggaccccggttctggaaggttcgccgcggagacaagtgagcagtctgtgccatagggattctcgaagagaacagcgttgtgtcccagtgcacatgctcgcatcgcttaccaggagtgcccgagaccctaagatgttcggagtggttttttcgcacagacccgaatagcctgcccctcagccacgctctgtgcccttctgagaacaggctgatatgcccaagatagtcctgaatggtgtgaccgtagacttccctttccagccctacaaatgccaacaggagtacatgaccaaggtcctggaatgtctgcagcagaaggtgaatggcatcctggagagccctacgggtacagggaagacgctgtgcctgctgtgcaccacgctggcctggcgagaacacctccgagacggcatctctgcccgcaagattgccgagagggcgcaaggagagcttttcccggatcgggccttgtcatcctggggcaacgctgctgctgctgctggagaccccatagcttgctacacggacatcccaaagattatttacgcctccaggacccactcgcaactcacacaggtcatcaacgagcttcggaacacctcctaccggcctaaggtgtgtgtgctgggctcccgggagcagctgtgcatccatcctgaggtgaagaaacaagagagtaaccatctacagatccacttgtgccgtaagaaggtggcaagtcgctcctgtcatttctacaacaacgtagaagaaaaaagcctggagcaggagctggccagccccatcctggacattgaggacttggtcaagagcggaagcaagcacagggtgtgcccttactacctgtcccggaacctgaagcagcaagccgacatcatattcatgccgtacaattacttgttggatgccaagagccgcagagcacacaacattgacctgaaggggacagtcgtgatctttgacgaagctcacaacgtggagaagatgtgtgaagaatcggcatcctttgacctgactccccatgacctggcttcaggactggacgtcatagaccaggtgctggaggagcagaccaaggcagcgcagcagggtgagccccacccggagttcagcgcggactcccccagcccagggctgaacatggagctggaagacattgcaaagctgaagatgatcctgctgcgcctggagggggccatcgatgctgttgagctgcctggagacgacagcggtgtcaccaagccagggagctacatctttgagctgtttgctgaagcccagatcacgtttcagaccaagggctgcatcctggactcgctggaccagatcatccagcacctggcaggacgtgctggagtgttcaccaacacggccggactgcagaagctggcggacattatccagattgtgttcagtgtggacccctccgagggcagccctggttccccagcagggctgggggccttacagtcctataaggtgcacatccatcctgatgctggtcaccggaggacggctcagcggtctgatgcctggagcaccactgcagccagaaagcgagggaaggtgctgagctactggtgcttcagtcccggccacagcatgcacgagctggtccgccagggcgtccgctccctcatccttaccagcggcacgctggccccggtgtcctcctttgctctggagatgcagatccctttcccagtctgcctggagaacccacacatcatcgacaagcaccagatctgggtgggggtcgtccccagaggccccgatggagcccagttgagctccgcgtttgacagacggttttccgaggagtgcttatcctccctggggaaggctctgggcaacatcgcccgcgtggtgccctatgggctcctgatcttcttcccttcctatcctgtcatggagaagagcctggagttctggcgggcccgcgacttggccaggaagatggaggcgctgaagccgctgtttgtggagcccaggagcaaaggcagcttctccgagaccatcagtgcttactatgcaagggttgccgcccctgggtccaccggcgccaccttcctggcggtctgccggggcaaggccagcgaggggctggacttctcagacacgaatggccgtggtgtgattgtcacgggcctcccgtaccccccacgcatggacccccgggttgtcctcaagatgcagttcctggatgagatgaagggccagggtggggctgggggccagttcctctctgggcaggagtggtaccggcagcaggcgtccagggctgtgaaccaggccatcgggcgagtgatccggcaccgccaggactacggagctgtcttcctctgtgaccacaggttcgcctttgccgacgcaagagcccaactgccctcctgggtgcgtccccacgtcagggtgtatgacaactttggccatgtcatccgagacgtggcccagttcttccgtgttgccgagcgaactatgccagcgccggccccccgggctacagcacccagtgtgcgtggagaagatgctgtcagcgaggccaagtcgcctggccccttcttctccaccaggaaagctaagagtctggacctgcatgtccccagcctgaagcagaggtcctcagggtcaccagctgccggggaccccgagagtagcctgtgtgtggagtatgagcaggagccagttcctgcccggcagaggcccagggggctgctggccgccctggagcacagcgaacagcgggcggggagccctggcgaggagcaggcccacagctgctccaccctgtccctcctgtctgagaagaggccggcagaagaaccgcgaggagggaggaagaagatccggctggtcagccacccggaggagcccgtggctggtgcacagacggacagggccaagctcttcatggtggccgtgaagcaggagttgagccaagccaactttgccaccttcacccaggccctgcaggactacaagggttccgatgacttcgccgccctggccgcctgtctcggccccctctttgctgaggaccccaagaagcacaacctgctccaaggcttctaccagtttgtgcggccccaccataagcagcagtttgaggaggtctgtatccagctgacaggacgaggctgtggctatcggcctgagcacagcattccccgaaggcagcgggcacagccggtcctggaccccactggaagaacggcgccggatcccaagctgaccgtgtccacggctgcagcccagcagctggacccccaagagcacctgaaccagggcaggccccacctgtcgcccaggccacccccaacaggagaccctggcagccaaccacagtgggggtctggagtgcccagagcagggaagcagggccagcacgccgtgagcgcctacctggctgatgcccgcagggccctggggtccgcgggctgtagccaactcttggcagcgctgacagcctataagcaagacgacgacctcgacaaggtgctggctgtgttggccgccctgaccactgcaaagccagaggacttccccctgctgcacaggttcagcatgtttgtgcgtccacaccacaagcagcgcttctcacagacgtgcacagacctgaccggccggccctacccgggcatggagccaccgggaccccaggaggagaggcttgccgtgcctcctgtgcttacccacagggctccccaaccaggcccctcacggtccgagaagaccgggaagacccagagcaagatctcgtccttccttagacagaggccagcagggactgtgggggcgggcggtgaggatgcaggtcccagccagtcctcaggacctccccacgggcctgcagcatctgagtggggtgagcctcatgggagagacatcgctgggcagcaggccacgggagctccgggcgggcccctctcagcaggctgtgtgtgccagggctgtggggcagaggacgtggtgcccttccagtgccctgcctgtgacttccagcgctgccaagcctgctggcaacggcaccttcaggcctctaggatgtgcccagcctgccacaccgcctccaggaagcagagcgtcatgcaggtcttctggccagagccccacaaggaccatgagggcgctggaggggccaggcctgtcgctgctgtgcctggtgttggcgctgcctgccctgctgccggtgccggctgtacgcggagtggcagaaacacccacctacccctggcgggacgcagagacaggggagcggctggtgtgcgcccagtgccccccaggcacctttgtgcagcggccgtgccgccgagacagccccacgacgtgtggcccgtgtccaccgcgccactacacgcagttctggaactacctagagcgctgccgctactgcaacgtcctctgcggggagcgtga

SEQ ID NO: 3623 - DNA, 2273 bp, Homo sapiens
agcctctccggctactcggggtcagcgtggggcccctgcagcagatgagggtcttcacttcggtgaactgaacccttgaagcggctgtgggcagggcagcagggctatggccaccccccaggttcgcctttgccgacgcaagagcccaactgccctcctgggtgcgtccccacgtcagggtgtatgacaactttggccatgtcatccgagacgtggcccagttcttccgtgttgccgagcgaactatgccagcgccggccccccgggctacagcacccagtgtgcgtggagaagatgctgtcagcgaggccaagtcgcctggccccttcttctccaccaggaaagctaagagtctggacctgcatgtccccagcctgaagcagaggtcctcagggtcaccagctgccggggaccccgagagtagcctgtgtgtggagtatgagcaggagccagttcctgcccggcagaggcccagggggctgctggccgccctggagcacagcgaacagcgggcggggagccctggcgaggagcaggcccacagctgctccaccctgtccctcctgtctgagaagaggccggcagaagaaccgcgaggagggaggaagaagatccggctggtcagccacccggaggagcccgtggctggtgcacagacggacagggccaagctcttcatggtggccgtgaagcaggagttgagccaagccaactttgccaccttcacccaggccctgcaggactacaagggttccgatgacttcgccgccctggccgcctgtctcggccccctctttgctgaggaccccaagaagcacaacctgctccaaggcttctaccagtttgtgcggccccaccataagcagcagtttgaggaggtctgtatccagctgacaggacgaggctgtggctatcggcctgagcacagcattccccgaaggcagcgggcacagccggtcctggaccccactggaagaacggcgccggatcccaagctgaccgtgtccacggctgcagcccagcagctggacccccaagagcacctgaaccagggcaggccccacctgtcgcccaggccacccccaacaggagaccctggcagccaaccacagtgggggtctggagtgcccagagcagggaagcagggccagcacgccgtgagcgcctacctggctgatgcccgcagggccctggggtccgcgggctgtagccaactcttggcagcgctgacagcctataagcaagacgacgacctcgacaaggtgctggctgtgttggccgccctgaccactgcaaagccagaggacttccccctgctgcacaggttcagcatgtttgtgcgtccacaccacaagcagcgcttctcacagacgtgcacagacctgaccggccggccctacccgggcatggagccaccgggaccccaggaggagaggcttgccgtgcctcctgtgcttacccacagggctccccaaccaggcccctcacggtccgagaagaccgggaagacccagagcaagatctcgtccttccttagacagaggccagcagggactgtgggggcgggcggtgaggatgcaggtcccagccagtcctcaggacctccccacgggcctgcagcatctgagtggggtgagcctcatgggagagacatcgctgggcagcaggccacgggagctccgggcgggcccctctcagcaggctgtgtgtgccagggctgtggggcagaggacgtggtgcccttccagtgccctgcctgtgacttccagcgctgccaagcctgctggcaacggcaccttcaggcctctaggatgtgcccagcctgccacaccgcctccaggaagcagagcgtcatgcaggtcttctggccagagccccagtgagtgcccacggaggcccccagcacacccaacgtggcttgatcacctgcctgtccagctctggtgggccaagaacccacccaacagaataggccagcccatgccagccggcttggcccgctgcaggcctcaggcaggcggggcccatggttggtccctgcggtgggaccggatctgggcctgcctctgagaagccctgagctaccttggggtctggggtgggtttctgggaaagtgcttccccagaacttccctggctcctggcctgtgagtggtgccacaggggcaccccagctgagcccctcaccgggaaggaggagacccccgtgggcacgtgtccacttttaatcaggggacagggctctctaataaagctgctggcagtgcccagga

SEQ ID NO: 3624 - DNA, 4955 bp, Homo sapiens
agtcagccctgctgccagccagtgccgggtgctggggactcagggaggcccgccgggaccactgcgggacagtgagccgagcagaagctggaacgcaggagaggaaggagagggggcggtcagggctctcaggagccgggtcctgggcaaggcgcagccgttttcaaattttcaggaaagcggtcggctcacactcgagcagtaaaaagatgcctctggggaggaggcccgtgcagctctccgggcaatggtggtggctcggcctagagaggcggtagtggaacgcagaccctggtgggggaatgacatcaagggaggagacgggcgggaccccagatttctgcctgtgggcgatggaagtgaggttcactggccagcggagccggacacagaacgcgcaaaacgccgtgtaggcctggaggagccgaagagcaggcggaccccctccgcgggggaacagtttccgccgggagcacaaagcaacggaccggaagtggggggcggaagtgcagtgggctcagcgccgactgcgcgcctctgcccgcgaaaactctgagctggctgacagctggggacgggtggcggccctcgactggagtcggttgagttcctgagggaccccggttctggaaggttcgccgcggagacaagtgagcagtctgtgccatagggattctcgaagagaacagcgttgtgtcccagtgcacatgctcgcatcgcttaccaggagtgcccgagaccctaagatgttcggagtggttttttcgcacagacccgaatagcctgcccctcagccacgctctgtgcccttctgagaacaggctgatatgcccaagatagtcctgaatggtgtgaccgtagacttccctttccagccctacaaatgccaacaggagtacatgaccaaggtcctggaatgtctgcagcagaaggtgaatggcatcctggagagccctacgggtacagggaagacgctgtgcctgctgtgcaccacgctggcctggcgagaacacctccgagacggcatctctgcccgcaagattgccgagagggcgcaaggagagcttttcccggatcgggccttgtcatcctggggcaacgctgctgctgctgctggagaccccatagcttgctacacggacatcccaaagattatttacgcctccaggacccactcgcaactcacacaggtcatcaacgagcttcggaacacctcctaccggcctaaggtgtgtgtgctgggctcccgggagcagctgtgcatccatcctgaggtgaagaaacaagagagtaaccatctacagatccacttgtgccgtaagaaggtggcaagtcgctcctgtcatttctacaacaacgtagaagaaaaaagcctggagcaggagctggccagccccatcctggacattgaggacttggtcaagagcggaagcaagcacagggtgtgcccttactacctgtcccggaacctgaagcagcaagccgacatcatattcatgccgtacaattacttgttggatgccaagagccgcagagcacacaacattgacctgaaggggacagtcgtgatctttgacgaagctcacaacgtggagaagatgtgtgaagaatcggcatcctttgacctgactccccatgacctggcttcaggactggacgtcatagaccaggtgctggaggagcagaccaaggcagcgcagcagggtgagccccacccggagttcagcgcggactcccccagcccagggctgaacatggagctggaagacattgcaaagctgaagatgatcctgctgcgcctggagggggccatcgatgctgttgagctgcctggagacgacagcggtgtcaccaagccagggagctacatctttgagctgtttgctgaagcccagatcacgtttcagaccaagggctgcatcctggactcgctggaccagatcatccagcacctggcaggacgtgctggagtgttcaccaacacggccggactgcagaagctggcggacattatccagattgtgttcagtgtggacccctccgagggcagccctggttccccagcagggctgggggccttacagtcctataaggtgcacatccatcctgatgctggtcaccggaggacggctcagcggtctgatgcctggagcaccactgcagccagaaagcgagggaaggtgctgagctactggtgcttcagtcccggccacagcatgcacgagctggtccgccagggcgtccgctccctcatccttaccagcggcacgctggccccggtgtcctcctttgctctggagatgcagatccctttcccagtctgcctggagaacccacacatcatcgacaagcaccagatctgggtgggggtcgtccccagaggccccgatggagcccagttgagctccgcgtttgacagacggttttccgaggagtgcttatcctccctggggaaggctctgggcaacatcgcccgcgtggtgccctatgggctcctgatcttcttcccttcctatcctgtcatggagaagagcctggagttctggcgggcccgcgacttggccaggaagatggaggcgctgaagccgctgtttgtggagcccaggagcaaaggcagcttctccgagaccatcagtgcttactatgcaagggttgccgcccctgggtccaccggcgccaccttcctggcggtctgccggggcaaggccagcgaggggctggacttctcagacacgaatggccgtggtgtgattgtcacgggcctcccgtaccccccacgcatggacccccgggttgtcctcaagatgcagttcctggatgagatgaagggccagggtggggctgggggccagttcctctctgggcaggagtggtaccggcagcaggcgtccagggctgtgaaccaggccatcgggcgagtgatccggcaccgccaggactacggagctgtcttcctctgtgaccacaggttcgcctttgccgacgcaagagcccaactgccctcctgggtgcgtccccacgtcagggtgtatgacaactttggccatgtcatccgagacgtggcccagttcttccgtgttgccgagcgaactatgccagcgccggccccccgggctacagcacccagtgtgcgtggagaagatgctgtcagcgaggccaagtcgcctggccccttcttctccaccaggaaagctaagagtctggacctgcatgtccccagcctgaagcagaggtcctcagggtcaccagctgccggggaccccgagagtagcctgtgtgtggagtatgagcaggagccagttcctgcccggcagaggcccagggggctgctggccgccctggagcacagcgaacagcgggcggggagccctggcgaggagcaggcccacagctgctccaccctgtccctcctgtctgagaagaggccggcagaagaaccgcgaggagggaggaagaagatccggctggtcagccacccggaggagcccgtggctggtgcacagacggacagggccaagctcttcatggtggccgtgaagcaggagttgagccaagccaactttgccaccttcacccaggccctgcaggactacaagggttccgatgacttcgccgccctggccgcctgtctcggccccctctttgctgaggaccccaagaagcacaacctgctccaaggcttctaccagtttgtgcggccccaccataagcagcagtttgaggaggtctgtatccagctgacaggacgaggctgtggctatcggcctgagcacagcattccccgaaggcagcgggcacagccggtcctggaccccactggaagaacggcgccggatcccaagctgaccgtgtccacggctgcagcccagcagctggacccccaagagcacctgaaccagggcaggccccacctgtcgcccaggccacccccaacaggagaccctggcagccaaccacagtgggggtctggagtgcccagagcagggaagcagggccagcacgccgtgagcgcctacctggctgatgcccgcagggccctggggtccgcgggctgtagccaactcttggcagcgctgacagcctataagcaagacgacgacctcgacaaggtgctggctgtgttggccgccctgaccactgcaaagccagaggacttccccctgctgcacaggttcagcatgtttgtgcgtccacaccacaagcagcgcttctcacagacgtgcacagacctgaccggccggccctacccgggcatggagccaccgggaccccaggaggagaggcttgccgtgcctcctgtgcttacccacagggctccccaaccaggcccctcacggtccgagaagaccgggaagacccagagcaagatctcgtccttccttagacagaggccagcagggactgtgggggcgggcggtgaggatgcaggtcccagccagtcctcaggacctccccacgggcctgcagcatctgagtggggcctctaggatgtgcccagcctgccacaccgcctccaggaagcagagcgtcatgcaggtcttctggccagagccccagtgagtgcccacggaggcccccagcacacccaacgtggcttgatcacctgcctgtccagctctggtgggccaagaacccacccaacagaataggccagcccatgccagccggcttggcccgctgcaggcctcaggcaggcggggcccatggttggtccctgcggtgggaccggatctgggcctgcctctgagaagccctgagctaccttggggtctggggtgggtttctgggaaagtgcttccccagaacttccctggctcctggcctgtgagtggtgccacaggggcaccccagctgagcccctcaccgggaaggaggagacccccgtgggcacgtgtccacttttaatcaggggacagggctctctaataaagctgctggcagtgcccaggacggtg

SEQ ID NO: 3625 - DNA, 4273 bp, Homo sapiens
aacggaccggaagtggggggcggaagtgcagtgggctcagcgccgactgcgcgcctctgcccgcgaaaactctgagctggctgacagctggggacgggtggcggccctcgactggagtcggttgagttcctgagggaccccggttctggaaggttcgccgcggagacaagtgagcagtctgtgccatagggattctcgaagagaacagcgttgtgtcccagtgcacatgctcgcatcgcttaccaggagtgcccgagaccctaagatgttcggagtggttttttcgcacagacccgaatagcctgcccctcagccacgctctgtgcccttctgagaacaggctgatatgcccaagatagtcctgaatggtgtgaccgtagacttccctttccagccctacaaatgccaacaggagtacatgaccaaggtcctggaatgtctgcagcagaaggtgaatggcatcctggagagccctacgggtacagggaagacgctgtgcctgctgtgcaccacgctggcctggcgagaacacctccgagacggcatctctgcccgcaagattgccgagagggcgcaaggagagcttttcccggatcgggccttgtcatcctggggcaacgctgctgctgctgctggagaccccatagcttgctacacggacatcccaaagattatttacgcctccaggacccactcgcaactcacacaggtcatcaacgagcttcggaacacctcctaccgctcacgctgcagggccacgctgtgggtgttggagacagctcctcctcgacccacggtgctctctcccaccaggcctaaggtgtgtgtgctgggctcccgggagcagctgtgcatccatcctgaggtgaagaaacaagagagtaaccatctacagatccacttgtgccgtaagaaggtggcaagtcgctcctgtcatttctacaacaacgtagaagaaaaaagcctggagcaggagctggccagccccatcctggacattgaggacttggtcaagagcggaagcaagcacagggtgtgcccttactacctgtcccggaacctgaagcagcaagccgacatcatattcatgccgtacaattacttgttggatgccaagagccgcagagcacacaacattgacctgaaggggacagtcgtgatctttgacgaagctcacaacgtggagaagatgtgtgaagaatcggcatcctttgacctgactccccatgacctggcttcaggactggacgtcatagaccaggtgctggaggagcagaccaaggcagcgcagcagggtgagccccacccggagttcagcgcggactcccccagcccagggctgaacatggagctggaagacattgcaaagctgaagatgatcctgctgcgcctggagggggccatcgatgctgttgagctgcctggagacgacagcggtgtcaccaagccagggagctacatctttgagctgtttgctgaagcccagatcacgtttcagaccaagggctgcatcctggactcgctggaccagatcatccagcacctggcaggacgtgctggagtgttcaccaacacggccggactgcagaagctggcggacattatccagattgtgttcagtgtggacccctccgagggcagccctggttccccagcagggctgggggccttacagtcctataaggtgcacatccatcctgatgctggtcaccggaggacggctcagcggtctgatgcctggagcaccactgcagccagaaagcgagggaaggtgctgagctactggtgcttcagtcccggccacagcatgcacgagctggtccgccagggcgtccgctccctcatccttaccagcggcacgctggccccggtgtcctcctttgctctggagatgcagatccctttcccagtctgcctggagaacccacacatcatcgacaagcaccagatctgggtgggggtcgtccccagaggccccgatggagcccagttgagctccgcgtttgacagacggttttccgaggagtgcttatcctccctggggaaggctctgggcaacatcgcccgcgtggtgccctatgggctcctgatcttcttcccttcctatcctgtcatggagaagagcctggagttctggcgggcccgcgacttggccaggaagatggaggcgctgaagccgctgtttgtggagcccaggagcaaaggcagcttctccgagaccatcagtgcttactatgcaagggttgccgcccctgggtccaccggcgccaccttcctggcggtctgccggggcaaggccagcgaggggctggacttctcagacacgaatggccgtggtgtgattgtcacgggcctcccgtaccccccacgcatggacccccgggttgtcctcaagatgcagttcctggatgagatgaagggccagggtggggctgggggccagttcctctctgggcaggagtggtaccggcagcaggcgtccagggctgtgaaccaggccatcgggcgagtgatccggcaccgccaggactacggagctgtcttcctctgtgaccacaggttcgcctttgccgacgcaagagcccaactgccctcctgggtgcgtccccacgtcagggtgtatgacaactttggccatgtcatccgagacgtggcccagttcttccgtgttgccgagcgaactatgccagcgccggccccccgggctacagcacccagtgtgcgtggagaagatgctgtcagcgaggccaagtcgcctggccccttcttctccaccaggaaagctaagagtctggacctgcatgtccccagcctgaagcagaggtcctcagggtcaccagctgccggggaccccgagagtagcctgtgtgtggagtatgagcaggagccagttcctgcccggcagaggcccagggggctgctggccgccctggagcacagcgaacagcgggcggggagccctggcgaggagcaggcccacagctgctccaccctgtccctcctgtctgagaagaggccggcagaagaaccgcgaggagggaggaagaagatccggctggtcagccacccggaggagcccgtggctggtgcacagacggacagggccaagctcttcatggtggccgtgaagcaggagttgagccaagccaactttgccaccttcacccaggccctgcaggactacaagggttccgatgacttcgccgccctggccgcctgtctcggccccctctttgctgaggaccccaagaagcacaacctgctccaaggcttctaccagtttgtgcggccccaccataagcagcagtttgaggaggtctgtatccagctgacaggacgaggctgtggctatcggcctgagcacagcattccccgaaggcagcgggcacagccggtcctggaccccactggaagaacggcgccggatcccaagctgaccgtgtccacggctgcagcccagcagctggacccccaagagcacctgaaccagggcaggccccacctgtcgcccaggccacccccaacaggagaccctggcagccaaccacagtgggggtctggagtgcccagagcagggaagcagggccagcacgccgtgagcgcctacctggctgatgcccgcagggccctggggtccgcgggctgtagccaactcttggcagcgctgacagcctataagcaagacgacgacctcgacaaggtgctggctgtgttggccgccctgaccactgcaaagccagaggacttccccctgctgcacagcaacagcatgtttgtgcgtccacaccacaagcagcgcttctcacagacgtgcacagacctgaccggccggccctacccgggcatggagccaccgggaccccaggaggagaggcttgccgtgcctcctgtgcttacccacagggctccccaaccaggcccctcacggtccgagaagaccgggaagacccagagcaagatctcgtccttccttagacagaggccagcagggactgtgggggcgggcggtgaggatgcaggtcccagccagtcctcaggacctccccacgggcctgcagcatctgagtggggcctctaggatgtgcccagcctgccacaccgcctccaggaagcagagcgtcatgcaggtcttctggccagagccccagtgagtgcccacggaggcccccagcacacccaacgtggcttgatcacctgcctgtccagctctggtgggccaagaacccacccaacagaataggccagcccatgccagccggcttggcccgctgca

SEQ ID NO: 3626 - DNA, 4859 bp, Homo sapiens
cttgcacttcgcgggagaagttgttggcgcgaatggatcctgagcctcgataacagattcctcaaccggcccacccgccagccagccagcgccttcatcctggggctgcgatggacattcggaaattctttggagtaataccaagtggaaagaaacttgtaagtgaaacagtaaagaagaatgagaaaacaaagtctgatgaagaaactttaaaagcaaagaaaggaataaaggaaatcaaggtaaatagctcccgtaaagaggatgacttcaaacaaaagcaaccaagcaagaaaaagaggatcatctatgattcagattcagagtcagaggagacgttgcaggtaaaaaatgccaaaaagccaccagaaaaactgccagtatcttctaaacctggtaaaatttcacggcaggatcctgttacatacatttcagaaacagatgaagaagatgactttatgtgtaagaaggcggcctctaaatcaaaagagaatggaagatctacaaatagtcatcttggaacatcaaacatgaaaaagaatgaagaaaacactaagaccaagaataagcctttatcaccaataaaacttacacccacatcagtacttgattattttggaactggaagtgtccaaagatctaataagaagatggtggcaagcaaaagaaaagagctttcacaaaatacagatgagtctggattaaatgatgaagccatcgccaagcaattacagcttgatgaagatgcggagctggagaggcagttgcatgaagatgaagagtttgccagaacattagccatgttggatgaagaacccaagaccaaaaaggctcgaaaggacacagaagcgggagaaacgttttcatctgtccaagccaatttaagtaaagcagaaaaacataaatatcctcataaagtaaaaacagcacaagtttcagatgaaagaaagagctacagtcctaggaagcaaagtaaatatgaaagttcaaaagaatctcagcaacattccaagtcatcagctgacaaaataggagaagtctcttctcccaaggccagttctaagctggcaattatgaaaagaaaagaagagagctcttataaagaaatagagcctgtggcctcaaaaagaaaagaaaatgccattaaattgaaaggagagacaaaaactcctaagaaaaccaaaagttctccagctaaaaaagagtctgtaagtcctgaagattctgaaaagaaacgcactaattatcaagcttatcgaagctacttaaatcgagaaggtcccaaggctctgggctccaaagaaataccaaagggagctgaaaattgcttggaaggccttatatttgtaatcacaggcgtgctggagtctattgaacgagatgaggccaagtctctaattgaacgttatgggggaaaagtaacaggaaatgtcagcaagaaaacaaattatcttgtcatgggtcgtgatagtggacagtccaagagtgataaggccgcagccttggggacaaaaattattgatgaagatggcctgttgaatctgattcggactatgccaggcaagaaatccaagtatgaaatagcagttgaaactgagatgaagaaagagtccaaactggagagaacaccccaaaaaaatgtccaaggaaaaagaaaaattagtccatctaaaaaggaatcagaatctaaaaagagcaggccgacttccaaaagggacagtttggcaaagacaataaaaaaggaaacagatgtgttttggaaaagcctggatttcaaggagcaggtggctgaggagacaagtggtgacagcaaggctaggaatttggctgatgacagcagtgaaaacaaagtggaaaatttgctctgggtggataaatataagccaacctcgctcaagaccataattggacagcaaggtgaccagagctgtgccaacaaactcctacgctggctccgaaactggcaaaagagttcttccgaagataaaaaacacgcaaagtttggtaaattttccggcaaagatgatggctctagttttaaagcagcgttgctgtcaggccctcctggtgttggcaaaaccaccacagcttccctggtgtgtcaggagttgggatacagctacgtggaactgaatgcaagtgacacccggagtaagagcagtttgaaggcgattgttgctgagtcactgaacaataccagcatcaaaggcttttattcaaatggagcagcctcttcagtaagcacgaaacatgctctcatcatggatgaagtagatggcatggcaggcaatgaggataggggaggaattcaggaattaattggcctgataaaacatactaaaattcccattatttgtatgtgcaatgatagaaatcatcccaagattcgctctctggttcattattgttttgatcttcgttttcaaagacctcgggttgaacagattaagggtgctatgatgtctattgcatttaaagaaggtttaaagattccccctccagctatgaatgaaataattttgggagccaatcaagatatcagacaggttttacataatctgagtatgtggtgtgcacgaagtaaagcattaacctatgaccaggccaaagctgattctcacagagccaaaaaggatatcaaaatgggcccatttgatgttgcccggaaagtgtttgcagctggagaggagactgctcacatgtcacttgtggacaagtcagatctcttttttcatgattattcaatagcacccctcttcgtccaggaaaattacatacacgtgaagcctgtagcagcagggggtgacatgaaaaagcacctgatgcttttaagcagagcagcagacagcatatgcgatggtgacctagtggacagccagatccggagtaagcaaaactggagtcttctgcctgcgcaggccatttatgccagtgttcttcctggagagttgatgagggggtacatgacccagtttcccaccttcccaagctggctggggaagcactcgtctacaggcaaacatgatcgtattgttcaggacctggccttgcatatgagtctcagaacttactccagcaaaaggactgtaaacatggattatctgtcgcttctaagggatgcacttgtacagcccttgacctcacaaggagtagacggagtacaggatgttgttgcacttatggacacatattatttgatgaaagaagactttgagaatatcatggaaatcagcagctggggtggcaaacctagtcccttttcaaagctggatcccaaggtgaaagcagccttcacaagagcttacaataaggaagcccaccttactccatactcacttcaagctataaaggcatctagacacagcacaagcccatccctggattcggaatacaatgaagaattaaatgaagatgactctcaatctgatgagaaagaccaagatgctatagaaactgatgccatgatcaagaaaaagacaaaatcttcaaagccttcaaaaccagaaaaagataaggagcccagaaaaggaaaaggaaaaagttcgaagaaatgaaaccatttttcactagcgacagccactttttactctccctcctgaccagtccagctggtctagagaaagccttgttttttcccagagcaaccatgttttagcataatgggatgacctggtgtcccattataaataaagggtggtatggctagaagggtatgagcagtaggcttatgtacacctcttatagaggttgataggactgcttgggtcctccactgtcctctgtcaatctagttagacgtgcttctgaatgactgtagaattggaactagaaactacacctgggctttggagtcagattttagttaacaataatgagcctgggagcagtagtactaaggcgtcttttgtaggcttaagaatttatcctaatggcctttataggaccaatgctgattttttttaaaggcagttcctattatgtggtgaaattttgtaaataaatgattatacaaaacagtcaccacctagaactgggtattctttgtacattgtcagatatctttcaaagtataaattaggaataaaaatgttccacatgatatgtgtacaaattctttttaagattgtcatcttgtacagcaaaatattatgttggtatattacttccttattaatttgcaaatgattggattaaaaaagctcactgtattccttactaacctgttgtgtgaaacataacattggcagtcgaggagtcagaactcggattcccagcctcactccctctgtgtgtgttgaccacgtctctgctgtgaataggatttcatgcagtggtctgttatggggctttgcagcgtggggggctgcagaagattctcagacattcttatccttctggagtctcaacccatcaggttcagaccagtaggaaccaggctgggtcaggctcttaatttcactatggtgggggacaaaatgaacactggcttttgttcactttgcccctgagagatctagtcctgtcctgtgatggcttccacaaaccctgttggaagtttgggttattcctataactgtatgtgttgagtggccgtgaggctatggacctagcctggaatttagatgtctagctattttttaatcttgttggtaaatgctcagaggtctgtgctacctctgtgaggtatatactaaaatgaatgtaaaataaggatcgtattccctgctttaaggaactggtagtcttgtttgggtgatgagacaaagttcttgagacatttaaactgtatttaccagtgtgaaaaatgtcatttatggagattaattcattatggaaataaaacattgcctaagcccttg

SEQ ID NO: 3627 - DNA, 4886 bp, Homo sapiens
accgcgcgccactgtcttcgccttcttgcacttcgcgggagaagttgttggcgcgaatggatcctgagcctcgataacagattcctcaaccggcccacccgccagccagccagcgccttcatcctggggctgcgatggacattcggaaattctttggagtaataccaagtggaaagaaacttgtaagtgaaacagtaaagaagaatgagaaaacaaagtctgatgaagaaactttaaaagcaaagaaaggaataaaggaaatcaaggtaaatagctcccgtaaagaggatgacttcaaacaaaagcaaccaagcaagaaaaagaggatcatctatgattcagattcagagtcagaggagacgttgcaggtaaaaaatgccaaaaagccaccagaaaaactgccagtatcttctaaacctggtaaaatttcacggcaggatcctgttacatacatttcagaaacagatgaagaagatgactttatgtgtaagaaggcggcctctaaatcaaaagagaatggaagatctacaaatagtcatcttggaacatcaaacatgaaaaagaatgaagaaaacactaagaccaagaataagcctttatcaccaataaaacttacacccacatcagtacttgattattttggaactggaagtgtccaaagatctaataagaagatggtggcaagcaaaagaaaagagctttcacaaaatacagatgagtctggattaaatgatgaagccatcgccaagcaattacagcttgatgaagatgcggagctggagaggcagttgcatgaagatgaagagtttgccagaacattagccatgttggatgaagaacccaagaccaaaaaggctcgaaaggacacagaagcgggagaaacgttttcatctgtccaagccaatttaagtaaagcagaaaaacataaatatcctcataaagtaaaaacagcacaagtttcagatgaaagaaagagctacagtcctaggaagcaaagtaaatatgaaagttcaaaagaatctcagcaacattccaagtcatcagctgacaaaataggagaagtctcttctcccaaggccagttctaagctggcaattatgaaaagaaaagaagagagctcttataaagaaatagagcctgtggcctcaaaaagaaaagaaaatgccattaaattgaaaggagagacaaaaactcctaagaaaaccaaaagttctccagctaaaaaagagtctgtaagtcctgaagattctgaaaagaaacgcactaattatcaagcttatcgaagctacttaaatcgagaaggtcccaaggctctgggctccaaagaaataccaaagggagctgaaaattgcttggaaggccttatatttgtaatcacaggcgtgctggagtctattgaacgagatgaggccaagtctctaattgaacgttatgggggaaaagtaacaggaaatgtcagcaagaaaacaaattatcttgtcatgggtcgtgatagtggacagtccaagagtgataaggccgcagccttggggacaaaaattattgatgaagatggcctgttgaatctgattcggactatgccaggcaagaaatccaagtatgaaatagcagttgaaactgagatgaagaaagagtccaaactggagagaacaccccaaaaaaatgtccaaggaaaaagaaaaattagtccatctaaaaaggaatcagaatctaaaaagagcaggccgacttccaaaagggacagtttggcaaagacaataaaaaaggaaacagatgtgttttggaaaagcctggatttcaaggagcaggtggctgaggagacaagtggtgacagcaaggctaggaatttggctgatgacagcagtgaaaacaaagtggaaaatttgctctgggtggataaatataagccaacctcgctcaagaccataattggacagcaaggtgaccagagctgtgccaacaaactcctacgctggctccgaaactggcaaaagagttcttccgaagataaaaaacacgcagcaaagtttggtaaattttccggcaaagatgatggctctagttttaaagcagcgttgctgtcaggccctcctggtgttggcaaaaccaccacagcttccctggtgtgtcaggagttgggatacagctacgtggaactgaatgcaagtgacacccggagtaagagcagtttgaaggcgattgttgctgagtcactgaacaataccagcatcaaaggcttttattcaaatggagcagcctcttcagtaagcacgaaacatgctctcatcatggatgaagtagatggcatggcaggcaatgaggataggggaggaattcaggaattaattggcctgataaaacatactaaaattcccattatttgtatgtgcaatgatagaaatcatcccaagattcgctctctggttcattattgttttgatcttcgttttcaaagacctcgggttgaacagattaagggtgctatgatgtctattgcatttaaagaaggtttaaagattccccctccagctatgaatgaaataattttgggagccaatcaagatatcagacaggttttacataatctgagtatgtggtgtgcacgaagtaaagcattaacctatgaccaggccaaagctgattctcacagagccaaaaaggatatcaaaatgggcccatttgatgttgcccggaaagtgtttgcagctggagaggagactgctcacatgtcacttgtggacaagtcagatctcttttttcatgattattcaatagcacccctcttcgtccaggaaaattacatacacgtgaagcctgtagcagcagggggtgacatgaaaaagcacctgatgcttttaagcagagcagcagacagcatatgcgatggtgacctagtggacagccagatccggagtaagcaaaactggagtcttctgcctgcgcaggccatttatgccagtgttcttcctggagagttgatgagggggtacatgacccagtttcccaccttcccaagctggctggggaagcactcgtctacaggcaaacatgatcgtattgttcaggacctggccttgcatatgagtctcagaacttactccagcaaaaggactgtaaacatggattatctgtcgcttctaagggatgcacttgtacagcccttgacctcacaaggagtagacggagtacaggatgttgttgcacttatggacacatattatttgatgaaagaagactttgagaatatcatggaaatcagcagctggggtggcaaacctagtcccttttcaaagctggatcccaaggtgaaagcagccttcacaagagcttacaataaggaagcccaccttactccatactcacttcaagctataaaggcatctagacacagcacaagcccatccctggattcggaatacaatgaagaattaaatgaagatgactctcaatctgatgagaaagaccaagatgctatagaaactgatgccatgatcaagaaaaagacaaaatcttcaaagccttcaaaaccagaaaaagataaggagcccagaaaaggaaaaggaaaaagttcgaagaaatgaaaccatttttcactagcgacagccactttttactctccctcctgaccagtccagctggtctagagaaagccttgttttttcccagagcaaccatgttttagcataatgggatgacctggtgtcccattataaataaagggtggtatggctagaagggtatgagcagtaggcttatgtacacctcttatagaggttgataggactgcttgggtcctccactgtcctctgtcaatctagttagacgtgcttctgaatgactgtagaattggaactagaaactacacctgggctttggagtcagattttagttaacaataatgagcctgggagcagtagtactaaggcgtcttttgtaggcttaagaatttatcctaatggcctttataggaccaatgctgattttttttaaaggcagttcctattatgtggtgaaattttgtaaataaatgattatacaaaacagtcaccacctagaactgggtattctttgtacattgtcagatatctttcaaagtataaattaggaataaaaatgttccacatgatatgtgtacaaattctttttaagattgtcatcttgtacagcaaaatattatgttggtatattacttccttattaatttgcaaatgattggattaaaaaagctcactgtattccttactaacctgttgtgtgaaacataacattggcagtcgaggagtcagaactcggattcccagcctcactccctctgtgtgtgttgaccacgtctctgctgtgaataggatttcatgcagtggtctgttatggggctttgcagcgtggggggctgcagaagattctcagacattcttatccttctggagtctcaacccatcaggttcagaccagtaggaaccaggctgggtcaggctcttaatttcactatggtgggggacaaaatgaacactggcttttgttcactttgcccctgagagatctagtcctgtcctgtgatggcttccacaaaccctgttggaagtttgggttattcctataactgtatgtgttgagtggccgtgaggctatggacctagcctggaatttagatgtctagctattttttaatcttgttggtaaatgctcagaggtctgtgctacctctgtgaggtatatactaaaatgaatgtaaaataaggatcgtattccctgctttaaggaactggtagtcttgtttgggtgatgagacaaagttcttgagacatttaaactgtatttaccagtgtgaaaaatgtcatttatggagattaattcattatggaaataaaacattgcctaagcccttg

SEQ ID NO: 3628 - DNA, 561 bp, Homo sapiens
cctgaagattctgaaaagaaacgcactaattatcaagcttatcgaagctacttaaatcgagaaggtcccaaggctctgggctccaaagaaataccaaagggagctgaaaattgcttggaaggccttatatttgtaatcacaggcgtgctggagtctattgaacgagatgaggccaagtctctaattgaacgttatgggggaaaagtaacaggaaatgtcagcaagaaaacaaattatcttgtcatgggtcgtgatagtggacagtccaagagtgataaggccgcagccttggggacaaaaattattgatgaagatggcctgttgaatctgattcggactatgccaggcaagaaatccaagtatgaaatagcagttgaaactgaggagttgggatacagctacgtggaactgaatgcaagtgacacccggagtaagagcagtttgaaggcgattgttgctgagtcactgaacaataccagcatcaaaggcttttattcaaatggagcagcctcttcagtaagcacgaaacatgctctcatcatggatgaagtagatggcatg

SEQ ID NO: 3629 - DNA, 4352 bp, Homo sapiens
gcacgtcgggggcgggagcggtgcgcgcaacttctcgggccaataactgcgcagcgcgcgggacccgggtggggaagctggagctgttgcggggtccgcggggaagtcttggcggtggagccatggtcggccaactgagcgagggggccattgcggccatcatgcagaagggggatacaaacataaagcccatcctccaagtcatcaacatccgtcccattactacggggaatagtccgccgcgttatcgactgctcatgagtgatggattgaacactctatcctctttcatgttggcgacacagttgaaccctctcgtggaggaagaacaattgtccagcaactgtgtatgccagattcacagatttattgtgaacactctgaaagacggaaggagagtagttatcttgatggaattagaagttttgaagtcagctgaagcagttggagtgaagattggcaatccagtgccctataatgaaggactcgggcagccgcaagtagctcctccagcgccagcagccagcccagcagcaagcagcaggccccagccgcagaatggaagctcgggaatgggttctactgtttctaaggcttatggtgcttcaaagacatttggaaaagctgcaggtcccagcctgtcacacacttctgggggaacacagtccaaagtggtgcccattgccagcctcactccttaccagtccaagtggaccatttgtgctcgtgttaccaacaaaagtcagatccgtacctggagcaactcccgaggggaagggaagcttttctccctagaactggttgacgaaagtggtgaaatccgagctacagctttcaatgagcaagtggacaagttctttcctcttattgaagtgaacaaggtgtattatttctcgaaaggcaccctgaagattgctaacaagcagttcacagctgttaaaaatgactacgagatgaccttcaataacgagacttccgtcatgccctgtgaggacgaccatcatttacctacggttcagtttgatttcacggggattgatgacctcgagaacaagtcgaaagactcacttgtagacatcatcgggatctgcaagagctatgaagacgccactaaaatcacagtgaggtctaacaacagagaagttgccaagaggaatatctacttgatggacacatccgggaaggtggtgactgctacactgtggggggaagatgctgataaatttgatggttctagacagcccgtgttggctatcaaaggagcccgagtctctgatttcggtggacggagcctctccgtgctgtcttcaagcactatcattgcgaatcctgacatcccagaggcctataagcttcgtggatggtttgacgcagaaggacaagccttagatggtgtttccatctctgatctaaagagcggcggagtcggagggagtaacaccaactggaaaaccttgtatgaggtcaaatccgagaacctgggccaaggcgacaagccggactactttagttctgtggccacagtggtgtatcttcgcaaagagaactgcatgtaccaagcctgcccgactcaggactgcaataagaaagtgattgatcaacagaatggattgtaccgctgtgagaagtgcgacaccgaatttcccaatttcaagtaccgcatgatcctgtcagtaaatattgcagattttcaagagaatcagtgggtgacttgtttccaggagtctgctgaagctatccttggacaaaatgctgcttatcttggggaattaaaagacaagaatgaacaggcatttgaagaagttttccagaatgccaacttccgatctttcatattcagagtcagggtcaaagtggagacctacaacgacgagtctcgaattaaggccactgtgatggacgtgaagcccgtggactacagagagtatggccgaaggctggtcatgagcatcaggagaagtgcattgatgtgagaggagcagtgccaatcgggcagaagtttgcaaataggcagaatggaatcgatttcctcccacctccgtgtgacgatcccatgttagctacacagtgcagaggctcttgatggtggactaagcaatttcccccctcgtgcgcatctcagaacccatcggtaggcaaaggaaaatacgctcaggtggttgtggtgtagactgtgtcaggcctacggagtcagccagtggctagcgcaagaccagtcactccctctgccttcaggcttctgtcaatttcattatcatcaagcaggaattatgtcgtaagtcactgaccctaactgcagaccatgaagtaaattatgtaactaggtttttgcttctccagtggtgaccacccccccccatccccgctcacaacttgggttcttctcagcggggcgagctgagaagcggtcatgagcacctggggattttagtaagtgtgtcttcctagaattcgaaggctctctctttctagaggtgctacatagttggtaatgcttggaatggcaatagggtagaatgattaatcaaaggcatatcttctatatctgaagagtatccttccttcagggtttaatagactgagtcagatgggtctgatattaatcaaaattgtctcttctgaggaccgctgataagcattgacttgccgtcccctaaggaaatccgagcggctacaaagcgtttctttacttctcacttcaattaatgctgcgcttcgcttggtgagtgcgtactttttctacctgtacacattcctgcattcatgtattttgttttttttgactaaagctatgttacatggaaaggattttgaagccttttgtttcccttgctttgttttaataaacagtatattctttggttgtgaatcctactttctttgaatgcaaagagttcctataactggaaagcaattaattagccttcataataaatgttcacttgggggggatgttaactcattataaacccgaagattagtccaaggcatggagatccttcttcctagtgtttgcagccctgaaatgcatctttcaaagcatgaaaacactaaaaacaaaaagccattttgcctgaggatgctgatgatctggcacttgggattttattgatgtttacgcagcagtctaacaccaaccacgctttgaaatgtgtacagacagtgagctggtaagaaaacagtaattatgctagtgggcctttcagtcagcaaaagcatgctcgctctgtgtgttcctaatcatattaattatctatccggtggctgcaacacaccgcctgccattggccgcacatctcgccgtcgtaccccggcagtgcggcggtcactctgcagccagaggacctgctgttcatcactgcacatgccgcctgcggaggcttttggatatggggagtgatggtgtcctgtctgtctcccccctcggtgtctgccgttgacataggggccagccagccctagacgggatgacttccgttcctgaggacagacacagagggactcctgctcagcctcactaattgtttagacacattccttcctacccttctctagtctcaggagatggtaactgggtcgcatttcagtctctgactgaggcctcagccatttttacggaagttcttttctgtctgaccttgcttataaagcatcgacgagaaaattacagtcttcaaccctcttctggattgacaaattgtggctgggaagtggcgatctagctttcagcccagtaaccagtctttcatgcctactactcccagcattccctcctctccccacgtgtctgtccacacagtgaagaggcctgaccagccgtggtaccaggacaggacgtgtccagggaacgctgacacctgtcctcgcgccttctcagtggccagcgtgatgaaaccagcacgtctccgtggatgtgattgggaacccaggggcagtgccagggggagggctccctcgaggaggctgtttctaacagatttccccactcaaagatcagatcaccagcagaggagcatcagaaactggctccactgttgggcttttcagagattttggtccctgcgggttgcctaaatagattctggcccacagtttacctcgaaaggctgttgatgttgttctgtttctcctctttcacttagagatcaatgttgattttgcgtacaccatgacatcagcgttaggcaattaggagaaaaaaatctaatcatttcgcctttatttcaagtggttcttgaattccctccagtctcattgtgaaaggggcagggaaaaaaataaaagggtaataatctgatttctgtccatatttccagtgttttatgctttccattaaaaccttgctaatctct

SEQ ID NO: 3630 - DNA, 2020 bp, Homo sapiens
aagctactcagataagaggctccaagaggacatttttggatgtgaaaaacaatgagaaggaggacaacacacatttacaatcgtcttaattttgtactcagaaaaaggatgtgaagacaatgcacagggaatacaatagtttcagatctgtgtacagtttccttttgcttcatctcctgcaacaatgtaatgaagacaccatgatatcattaacatttcacacaaaaggaaaatgaggctgaaatggtgtgggcaaggcccaggaatctggagcatccctaaccaagcaggagagcacctgggatagagaaagtgctcaagaatgttcacttactgattactacaatcaaaaaaagatacgacactaatttaccacattcttcttacttattttatgagatactattcttccaaggtggagaaagtggagaaagtagagtgacgcagctaagggagtaaatcgaccctcagccaacaagtggcaaaagcctgaagaaagtgatcaagatcactgatgaccccgctgcccatctccaagggggcgggtatcacaaccccgacgccacaccacgtatcattccgcaaaactcccgcgcctcccacgcagaactggcaagagggaaggcgagacagcagtgaacagctggtacgcagcacccacagcaccgcggcagcagctagtgccgactcccgcctagctcttttgactctgttcgcgggaagaatggggaaacagtaaggttgcggcgcctcccgcgagacgaggtacctgaggctggccccgcagtcccccgccgcaccagcaccggagcttcacaccccacttccggggtcaagtcaccgccgggaatcctgtgatcgcagaaaggtagtctcaggttccgcccctatccaagtcccgcctccactgcctctcgccctgtatctgtcaacttccgggacgccgcgcgtcactaagcagccaatctccacttccggactcatccagccccttctccacccctttcagagacagcgcgattgcgatttaggtttccgcgcatttaattggcgaagctggagcgctagtcttcgctgattggtgccgagaaatctgccccatagacacccgcggggcgcacagtttcagtcgtccgtgggtttcccgccagccgcagtcttggaccataatcatggtggacatgatggacttgcccaggtcgcgcatcaacgccggcatgctagctcaattcatcgacaagcctgtctgcttcgtagggaggctggaaaagattcatcccaccggaaaaatgtttattctttcagatggagaaggaaaaaatggaaccatcgagttgatggaaccccttgatgaagaaatctctggaattgtggaagtggttggaagagtaaccgccaaggccaccatcttgtgtacatcttatgtccagtttaaagaagatagccatccttttgatcttggactttacaatgaagctgtgaaaattatccatgacttccctcagttttatcctttagggattgtgcaacatgattgatcttgatggattttcatacgattgtaaatgagctatattaaagtctattaaaggaagcccttcttgtttgagggagagatttctgtgctttctcatatttaatttgctgtttttaagatattccaacctagagtttttgatggaactgatatattgacagttctcaccgaagtccttttataaagaattgctactccaatatatggtcagattagatgcaagaataaagcagttgtccgagtctaagtttctattttattaataaaaactaaaatggtacgtactatcggtcatttcattttcattcttttaatcatgtattcaagcacaaacttgaaatttcatagccataaggtcaagatttagacctaccaaataaaaccttgggccagctgtgttaaggatttgctcaccttttcccaaactataccttgataattatttccttgataccctacttacaaaatgaagtagatgacatt

SEQ ID NO: 3631 - DNA, 847 bp, Homo sapiens
gggaaggcgagacagcagtgaacagctggtacgcagcacccacagcaccgcggcagcagctagtgccgactcccgcctagctcttttgactctgttcgcgggaagaatggggaaacagtaaggttgcggcgcctcccgcgagacgaggtacctgaggctggccccgcagtcccccgccgcaccagcaccggagcttcacaccccacttccggggtcaagtcaccgccgggaatcctgtgatcgcagaaagagacagcgcgattgcgatttaggtttccgcgcatttaattggcgaagctggagcgctagtcttcgctgattggtgccgagaaatctgccccatagacacccgcggggcgcacagtttcagtcgtccgtgggtttcccgccagccgcagtcttggaccataatcatggtggacatgatggacttgcccaggtcgcgcatcaacgccggcatgctagctcaattcatcgacaagcctgtctgcttcgtagggaggctggaaaagattcatcccaccggaaaaatgtttattctttcagatggagaaggaaaaaatggaaccatcgagttgatggaaccccttgatgaagaaatctctggaattgtggaagtggttggaagagtaaccgccaaggccaccatcttgtgtacatcttatgtccagtttaaagaagatagccatccttttgatcttggactttacaatgaagctgtgaaaattatccatgacttccctcagttttatcctttagggattgtgcaacatgattgatcttgatggattttcatacgattgtaaatgagctatattaaagtctattaaaggaagcccttcttgtt

SEQ ID NO: 3632 - DNA, 4840 bp, Homo sapiens
tccggtttttctcaggggacgttgaaattatttttgtaacgggagtcgggagaggacggggcgtgccccgacgtgcgcgcgcgtcgtcctccccggcgctcctccacagctcgctggctcccgccgcggaaaggcgtcatgccgcccaaaaccccccgaaaaacggccgccaccgccgccgctgccgccgcggaacccccggcaccgccgccgccgccccctcctgaggaggacccagagcaggacagcggcccggaggacctgcctctcgtcaggcttgagtttgaagaaacagaagaacctgattttactgcattatgtcagaaattaaagataccagatcatgtcagagagagagcttggttaacttgggagaaagtttcatctgtggatggagtattgggaggttatattcaaaagaaaaaggaactgtggggaatctgtatctttattgcagcagttgacctagatgagatgtcgttcacttttactgagctacagaaaaacatagaaatcagtgtccataaattctttaacttactaaaagaaattgataccagtaccaaagttgataatgctatgtcaagactgttgaagaagtatgatgtattgtttgcactcttcagcaaattggaaaggacatgtgaacttatatatttgacacaacccagcagttcgatatctactgaaataaattctgcattggtgctaaaagtttcttggatcacatttttattagctaaaggggaagtattacaaatggaagatgatctggtgatttcatttcagttaatgctatgtgtccttgactattttattaaactctcacctcccatgttgctcaaagaaccatataaaacagctgttatacccattaatggttcacctcgaacacccaggcgaggtcagaacaggagtgcacggatagcaaaacaactagaaaatgatacaagaattattgaagttctctgtaaagaacatgaatgtaatatagatgaggtgaaaaatgtttatttcaaaaattttataccttttatgaattctcttggacttgtaacatctaatggacttccagaggttgaaaatctttctaaacgatacgaagaaatttatcttaaaaataaagatctagatgcaagattatttttggatcatgataaaactcttcagactgattctatagacagttttgaaacacagagaacaccacgaaaaagtaaccttgatgaagaggtgaatgtaattcctccacacactccagttaggactgttatgaacactatccaacaattaatgatgattttaaattcagcaagtgatcaaccttcagaaaatctgatttcctattttaacaactgcacagtgaatccaaaagaaagtatactgaaaagagtgaaggatataggatacatctttaaagagaaatttgctaaagctgtgggacagggttgtgtcgaaattggatcacagcgatacaaacttggagttcgcttgtattaccgagtaatggaatccatgcttaaatcagaagaagaacgattatccattcaaaattttagcaaacttctgaatgacaacatttttcatatgtctttattggcgtgcgctcttgaggttgtaatggccacatatagcagaagtacatctcagaatcttgattctggaacagatttgtctttcccatggattctgaatgtgcttaatttaaaagcctttgatttttacaaagtgatcgaaagttttatcaaagcagaaggcaacttgacaagagaaatgataaaacatttagaacgatgtgaacatcgaatcatggaatcccttgcatggctctcagattcacctttatttgatcttattaaacaatcaaaggaccgagaaggaccaactgatcaccttgaatctgcttgtcctcttaatcttcctctccagaataatcacactgcagcagatatgtatctttctcctgtaagatctccaaagaaaaaaggttcaactacgcgtgtaaattctactgcaaatgcagagacacaagcaacctcagccttccagacccagaagccattgaaatctacctctctttcactgttttataaaaaagtgtatcggctagcctatctccggctaaatacactttgtgaacgccttctgtctgagcacccagaattagaacatatcatctggacccttttccagcacaccctgcagaatgagtatgaactcatgagagacaggcatttggaccaaattatgatgtgttccatgtatggcatatgcaaagtgaagaatatagaccttaaattcaaaatcattgtaacagcatacaaggatcttcctcatgctgttcaggagacattcaaacgtgttttgatcaaagaagaggagtatgattctattatagtattctataactcggtcttcatgcagagactgaaaacaaatattttgcagtatgcttccaccaggccccctaccttgtcaccaatacctcacattcctcgaagcccttacaagtttcctagttcacccttacggattcctggagggaacatctatatttcacccctgaagagtccatataaaatttcagaaggtctgccaacaccaacaaaaatgactccaagatcaagaatcttagtatcaattggtgaatcattcgggacttctgagaagttccagaaaataaatcagatggtatgtaacagcgaccgtgtgctcaaaagaagtgctgaaggaagcaaccctcctaaaccactgaaaaaactacgctttgatattgaaggatcagatgaagcagatggaagtaaacatctcccaggagagtccaaatttcagcagaaactggcagaaatgacttctactcgaacacgaatgcaaaagcagaaaatgaatgatagcatggatacctcaaacaaggaagagaaatgaggatctcaggaccttggtggacactgtgtacacctctggattcattgtctctcacagatgtgactgtataactttcccaggttctgtttatggccacatttaatatcttcagctctttttgtggatataaaatgtgcagatgcaattgtttgggtgattcctaagccacttgaaatgttagtcattgttatttatacaagattgaaaatcttgtgtaaatcctgccatttaaaaagttgtagcagattgtttcctcttccaaagtaaaattgctgtgctttatggatagtaagaatggccctagagtgggagtcctgataacccaggcctgtctgactactttgccttcttttgtagcatataggtgatgtttgctcttgtttttattaatttatatgtatatttttttaatttaacatgaacacccttagaaaatgtgtcctatctatcttccaaatgcaatttgattgactgcccattcaccaaaattatcctgaactcttctgcaaaaatggatattattagaaattagaaaaaaattactaattttacacattagattttattttactattggaatctgatatactgtgtgcttgttttataaaattttgcttttaattaaataaaagctggaagcaaagtataaccatatgatactatcatactactgaaacagatttcatacctcagaatgtaaaagaacttactgattattttcttcatccaacttatgtttttaaatgaggattattgatagtactcttggtttttataccattcagatcactgaatttataaagtacccatctagtacttgaaaaagtaaagtgttctgccagatcttaggtatagaggaccctaacacagtatatcccaagtgcactttctaatgtttctgggtcctgaagaattaagatacaaattaattttactccataaacagactgttaattataggagccttaatttttttttcatagagatttgtctaattgcatctcaaaattattctgccctccttaatttgggaaggtttgtgttttctctggaatggtacatgtcttccatgtatcttttgaactggcaattgtctatttatcttttatttttttaagtcagtatggtctaacactggcatgttcaaagccacattatttctagtccaaaattacaagtaatcaagggtcattatgggttaggcattaatgtttctatctgattttgtgcaaaagcttcaaattaaaacagctgcattagaaaaagaggcgcttctcccctcccctacacctaaaggtgtatttaaactatcttgtgtgattaacttatttagagatgctgtaacttaaaataggggatatttaaggtagcttcagctagcttttaggaaaatcactttgtctaactcagaattatttttaaaaagaaatctggtcttgttagaaaacaaaattttattttgtgctcatttaagtttcaaacttactattttgacagttattttgataacaatgacactagaaaacttgactccatttcatcattgtttctgcatgaatatcatacaaatcagttagtttttaggtcaagggcttactatttctgggtcttttgctactaagttcacattagaattagtgccagaattttaggaacttcagagatcgtgtattgagatttcttaaataatgcttcagatattattgctttattgcttttttgtattggttaaaactgtacatttaaaattgctatgttactattttctacaattaatagtttgtctattttaaaataaattagttgttaagagtcttaatggtctgatgttgtgttctttgtattaagtacactaatgttctcttttctgtctaggagaagatagatagaagataactctcctagtatctcatcc

SEQ ID NO: 3633 - DNA, 480 bp, Homo sapiens
tccggtttttctcaggggacgttgaaattatttttgtaacgggagtcgggagaggacggggcgtgccccgacgtgcgcgcgcgtcgtcctccccggcgctcctccacagctcgctggctcccgccgcggaaaggcgtcatgccgcccaaaaccccccgaaaaacggccgccaccgccgccgctgccgccgcggaacccccggcaccgccgccgccgccccctcctgaggaggacccagagcaggacagcggcccggaggacctgcctctcgtcaggggaagtattacaaatggaagatgatctggtgatttcatttcagttaatgctatgtgtccttgactattttattaaactctcacctcccatgttgctcaaagaaccatataaaacagctgttatacccattaatggttcacctcgaacacccaggcgaggtcagaacaggagtgcacggatagcaaaacaactagaaaatgatac

SEQ ID NO: 3634 - DNA, 3150 bp, Homo sapiens
gctcagttgccgggcgggggagggcgcgtccggtttttctcaggggacgttgaaattatttttgtaacgggagtcgggagaggacggggcgtgccccgacgtgcgcgcgcgtcgtcctccccggcgctcctccacagctcgctggctcccgccgcggaaaggcgtcatgccgcccaaaaccccccctcctgaggaggacccagagcaggacagcggcccggaggacctgcctctcgtcaggcttgagtttgaagaaacagaagaacctgattttactgcattatgtcagaaattaaagataccagatcatgtcagagagagagcttggttaacttgggagaaagtttcatctgtggatggagtattgggaggttatattcaaaagaaaaaggaactgtggggaatctgtatctttattgcagcagttgacctagatgagatgtcgttcacttttactgagctacagaaaaacatagaaatcagtgtccataaattctttaacttactaaaagaaattgataccagtaccaaagttgataatgctatgtcaagactgttgaagaagtatgatgtattgtttgcactcttcagcaaattggaaaggacatgtgaacttatatatttgacacaacccagcagttcgatatctactgaaataaattctgcattggtgctaaaagtttcttggatcacatttttattagctaaaggggaagtattacaaatggaagatgatctggtgatttcatttcagttaatgctatgtgtccttgactattttattaaactctcacctcccatgttgctcaaagaaccatataaaacagctgttatacccattaatggttcacctcgaacacccaggcgaggtcagaacaggagtgcacggatagcaaaacaactagaaaatgatacaagaattattgaagttctctgtaaagaacatgaatgtaatatagatgaggtgaaaaatgtttatttcaaaaattttataccttttatgaattctcttggacttgtaacatctaatggacttccagaggttgaaaatctttctaaacgatacgaagaaatttatcttaaaaataaagatctagatgcaagattatttttggatcatgataaaactcttcagactgattctatagacagttttgaaacacagagaacaccacgaaaaagtaaccttgatgaagaggtgaatgtaattcctccacacactccagttaggactgttatgaacactatccaacaattaatgatgattttaaattcagcaagtgatcaaccttcagaaaatctgatttcctattttaacaactgcacagtgaatccaaaagaaagtatactgaaaagagtgaaggatataggatacatctttaaagagaaatttgctaaagctgtgggacagggttgtgtcgaaattggatcacagcgatacaaacttggagttcgcttgtattaccgagtaatggaatccatgcttaaatcagaagaagaacgattatccattcaaaattttagcaaacttctgaatgacaacatttttcatatgtctttattggcgtgcgctcttgaggttgtaatggccacatatagcagaagtacatctcagaatcttgattctggaacagatttgtctttcccatggattctgaatgtgcttaatttaaaagcctttgatttttacaaagtgatcgaaagttttatcaaagcagaaggcaacttgacaagagaaatgataaaacatttagaacgatgtgaacatcgaatcatggaatcccttgcatggctctcagattcacctttatttgatcttattaaacaatcaaaggaccgagaaggaccaactgatcaccttgaatctgcttgtcctcttaatcttcctctccagaataatcacactgcagcagatatgtatctttctcctgtaagatctccaaagaaaaaaggttcaactacgcgtgtaaattctactgcaaatgcagagacacaagcaacctcagccttccagacccagaagccattgaaatctacctctctttcactgttttataaaaaagtgtatcggctagcctatctccggctaaatacactttgtgaacgccttctgtctgagcacccagaattagaacatatcatctggacccttttccagcacaccctgcagaatgagtatgaactcatgagagacaggcatttggaccaaattatgatgtgttccatgtatggcatatgcaaagtgaagaatatagaccttaaattcaaaatcattgtaacagcatacaaggatcttcctcatgctgttcaggagacattcaaacgtgttttgatcaaagaagaggagtatgattctattatagtattctataactcggtcttcatgcagagactgaaaacaaatattttgcagtatgcttccaccaggccccctaccttgtcaccaatacctcacattcctcgaagcccttacaagtttcctagttcacccttacggattcctggagggaacatctatatttcacccctgaagagtccatataaaatttcagaaggtctgccaacaccaacaaaaatgactccaagatcaagaatcttagtatcaattggtgaatcattcgggacttctgagaagttccagaaaataaatcagatggtatgtaacagcgaccgtgtgctcaaaagaagtgctgaaggaagcaaccctcctaaaccactgaaaaaactacgctttgatattgaaggatcagatgaagcagatggaagtaaacatctcccaggagagtccaaatttcagcagaaactggcagaaatgacttctactcgaacacgaatgcaaaagcagaaaatgaatgatagcatggatacctcaaacaaggaagagaaatgaggatctcaggaccttggtggacactgtgtacacctctggattcattgtctctcacagatgtgactgtataactttcccaggttctgtttatggccacatttaatatcttcagctctttttgtggatataaaatgtgcagatgcaattgtttgggtgattcctaagccacttgaaatgttagtcattgttatttatacaagattgaaaatcttgtgtaaatcctgccatttaaaaagttgtagcagattgtttcctcttcc

SEQ ID NO: 3635 - DNA, 3276 bp, Homo sapiens
cgcgtgacgtcgcgcgggctcccgggcggggcgggtccggccgcctccgagcccggccggcagcccccggccttaaagcgcgggctgtccggaggggtcggctttcccaccgaggatttggcactctggtgagggaaaagggcgaaagagaaaagcgagcagccgtcctttcacagcctcagaaagtgctcgcttcccttcgggggctttcgcgaatcccgaggcaatctcggaggcggtatttgacctgtccaaagacgacttgatacctctataatgtaacagaaaaggtcagaaaatattaagcaagtagaagtgtggagcatattaagcaagatgaacatctcgggaagcagctgtggaagccctaactctgcagatacatctagtgactttaaggacctttggacaaaactaaaagaatgtcatgatagagaagtacaaggtttacaagtaaaagtaaccaagctaaaacaggaacgaatcttagatgcacaaagactagaagaattcttcaccaaaaatcaacagctgagggaacagcagaaagtccttcatgaaaccattaaagttttagaagatcggttaagagcaggcttatgtgatcgctgtgcagtaactgaagaacatatgcggaaaaaacagcaagagtttgaaaatatccggcagcagaatcttaaacttattacagaacttatgaatgaaaggaatactctacaggaagaaaataaaaagctttctgaacaactccagcagaaaattgagaatgatcaacagcatcaagcagctgagcttgaatgtgaggaagacgttattccagattcaccgataacagccttctcattttctggcgttaaccggctacgaagaaaggagaacccccatgtccgatacatagaacaaacacatactaaattggagcactctgtgtgtgcaaatgaaatgagaaaagtttccaagtcttcaactcatccacaacataatcctaatgaaaatgaaattctagtagctgacacttatgaccaaagtcaatctccaatggccaaagcacatggaacaagcagctatacccctgataagtcatcttttaatttagctacagttgttgctgaaacacttggacttggtgttcaagaagaatctgaaactcaaggtcccatgagcccccttggtgatgagctctaccactgtctggaaggaaatcacaagaaacagccttttgaggaatctacaagaaatactgaagatagtttaagattttcagattctacttcaaagactcctcctcaagaagaattacctactcgagtgtcatctcctgtatttggagctacctctagtatcaaaagtggtttagatttgaatacaagtttgtccccttctcttttacagcctgggaaaaaaaaacatctgaaaacactcccttttagcaacacttgtatatctagattagaaaaaactagatcaaaatctgaagatagtgcccttttcacacatcacagtcttgggtctgaagtgaacaagatcattatccagtcatctaataaacagatacttataaataaaaatataagtgaatccctaggtgaacagaataggactgagtacggtaaagattctaacactgataaacatttggagcccctgaaatcattgggaggccgaacatccaaaaggaagaaaactgaggaagaaagtgaacatgaagtaagctgcccccaagcttcttttgataaagaaaatgctttcccttttccaatggataatcagttttccatgaatggagactgtgtgatggataaacctctggatctgtctgatcgattttcagctattcagcgtcaagagaaaagccaaggaagtgagacttctaaaaacaaatttaggcaagtgactctttatgaggctttgaagaccattccaaagggcttttcctcaagccgtaaggcctcagatggcaactgcacgttgcccaaagattccccaggggagccctgttcacaggaatgcatcatccttcagcccttgaataaatgctctccagacaataaaccatcattacaaataaaagaagaaaatgctgtctttaaaattcctctacgtccacgtgaaagtttggagactgagaatgttttagatgacataaagagtgctggttctcatgagccaataaaaatacaaaccaggtcagaccatggaggatgtgaacttgcatcagttcttcagttaaatccatgtagaactggtaaaataaagtctctacaaaacaaccaagatgtatcctttgaaaatatccagtggagtatagatccgggagcagacctttctcagtataaaatggatgttactgtaatagatacaaaggatggcagtcagtcaaaattaggaggagagacagtggacatggactgtacattggttagtgaaaccgttctcttaaaaatgaagaagcaagagcagaagggagaaaaaagttcaaatgaagaaagaaaaatgaatgatagcttggaagatatgtttgatcggacaacacatgaagagtatgaatcctgtttggcagacagtttctcccaagcagcagatgaagaggaggaattgtctactgccacaaagaaactacacactcatggtgataaacaagacaaagtcaagcagaaagcgtttgtggagccgtattttaaaggtgatgaaagagagactagcttgcaaaattttcctcatattgaggtggttcggaaaaaagaggagagaagaaaactgcttgggcacacgtgtaaggaatgtgaaatttattatgcagatatgccagcagaagaaagagaaaagaaattggcttcctgctcaagacaccgattccgctacattccacccaacacaccagagaatttttgggaagttggttttccttccactcagacttgtatggaaagaggttatattaaggaagatcttgatccttgtcctcgtccaaaaagacgtcagccttacaacgcaatattttctccaaaaggcaaggagcagaagacatagacgttgaaacagaaacagaaggatgaaggacagttttttccttcttagttatttatagttaaagttggtactaaacattgatttttttgatcttctgtaaatggatttataaatcagttttctattgaaaatgtttgtgatattttgcttttgcacctttaaaacaataaggcgctttcattttgcactctaacttaagagtttttactttatgtagtgatacctaatacaattttgaaaatacaa

SEQ ID NO: 3636 - DNA, 2961 bp, Homo sapiens
gattgagaacatgcgggctacagagaggtatttgacctgtccaaagacgacttgatacctctataatgtaacagaaaaggtcagaaaatattaagcaagtagaagtgtggagcatattaagcaagatgaacatctcgggaagcagctgtggaagccctaactctgcagatacatctagtgactttaaggacctttggacaaaactaaaagaatgtcatgatagagaagtacaaggtttacaagtaaaagtaaccaagctaaaacaggaacgaatcttagatgcacaaagactagaagaattcttcaccaaaaatcaacagctgagggaacagcagaaagtccttcatgaaaccattaaagttttagaagatcggttaagagcaggcttatgtgatcgctgtgcagtaactgaagaacatatgcggaaaaaacagcaagagtttgaaaatatccggcagcagaatcttaaacttattacagaacttatgaatgaaaggaatactctacaggaagaaaataaaaagctttctgaacaactccagcagaaaattgagaatgatcaacagcatcaagcagctgagcttgaatgtgaggaagacgttattccagattcaccgataacagccttctcattttctggcgttaaccggctacgaagaaaggagaacccccatgtccgatacatagaacaaacacatactaaattggagcactctgtgtgtgcaaatgaaatgagaaaagtttccaagtcttcaactcatccacaacataatcctaatgaaaatgaaattctagtagctgacacttatgaccaaagtcaatctccaatggccaaagcacatggaacaagcagctatacccctgataagtcatcttttaatttagctacagttgttgctgaaacacttggacttggtgttcaagaagaatctgaaactcaaggtcccatgagcccccttggtgatgagctctaccactgtctggaaggaaatcacaagaaacagccttttgaggaatctacaagaaatactgaagatagtttaagattttcagattctacttcaaagactcctcctcaagaagaattacctactcgagtgtcatctcctgtatttggagctacctctagtatcaaaagtggtttagatttgaatacaagtttgtccccttctcttttacagcctgggaaaaaaaaacatctgaaaacactcccttttagcaacacttgtatatctagattagaaaaaactagatcaaaatctgaagatagtgcccttttcacacatcacagtcttgggtctgaagtgaacaagatcattatccagtcatctaataaacagatacttataaataaaaatataagtgaatccctaggtgaacagaataggactgagtacggtaaagattctaacactgataaacatttggagcccctgaaatcattgggaggccgaacatccaaaaggaagaaaactgaggaagaaagtgaacatgaagtaagctgcccccaagcttcttttgataaagaaaatgctttcccttttccaatggataatcagttttccatgaatggagactgtgtgatggataaacctctggatctgtctgatcgattttcagctattcagcgtcaagagaaaagccaaggaagtgagacttctaaaaacaaatttaggcaagtgactctttatgaggctttgaagaccattccaaagggcttttcctcaagccgtaaggcctcagatggcaactgcacgttgcccaaagattccccaggggagccctgttcacaggaatgcatcatccttcagcccttgaataaatgctctccagacaataaaccatcattacaaataaaagaagaaaatgctgtctttaaaattcctctacgtccacgtgaaagtttggagactgagaatgttttagatgacataaagagtgctggttctcatgagccaataaaaatacaaaccaggtcagaccatggaggatgtgaacttgcatcagttcttcagttaaatccatgtagaactggtaaaataaagtctctacaaaacaaccaagatgtatcctttgaaaatatccagtggagtatagatccgggagcagacctttctcagtataaaatggatgttactgtaatagatacaaaggatggcagtcagtcaaaattaggaggagagacagtggacatggactgtacattggttagtgaaaccgttctcttaaaaatgaagaagcaagagcagaagggagaaaaaagttcaatgctcttttacatagatgaagaaagaaaaatgaatgatagcttggaagatatgtttgatcggacaacacatgaagagtatgaatcctgtttggcagacagtttctcccaagcagcagatgaagaggaggaattgtctactgccacaaagaaactacacactcatggtgataaacaagacaaagtcaagcagaaagcgtttgtggagccgtattttaaaggtgatgaaagagagactagcttgcaaaattttcctcatattgaggtggttcggaaaaaagaggagagaagaaaactgcttgggcacacgtgtaaggaatgtgaaatttattatgcagatatgccagcagaagaaagagaaaagaaattggcttcctgctcaagacaccgattccgctacattccacccaacacaccagagaatttttgggaagttggttttccttccactcagacttgtatggaaagaggttatattaaggaagatcttgatccttgtcctcgtccaaaaagacgtcagccttacaacgcaatattttctccaaaaggcaaggagcagaagacatagacgttgaaacagaaacagaaggatgaaggacagttttttccttcttagttatttatagttaaagttggtactaaacattgatttttttgatcttctgtaaatggatttataaatcagttttctattg

SEQ ID NO: 3637 - DNA, 3199 bp, Homo sapiens
ggggagaaatggatggagaagggacctggctggaaagcctttgccccgctgctctgctccgcccataagaggacccctgaaatgtcccgtgcagtttgttcaagtcccctgtgtgatgaaatgtgcctctcgccttacccgtgtgagaatacctgtggtgtggcagcgagtattttggtgagcacctgcagtgtagtggtttatactaaggaatacacacaaattacaggcctttgagcccagaatgcaacttgggaggtatttgacctgtccaaagacgacttgatacctctataatgtaacagaaaaggtcagaaaatattaagcaagtagaagtgtggagcatattaagcaagatgaacatctcgggaagcagctgtggaagccctaactctgcagatacatctagtgactttaaggacctttggacaaaactaaaagaatgtcatgatagagaagtacaaggtttacaagtaaaagtaaccaagctaaaacaggaacgaatcttagatgcacaaagactagaagaattcttcaccaaaaatcaacagctgagggaacagcagaaagtccttcatgaaaccattaaagttttagaagatcggttaagagcaggcttatgtgatcgctgtgcagtaactgaagaacatatgcggaaaaaacagcaagagtttgaaaatatccggcagcagaatcttaaacttattacagaacttatgaatgaaaggaatactctacaggaagaaaataaaaagctttctgaacaactccagcagaaaattgagaatgatcaacagcatcaagcagctgagcttgaatgtgaggaagacgttattccagattcaccgataacagccttctcattttctggcgttaaccggctacgaagaaaggagaacccccatgtccgatacatagaacaaacacatactaaattggagcactctgtgtgtgcaaatgaaatgagaaaagtttccaagtcttcaactcatccacaacataatcctaatgaaaatgaaattctagtagctgacacttatgaccaaagtcaatctccaatggccaaagcacatggaacaagcagctatacccctgataagtcatcttttaatttagctacagttgttgctgaaacacttggacttggtgttcaagaagaatctgaaactcaaggtcccatgagcccccttggtgatgagctctaccactgtctggaaggaaatcacaagaaacagccttttgaggaatctacaagaaatactgaagatagtttaagattttcagattctacttcaaagactcctcctcaagaagaattacctactcgagtgtcatctcctgtatttggagctacctctagtatcaaaagtggtttagatttgaatacaagtttgtccccttctcttttacagcctgggaaaaaaaaacatctgaaaacactcccttttagcaacacttgtatatctagattagaaaaaactagatcaaaatctgaagatagtgcccttttcacacatcacagtcttgggtctgaagtgaacaagatcattatccagtcatctaataaacagatacttataaataaaaatataagtgaatccctaggtgaacagaataggactgagtacggtaaagattctaacactgataaacatttggagcccctgaaatcattgggaggccgaacatccaaaaggaagaaaactgaggaagaaagtgaacatgaagtaagctgcccccaagcttcttttgataaagaaaatgctttcccttttccaatggataatcagttttccatgaatggagactgtgtgatggataaacctctggatctgtctgatcgattttcagctattcagcgtcaagagaaaagccaaggaagtgagacttctaaaaacaaatttaggcaagtgactctttatgaggctttgaagaccattccaaagggcttttcctcaagccgtaaggcctcagatggcaactgcacgttgcccaaagattccccaggggagccctgttcacaggaatgcatcatccttcagcccttgaataaatgctctccagacaataaaccatcattacaaataaaagaagaaaatgctgtctttaaaattcctctacgtccacgtgaaagtttggagactgagaatgttttagatgacataaagagtgctggttctcatgagccaataaaaatacaaaccaggtcagaccatggaggatgtgaacttgcatcagttcttcagttaaatccatgtagaactggtaaaataaagtctctacaaaacaaccaagatgtatcctttgaaaatatccagtggagtatagatccgggagcagacctttctcagtataaaatggatgttactgtaatagatacaaaggatggcagtcagtcaaaattaggaggagagacagtggacatggactgtacattggttagtgaaaccgttctcttaaaaatgaagaagcaagagcagaagggagaaaaaagttcaaatgaagaaagaaaaatgaatgatagcttggaagatatgtttgatcggacaacacatgaagagtatgaatcctgtttggcagacagtttctcccaagcagcagatgaagaggaggaattgtctactgccacaaagaaactacacactcatggtgataaacaagacaaagtcaagcagaaagcgtttgtggagccgtattttaaaggtgatgaaagtattatgcagatatgccagcagaagaaagagaaaagaaattggcttcctgctcaagacaccgattccgctacattccacccaacacaccagagaatttttgggaagttggttttccttccactcagacttgtatggaaagaggttatattaaggaagatcttgatccttgtcctcgtccaaaaagacgtcagccttacaacgcaatattttctccaaaaggcaaggagcagaagacatagacgttgaaacagaaacagaaggatgaaggacagttttttccttcttagttatttatagttaaagttggtactaaacattgatttttttgatcttctgtaaatggatttataaatcagttttctattgaaaatgtttgtgatattttgcttttgcacctttaaaacaataaggcgctttcattttgcactctaacttaagagtttttactttatgtagtgatacctaatacaattttgaaaatacaa

SEQ ID NO: 3638 - DNA, 3237 bp, Homo sapiens
cgcacgcggaaccggcgcgggcacctggggagaaatggatggagaagggacctggctggaaagcctttgccccgctgctctgctccgcccataagaggacccctgaaatgtcccgtgcagtttgttcaagtcccctgtgtgatgaaatgtgcctctcgccttacccgtgtgagaatacctgtggtgtggcagcgagtattttggtatttgacctgtccaaagacgacttgatacctctataatgtaacagaaaaggtcagaaaatattaagcaagtagaagtgtggagcatattaagcaagatgaacatctcgggaagcagctgtggaagccctaactctgcagatacatctagtgactttaaggacctttggacaaaactaaaagaatgtcatgatagagaagtacaaggtttacaagtaaaagtaaccaagctaaaacaggaacgaatcttagatgcacaaagactagaagaattcttcaccaaaaatcaacagctgagggaacagcagaaagtccttcatgaaaccattaaagttttagaagatcggttaagagcaggcttatgtgatcgctgtgcagtaactgaagaacatatgcggaaaaaacagcaagagtttgaaaatatccggcagcagaatcttaaacttattacagaacttatgaatgaaaggaatactctacaggaagaaaataaaaagctttctgaacaactccagcagaaaattgagaatgatcaacagcatcaagcagctgagcttgaatgtgaggaagacgttattccagattcaccgataacagccttctcattttctggcgttaaccggctacgaagaaaggagaacccccatgtccgatacatagaacaaacacatactaaattggagcactctgtgtgtgcaaatgaaatgagaaaagtttccaagtcttcaactcatccacaacataatcctaatgaaaatgaaattctagtagctgacacttatgaccaaagtcaatctccaatggccaaagcacatggaacaagcagctatacccctgataagtcatcttttaatttagctacagttgttgctgaaacacttggacttggtgttcaagaagaatctgaaactcaaggtcccatgagcccccttggtgatgagctctaccactgtctggaaggaaatcacaagaaacagccttttgaggaatctacaagaaatactgaagatagtttaagattttcagattctacttcaaagactcctcctcaagaagaattacctactcgagtgtcatctcctgtatttggagctacctctagtatcaaaagtggtttagatttgaatacaagtttgtccccttctcttttacagcctgggaaaaaaaaacatctgaaaacactcccttttagcaacacttgtatatctagattagaaaaaactagatcaaaatctgaagatagtgcccttttcacacatcacagtcttgggtctgaagtgaacaagatcattatccagtcatctaataaacagatacttataaataaaaatataagtgaatccctaggtgaacagaataggactgagtacggtaaagattctaacactgataaacatttggagcccctgaaatcattgggaggccgaacatccaaaaggaagaaaactgaggaagaaagtgaacatgaagtaagctgcccccaagcttcttttgataaagaaaatgctttcccttttccaatggataatcagttttccatgaatggagactgtgtgatggataaacctctggatctgtctgatcgattttcagctattcagcgtcaagagaaaagccaaggaagtgagacttctaaaaacaaatttaggcaagtgactctttatgaggctttgaagaccattccaaagggcttttcctcaagccgtaaggcctcagatggcaactgcacgttgcccaaagattccccaggggagccctgttcacaggaatgcatcatccttcagcccttgaataaatgctctccagacaataaaccatcattacaaataaaagaagaaaatgctgtctttaaaattcctctacgtccacgtgaaagtttggagactgagaatgttttagatgacataaagagtgctggttctcatgagccaataaaaatacaaaccaggtcagaccatggaggatgtgaacttgcatcagttcttcagttaaatccatgtagaactggtaaaataaagtctctacaaaacaaccaagatgtatcctttgaaaatatccagtggagtatagatccgggagcagacctttctcagtataaaatggatgttactgtaatagatacaaaggatggcagtcagtcaaaattaggaggagagacagtggacatggactgtacattggttagtgaaaccgttctcttaaaaatgaagaagcaagagcagaagggagaaaaaagttcaaatgaagaaagaaaaatgaatgatagcttggaagatatgtttgatcggacaacacatgaagagtatgaatcctgtttggcagacagtttctcccaagcagcagatgaagaggaggaattgtctactgccacaaagaaactacacactcatggtgataaacaagacaaagtcaagcagaaagcgtttgtggagccgtattttaaaggtgatgaaagagagactagcttgcaaaattttcctcatattgaggtggttcggaaaaaagaggagagaagaaaactgcttgggcacacgtgtaaggaatgtgaaatttattatgcagatatgccagcagaagaaagagaaaagaaattggcttcctgctcaagacaccgattccgctacattccacccaacacaccagagaatttttgggaagttggttttccttccactcagacttgtatggaaagaggttatattaaggaagatcttgatccttgtcctcgtccaaaaagacgtcagccttacaacgcaatattttctccaaaaggcaaggagcagaagacatagacgttgaaacagaaacagaaggatgaaggacagttttttccttcttagttatttatagttaaagttggtactaaacattgatttttttgatcttctgtaaatggatttataaatcagttttctattgaaaatgtttgtgatattttgcttttgcacctttaaaacaataaggcgctttcattttgcactctaacttaagagtttttactttatgtagtgatacctaatacaattttgaaaat

SEQ ID NO: 3639 - DNA, 3221 bp, Homo sapiens
cgcacgcggaaccggcgcgggcacctggggagaaatggatggagaagggacctggctggaaagcctttgccccgctgctctgctccgcccataagaggacccctgaaatgtcccgtgcagtttgttcaagtcccctgtgtgatgaaatgtgcctctcgccttacccgtgtgagaatacctgtggtgtggcagcgagtattttggtgagcacctgcagtgtagtggtttatactaaggaatacacacaaattacaggcctttgagcccagaatgcaacttgggaggtatttgacctgtccaaagacgacttgatacctctataatgtaacagaaaaggtcagaaaatattaagcaagtagaagtgtggagcatattaagcaagatgaacatctcgggaagcagctgtggaagccctaactctgcagatacatctagtgactttaaggacctttggacaaaactaaaagaatgtcatgatagagaagtacaaggtttacaagtaaaagtaaccaagctaaaacaggaacgaatcttagatgcacaaagactagaagaattcttcaccaaaaatcaacagctgagggaacagcagaaagtccttcatgaaaccattaaagttttagaagatcggttaagagcaggcttatgtgatcgctgtgcagtaactgaagaacatatgcggaaaaaacagcaagagtttgaaaatatccggcagcagaatcttaaacttattacagaacttatgaatgaaaggaatactctacaggaagaaaataaaaagctttctgaacaactccagcagaaaattgagaatgatcaacagcatcaagcagctgagcttgaatgtgaggaagacgttattccagattcaccgataacagccttctcattttctggcgttaaccggctacgaagaaaggagaacccccatgtccgatacatagaacaaacacatactaaattggagcactctgtgtgtgcaaatgaaatgagaaaagtttccaagtcttcaactcatccacaacataatcctaatgaaaatgaaattctagtagctgacacttatgaccaaagtcaatctccaatggccaaagcacatggaacaagcagctatacccctgataagtcatcttttaatttagctacagttgttgctgaaacacttggacttggtgttcaagaagaatctgaaactcaaggtcccatgagcccccttggtgatgagctctaccactgtctggaaggaaatcacaagaaacagccttttgaggaatctacaagaaatactgaagatagtttaagattttcagattctacttcaaagactcctcctcaagaagaattacctactcgagtgtcatctcctgtatttggagctacctctagtatcaaaagtggtttagatttgaatacaagtttgtccccttctcttttacagcctgggaaaaaaaaacatctgaaaacactcccttttagcaacacttgtatatctagattagaaaaaactagatcaaaatctgaagatagtgcccttttcacacatcacagtcttgggtctgaagtgaacaagatcattatccagtcatctaataaacagatacttataaataaaaatataagtgaatccctaggtgaacagaataggactgagtacggtaaagattctaacactgataaacatttggagcccctgaaatcattgggaggccgaacatccaaaaggaagaaaactgaggaagaaagtgaacatgaagtaagctgcccccaagcttcttttgataaagaaaatgctttcccttttccaatggataatcagttttccatgaatggagactgtgtgatggataaacctctggatctgtctgatcgattttcagctattcagcgtcaagagaaaagccaaggaagtgagacttctaaaaacaaatttaggcaagtgactctttatgaggctttgaagaccattccaaagggcttttcctcaagccgtaaggcctcagatggcaactgcacgttgcccaaagattccccaggggagccctgttcacaggaatgcatcatccttcagcccttgaataaatgctctccagacaataaaccatcattacaaataaaagaagaaaatgctgtctttaaaattcctctacgtccacgtgaaagtttggagactgagaatgttttagatgacataaagagtgctggttctcatgagccaataaaaatacaaaccaggtcagaccatggaggatgtgaacttgcatcagttcttcagttaaatccatgtagaactggtaaaataaagtctctacaaaacaaccaagatgtatcctttgaaaatatccagtggagtatagatccgggagcagacctttctcagtataaaatggatgttactgtaatagatacaaaggatggcagtcagtcaaaattaggaggagagacagtggacatggactgtacattggttagtgaaaccgttctcttaaaaatgaagaagcaagagcagaagggagaaaaaagttcaaatgaagaaagaaaaatgaatgatagcttggaagatatgtttgatcggacaacacatgaagagtatgaatcctgtttggcagacagtttctcccaagcagcagatgaagaggaggaattgtctactgccacaaagaaactacacactcatggtgataaacaagacaaagtcaagcagaaagcgtttgtggagccgtattttaaaggtgatgaaagtattatgcagatatgccagcagaagaaagagaaaagaaattggcttcctgctcaagacaccgattccgctacattccacccaacacaccagagaatttttgggaagttggttttccttccactcagacttgtatggaaagaggttatattaaggaagatcttgatccttgtcctcgtccaaaaagacgtcagccttacaacgcaatattttctccaaaaggcaaggagcagaagacatagacgttgaaacagaaacagaaggatgaaggacagttttttccttcttagttatttatagttaaagttggtactaaacattgatttttttgatcttctgtaaatggatttataaatcagttttctattgaaaatgtttgtgatattttgcttttgcacctttaaaacaataaggcgctttcattttgcactctaacttaagagtttttactttatgtagtgatacctaatacaattttgaaaat

SEQ ID NO: 3640 - DNA, 3225 bp, Homo sapiens
cgcgcctgggagggagaaagaagtcgggggccgtggcgcgcagcccgcggggcctgaagggatgttcgaggacaagccccacgctgagggggcggcggtggtcgccgcagccggggaggcgctacaggccctgtgccaggagctgaacctggacgaggggagcgcggccgaagccctggacgactttactgccatccgaggcaactacagcctagagggagaagttacacactggttggcatgttcattatatgttgcatgccgcaaaagcattattcccacggttggaaagggtatcatggaaggcaactgtgtttcacttaccagaatactacgttcagctaaattaagtttaatacaattttttagtaaaatgaagaaatggatggacatgtcaaatctaccacaagaatttcgtgaacgtatagaaaggctagagagaaattttgaggtgtctactgtaatattcaaaaaatatgagccaatttttttagatatatttcaaaatccatatgaagaaccaccaaagttaccacgaagccggaagcagaggaggattccttgcagtgttaaggatctgtttaatttctgttggacactttttgtttatactaagggtaattttcggatgattggggatgacttagtaaactcttatcatttacttctatgctgcttggatctgatttttgccaatgcgattatgtgcccaaatagacaagacttgctaaatccatcatttaaaggtttaccatctgattttcatactgctgactttacggcttctgaagagccaccctgcatcattgctgtactgtgtgaactgcatgatggacttctcgtagaagcaaaaggaataaaggagcactactttaagccatatatttcaaaactctttgacaggaagatattaaaaggagaatgcctcctggacctttcaagttttactgataatagcaaagcagtgaataaggagtatgaagagtatgttctaactgttggtgattttgatgagaggatctttttgggagcagacgcagaagaggaaattggaacacctcgaaagttcactcgtgacaccccattagggaaactgacagcacaggctaatgtggagtataaccttcaacagcactttgaaaaaaaaaggtcatttgcaccttctaccccactgaccggacggagatatttacgagaaaaagaagcagtcattactcctgttgcatcagccacccaaagtgtgagccggttacagagtattgtggctggtctgaaaaatgcaccaagtgaccaacttataaatatttttgaatcttgtgtgcgtaatcctgtggaaaacattatgaaaatactaaaaggaataggagagactttctgtcaacactatactcaatcaacagatgaacagccaggatctcacatagactttgctgtaaacagactaaagctggcagaaattttgtattataaaatactagagactgtaatggttcaggaaacacgaagacttcatggaatggacatgtcagttcttttagagcaagatatatttcatcgttccttgatggcttgttgtttggaaattgtgctctttgcctatagctcacctcgtacttttccttggattattgaagttctcaacttgcaaccattttacttttataaggttattgaggtggtgatccgctcagaagaggggctctcaagggacatggtgaaacacctaaacagcattgaagaacagattttggagagtttagcatggagtcacgattctgcactgtgggaggctctccaggtttctgcaaacaaagttcctacctgtgaagaagttatattcccaaataactttgaaacaggaaatggaggaaatgtgcagggacatcttcccctgatgccaatgtctcctctaatgcacccaagagtcaaggaagttcgaactgacagtgggagtcttcgaagagatatgcaaccattgtctccaatttctgtccatgaacgctacagttctcctaccgcagggagtgctaagagaagactctttggagaggaccccccaaaggaaatgcttatggacaagatcataacagaaggaacaaaattgaaaatcgctccttcttcaagcattactgctgaaaatgtatcaattttacctggtcaaactcttctaacaatggccacagccccagtaacaggaacaacaggacataaagttacaattccattacatggtgtcgcaaatgatgctggagagatcacactgatacctctttccatgaatacaaatcaggagtccaaagtcaagagtcctgtatcacttactgctcattcattaattggtgcttctccaaaacagaccaatctgactaaagcacaagaggtacattcaactggaataaacaggccaaagagaactgggtccttagcactattttacagaaaggtctatcatttggcaagtgtacgcttacgtgatctatgtctaaaactggatgtttcaaatgagttacgaaggaagatatggacgtgttttgaattcactttagttcactgtcctgatctaatgaaagacaggcatttggatcagctcctcctttgtgccttttatatcatggcaaaggtaacaaaagaagaaagaacttttcaagaaattatgaaaagttataggaatcagccccaagctaatagtcacgtatatagaagtgttctgctgaaaagtattccaagagaagttgtggcatataataaaaatataaatgatgactttgaaatgatagattgtgacttagaagatgctacaaaaacacctgactgttccagtggaccagtgaaagaggaaagaggtgatcttataaaattttacaatacaatatatgtaggaagagtgaagtcatttgcactgaaatacgacttggcgaatcaggaccatatgatggatgctccaccactctctccttttccacatattaaacaacagccaggctcaccacgccgcatttcccagcagcactccatttatatttccccgcacaagaatgggtcaggccttacaccaagaagcgctctgctgtacaagttcaatggcagcccttctaaggtaaggtgaataggctaaaagttggatttcagattaacagtcagtaactgttaatcctgcctctttttttttttttcttttttggccaagttactactatactaataaaatatgaaatgttaactatg

SEQ ID NO: 3641 - DNA, 5684 bp, Homo sapiens
gggtagcgcgcctgggagggagaaagaagtcgggggccgtggcgcgcagcccgcggggcctgaagggatgttcgaggacaagccccacgctgagggggcggcggtggtcgccgcagccggggaggcgctacaggccctgtgccaggagctgaacctggacgaggggagcgcggccgaagccctggacgactttactgccatccgaggcaactacagcctagagggagaagttacacactggttggcatgttcattatatgttgcatgccgcaaaagcattattcccacggttggaaagggtatcatggaaggcaactgtgtttcacttaccagaatactacgttcagctaaattaagtttaatacaattttttagtaaaatgaagaaatggatggacatgtcaaatctaccacaagaatttcgtgaacgtatagaaaggctagagagaaattttgaggtgtctactgtaatattcaaaaaatatgagccaatttttttagatatatttcaaaatccatatgaagaaccaccaaagttaccacgaagccggaagcagaggaggattccttgcagtgttaaggatctgtttaatttctgttggacactttttgtttatactaagggtaattttcggatgattggggatgacttagtaaactcttatcatttacttctatgctgcttggatctgatttttgccaatgcgattatgtgcccaaatagacaagacttgctaaatccatcatttaaaggtttaccatctgattttcatactgctgactttacggcttctgaagagccaccctgcatcattgctgtactgtgtgaactgcatgatggacttctcgtagaagcaaaaggaataaaggagcactactttaagccatatatttcaaaactctttgacaggaagatattaaaaggagaatgcctcctggacctttcaagttttactgataatagcaaagcagtgaataaggagtatgaagagtatgttctaactgttggtgattttgatgagaggatctttttgggagcagacgcagaagaggaaattggaacacctcgaaagttcactcgtgacaccccattagggaaactgacagcacaggctaatgtggagtataaccttcaacagcactttgaaaaaaaaaggtcatttgcaccttctaccccactgaccggacggagatatttacgagaaaaagaagcagtcattactcctgttgcatcagccacccaaagtgtgagccggttacagagtattgtggctggtctgaaaaatgcaccaagtgaccaacttataaatatttttgaatcttgtgtgcgtaatcctgtggaaaacattatgaaaatactaaaaggaataggagagactttctgtcaacactatactcaatcaacagatgaacagccaggatctcacatagactttgctgtaaacagactaaagctggcagaaattttgtattataaaatactagagactgtaatggttcaggaaacacgaagacttcatggaatggacatgtcagttcttttagagcaagatatatttcatcgttccttgatggcttgttgtttggaaattgtgctctttgcctatagctcacctcgtacttttccttggattattgaagttctcaacttgcaaccattttacttttataaggttattgaggtggtgatccgctcagaagaggggctctcaagggacatggtgaaacacctaaacagcattgaagaacagattttggagagtttagcatggagtcacgattctgcactgtgggaggctctccaggtttctgcaaacaaagttcctacctgtgaagaagttatattcccaaataactttgaaacaggaaatggaggaaatgtgcagggacatcttcccctgatgccaatgtctcctctaatgcacccaagagtcaaggaagttcgaactgacagtgggagtcttcgaagagatatgcaaccattgtctccaatttctgtccatgaacgctacagttctcctaccgcagggagtgctaagagaagactctttggagaggaccccccaaaggaaatgcttatggacaagatcataacagaaggaacaaaattgaaaatcgctccttcttcaagcattactgctgaaaatgtatcaattttacctggtcaaactcttctaacaatggccacagccccagtaacaggaacaacaggacataaagttacaattccattacatggtgtcgcaaatgatgctggagagatcacactgatacctctttccatgaatacaaatcaggagtccaaagtcaagagtcctgtatcacttactgctcattcattaattggtgcttctccaaaacagaccaatctgactaaagcacaagaggtacattcaactggaataaacaggccaaagagaactgggtccttagcactattttacagaaaggtctatcatttggcaagtgtacgcttacgtgatctatgtctaaaactggatgtttcaaatgagttacgaaggaagatatggacgtgttttgaattcactttagttcactgtcctgatctaatgaaagacaggcatttggatcagctcctcctttgtgccttttatatcatggcaaaggtaacaaaagaagaaagaacttttcaagaaattatgaaaagttataggaatcagccccaagctaatagtcacgtatatagaagtgttctgctgaaaagtattccaagagaagttgtggcatataataaaaatataaatgatgactttgaaatgatagattgtgacttagaagatgctacaaaaacacctgactgttccagtggaccagtgaaagaggaaagaggtgatcttataaaattttacaatacaatatatgtaggaagagtgaagtcatttgcactgaaatacgacttggcgaatcaggaccatatgatggatgctccaccactctctccttttccacatattaaacaacagccaggctcaccacgccgcatttcccagcagcactccatttatatttccccgcacaagaatgggtcaggccttacaccaagaagcgctctgctgtacaagttcaatggcagcccttctaagagtttgaaagatatcaacaacatgataaggcaaggtgagcagagaaccaagaagcgagtaatagccatcgatagtgatgcagaatcccctgccaaacgcgtctgtcaagaaaatgatgacgttttactgaaacgactacaggatgttgtcagtgaaagagcaaatcattaatgttgttcttgtttctatgataaaagcactttcagattgttctgcagaaagttggagctctgtccttcaaaccttttagccctatagatgataaatatcactgggttataagaaaaaattgcacaaaaattatgtgctttttaaaatatttatccaaaatgtagttgacagagatgtattttgagttggattggaaaggaatattttaagtgccttttaaaaatactaatagtccggccaggcgctgtggctcacgcctgtaatcccaggactttgggaggccaaggcgggcagatcaccggaggtcaggagttcgagaccagcctgaccaacatggagaaaccccatctctactaaaaatacaaaattagccgggtgtggtggcgcatgcctgtaatcccagctacttgggaggctgaggcagaattgcttgaacccaggaagcggaggttgtggtgagccaaggttgcgccactgcactccagcctgggcaacaagagtaaaactccatctcaaaaaatatatatatatatataaatagggaattttttttaatgtttgctccttgagttttcaagatgaaataaggagaaaccccataactttttagctctcttttaaaaataaatgtctccttctgtgttctgtaatatgaggataaataatctacttttgatagcatgctttgagatatttgtattcttaatttaatattgaaggaaggggttggttcccatagtacctggccagagggttatataccatcctgtctctggcccactgtggtaattccacatccaggtaccaccgccattcagagttgtctcaccccttctcgtgccttttctctccttgagctttataaacagatttgtacctgagccccagtgctacactcatccttgctttccagccctaagccatctcagcctgatgtcacaacccaataaatggggcactttcttcttttgtaaactattatcattttggtttctgtgacattaacttaattatatatgatcgtattaactcatgtagttctcaaaataggcagctgcttctgaagccagtaaaataaaattcagttagttattaaaaactaaattcctattagtaaggtaacaccatgattatgtgtgatatactgtttttgagatcatagttatcagtcattctcaatatctaattgagtccctaagaatattttaaaccttttaaaaatcacataaatatcatctcatgcctcataattctaatatatttaatacatcagtaaaatagctgcttattacttcccacactttgttctcagtattgttagtgcatcatgagtttcctgctagtgtttgaccactgggtactcctgaagatgttttttagtactagggatgcttttcagtattagggatgcttttttcagtactagggatgtactagggagtactgagtactcctgaagatgtttttcagtactagggatgcttttttcagtgttagggatgcttttcagtactagggatgcttttttcagtgctagggatgcttttcagtactagggatgctttccaaaatatcacctctttaacgtttactttttctagtgtgtgtctggaatccaaaggacatgaataagccactcataattaattttgagaagttttatcaaatgtttatgtttctaactgcaaaccttaattttggaaaggcacaatgtttaactcacctatgtttaaccatggctaatttaaaatagtctaagatttggccgtcactaattagtattctcaagaatttcatttttcaattttaagaagaaaagggattttggtcacattttgcttgtaaatgaaaattacatcctcattctttgtgtagtatctacacattgttataagccaaaaaacaaagtctgtctggaatctttgtacatatttgtatgttgctataattgttatttttatcttcattattgtgcaaaatataaatgagcatttgtacattgactgtataagaaaccatgggccaggtcctgtggctcatgcctataatcccaacactttgggaggctgaggcaggaggattgcttcagtccaggagttcaagactaacctgggcaacatagccctcatctctacaaaaaataaaaaaattagttgggtgtgatggcatgtgcctgtagtcccagctactcaggagactgacatgagaggatcacttgagactgggagattctgaggctgcagtgagctgtgattgcaccactacactccatcctaggtgagagggcaagaccctttctcagaaaaggaaaaaaagaaattctggacatgtttttatcagttttcaggacttggtatcaatgtacatagaatggctaataaaaattggaattgagattattgaaaaaaaa

SEQ ID NO: 3642 - DNA, 4876 bp, Homo sapiens
gcggcgcaggcgcggtgcgggcggcggacgggcgggcgcttcgccgtttgaatggctgcgggcccgggccctcacctcacctgaggtccggccgcccaggggtgcgctatgccgtcgggaggtgaccagtcgccaccgcccccgcctccccctccggcggcggcagcctcggatgaggaggaggaggacgacggcgaggcggaagacgccgcgccgcctgccgagtcgcccacccctcagatccagcagcggttcgacgagctgtgcagccgcctcaacatggacgaggcggcgcgggccgaggcctgggacagctaccgcagcatgagcgaaagctacacgctggagggaaatgatcttcattggttagcatgtgccttatatgtggcttgcagaaaatctgttccaactgtaagcaaagggacagtggaaggaaactatgtatctttaactagaatcctgaaatgttcagagcagagcttaatcgaattttttaataagatgaagaagtgggaagacatggcaaatctacccccacatttcagagaacgtactgagagattagaaagaaacttcactgtttctgctgtaatttttaagaaatatgaacccatttttcaggacatctttaaataccctcaagaggagcaacctcgtcagcagcgaggaaggaaacagcggcgacagccctgtactgtgtctgaaattttccatttttgttgggtgctttttatatatgcaaaaggtaatttccccatgattagtgatgatttggtcaattcttatcacctgctgctgtgtgctttggacttagtttatggaaatgcacttcagtgttctaatcgtaaagaacttgtgaaccctaattttaaaggcttatctgaagattttcatgctaaagattctaaaccttcctctgaccccccttgtatcattgagaaactgtgttccttacatgatggcctagttttggaagcaaaggggataaaggaacatttctggaaaccctatattaggaaactttatgaaaaaaagctccttaagggaaaagaagaaaatctcactgggtttctagaacctgggaactttggagagagttttaaagccatcaataaggcctatgaggagtatgttttatctgttgggaatttagatgagcggatatttcttggagaggatgctgaggaggaaattgggactctctcaaggtgtctgaacgctggttcaggaacagagactgctgaaagggtgcagatgaaaaacatcttacagcagcattttgacaagtccaaagcacttagaatctccacaccactaactggtgttaggtacattaaggagaatagcccttgtgtgactccagtttctacagctacgcatagcttgagtcgtcttcacaccatgctgacaggcctcaggaatgcaccaagtgagaaactggaacagattctcaggacatgttccagagatccaacccaggctattgctaacagactgaaagaaatgtttgaaatatattctcagcatttccagccagacgaggatttcagtaattgtgctaaagaaattgccagcaaacattttcgttttgcggagatgctttactataaagtattagaatctgttattgagcaggaacaaaaaagactaggagacatggatttatctggtattctggaacaagatgcgttccacagatctctcttggcctgctgccttgaggtcgtcactttttcttataagcctcctgggaattttccatttattactgaaatatttgatgtgcctctttatcatttttataaggtgatagaagtattcattagagcagaagatggcctttgtagagaggtggtaaaacaccttaatcagattgaagaacagatcttagatcatttggcatggaaaccagagtctccactctgggaaaaaattagagacaatgaaaacagagttcctacatgtgaagaggtcatgccacctcagaacctggaaagggcagatgaaatttgcattgctggctcccctttgactcccagaagggtgactgaagttcgtgctgatactggaggacttggaaggagcataacatctccaaccacattatacgataggtacagctccccaccagccagcactaccagaaggcggctatttgttgagaatgatagcccctctgatggagggacgcctgggcgcatgcccccacagcccctagtcaatgctgtccctgtgcagaatgtatctggggagactgtttctgtcacaccagttcctggacagactttggtcaccatggcaaccgccactgtcacagccaacaatgggcaaacggtaaccattcctgtgcaaggtattgccaatgaaaatggagggataacattcttccctgtccaagtcaatgttggggggcaggcacaagctgtgacaggctccatccagcccctcagtgctcaggccctggctggaagtctgagctctcaacaggtgacaggaacaactttgcaagtccctggtcaagtggccattcaacagatttccccaggtggccaacagcagaagcaaggccagtctgtaaccagcagtagtaatagacccaggaagaccagctctttatcgcttttctttagaaaggtataccatttagcagctgtccgccttcgggatctctgtgccaaactagatatttcagatgaattgaggaaaaaaatctggacctgctttgaattctccataattcagtgtcctgaacttatgatggacagacatctggaccagttattaatgtgtgccatttatgtgatggcaaaggtcacaaaagaagataagtccttccagaacattatgcgttgttataggactcagccgcaggcccggagccaggtgtatagaagtgttttgataaaagggaaaagaaaaagaagaaattctggcagcagtgatagcagaagccatcagaattctccaacagaactaaacaaagatagaaccagtagagactccagtccagttatgaggtcaagcagcaccttgccagttccacagcccagcagtgctcctcccacacctactcgcctcacaggtgccaacagtgacatggaagaagaggagaggggagacctcattcagttctacaacaacatctacatcaaacagattaagacatttgccatgaagtactcacaggcaaatatggatgctcctccactctctccctatccatttgtaagaacaggctcccctcgccgaatacagttgtctcaaaatcatcctgtctacatttccccacataaaaatgaaacaatgctttctcctcgagaaaagattttctattacttcagcaacagtccttcaaagagactgagagaaattaatagtatgatacgcacaggagaaactcctactaaaaagagaggaattcttttggaagatggaagtgaatcacctgcaaaaagaatttgcccagaaaatcattctgccttattacgccgtctccaagatgtagctaatgaccgtggttcccactgaggttagtctcttgtattaaactcttcacaaaatctgtttagcagcagcctttaatgcatctagattatggagcttttttccttaatccagctgatgagttacagcctgttagtaacatgaggggacattttggtgagaaatgggacttaactccttccagtgtccttagaacattttaattcatcccaactgtctttttttccctaccattcagtgattactgtcaaggctgcttagaatccaaacttggatttttgactctggcaaagcttttagaaatactgcaagaaaatgatgtgtacccaaacgtgagcataggaggcttctgttgacgtactccaacagaagaactgtgtttcaagttcaatcctacctgttttgtggtcagctgtagtcctcataaaaagcaaaacaaaaattaggtattttgtcctaaaacacctggtaggagtgtgtgattttttgcattcctgacaaaggagagcacacccaggtttggaggtcctaggtcattagccctcgtctcccgttccctttgtgcacatcttccctctccccattcggtgtggtgcagtgtgaaaagtccttgattgttcgggtgtgcaatgtctgagtgaacctgtataagtggaggcactttagggctgtaaaatgcatgattttgtaacccagattttgctgtatatttgtgatagcactttctacaatgtgaactttattaaatacaaaacttccaggctaaacatccaatattttctttaatgcttttatatttttttaaaatgttaaaacccctatagccaccttttgggaatgttttaaattctccagttttttgttatatagggatcaaccagctaagaaaagattttaatcaagttgaattgaggggattaatatgaaaacttatgacctcttcctttaggagggagttatctaaaagaaatgtctattaaggtgatatatttaaaaatatttttgggtgttcctggcagtttaaaaaaattggttggagaatttaggtttttattagtaccatagtaccatttatacaaattagaaaatgttatttaacagctgaattatctatacatatctttattaatcactattgttccagcagttttcaagtcaaattaataatcttattagggagaaaattcaattgtaaattgaatcagtataaacaaagttactaggtaacttcatattgctgagagaaatatggaacttacattgttcaattagaatagtgttctgcaaaaatatttataaaacttctcaagatactgctactgtaattttatatgaagataagtgtatttttcaataaagcatttataaatta

SEQ ID NO: 3643 - DNA, 4465 bp, Homo sapiens
gagagcttacagtacagtcagcgagatgaggcaggtatgaagattccagtgcatgcaatgcagtgtgttataaaagtcccatgactaccagagggaatacagatgtaaaacttaggaggaaaagaaatcactctggatgagccagtcaggcgacagccctgtactgtgtctgaaattttccatttttgttgggtgctttttatatatgcaaaaggtaatttccccatgattagtgatgatttggtcaattcttatcacctgctgctgtgtgctttggacttagtttatggaaatgcacttcagtgttctaatcgtaaagaacttgtgaaccctaattttaaaggcttatctgaagattttcatgctaaagattctaaaccttcctctgaccccccttgtatcattgagaaactgtgttccttacatgatggcctagttttggaagcaaaggggataaaggaacatttctggaaaccctatattaggaaactttatgaaaaaaagctccttaagggaaaagaagaaaatctcactgggtttctagaacctgggaactttggagagagtttatggagtctcgctgtgtcgcccaggctggaatgcagtggcatgatctcggctcactgcaacctctgcctcccaggttcaagcgattcttctgcctcagcctcctgagtagctgtgaatacagtaaagccatcaataaggcctatgaggagtatgttttatctgttgggaatttagatgagcggatatttcttggagaggatgctgaggaggaaattgggactctctcaaggtgtctgaacgctggttcaggaacagagactgctgaaagggtgcagatgaaaaacatcttacagcagcattttgacaagtccaaagcacttagaatctccacaccactaactggtgttaggtacattaaggagaatagcccttgtgtgactccagtttctacagctacgcatagcttgagtcgtcttcacaccatgctgacaggcctcaggaatgcaccaagtgagaaactggaacagattctcaggacatgttccagagatccaacccaggctattgctaacagactgaaagaaatgtttgaaatatattctcagcatttccagccagacgaggatttcagtaattgtgctaaagaaattgccagcaaacattttcgttttgcggagatgctttactataaagtattagaatctgttattgagcaggaacaaaaaagactaggagacatggatttatctggtattctggaacaagatgcgttccacagatctctcttggcctgctgccttgaggtcgtcactttttcttataagcctcctgggaattttccatttattactgaaatatttgatgtgcctctttatcatttttataaggtgatagaagtattcattagagcagaagatggcctttgtagagaggtggtaaaacaccttaatcagattgaagaacagatcttagatcatttggcatggaaaccagagtctccactctgggaaaaaattagagacaatgaaaacagagttcctacatgtgaagaggtcatgccacctcagaacctggaaagggcagatgaaatttgcattgctggctcccctttgactcccagaagggtgactgaagttcgtgctgatactggaggacttggaaggagcataacatctccaaccacattatacgataggtacagctccccaccagccagcactaccagaaggcggctatttgttgagaatgatagcccctctgatggagggacgcctgggcgcatgcccccacagcccctagtcaatgctgtccctgtgcagaatgtatctggggagactgtttctgtcacaccagttcctggacagactttggtcaccatggcaaccgccactgtcacagccaacaatgggcaaacggtaaccattcctgtgcaaggtattgccaatgaaaatggagggataacattcttccctgtccaagtcaatgttggggggcaggcacaagctgtgacaggctccatccagcccctcagtgctcaggccctggctggaagtctgagctctcaacaggtgacaggaacaactttgcaagtccctggtcaagtggccattcaacagatttccccaggtggccaacagcagaagcaaggccagtctgtaaccagcagtagtaatagacccaggaagaccagctctttatcgcttttctttagaaaggtataccatttagcagctgtccgccttcgggatctctgtgccaaactagatatttcagatgaattgaggaaaaaaatctggacctgctttgaattctccataattcagtgtcctgaacttatgatggacagacatctggaccagttattaatgtgtgccatttatgtgatggcaaaggtcacaaaagaagataagtccttccagaacattatgcgttgttataggactcagccgcaggcccggagccaggtgtatagaagtgttttgataaaagggaaaagaaaaagaagaaattctggcagcagtgatagcagaagccatcagaattctccaacagaactaaacaaagatagaaccagtagagactccagtccagttatgaggtcaagcagcaccttgccagttccacagcccagcagtgctcctcccacacctactcgcctcacaggtgccaacagtgacatggaagaagaggagaggggagacctcattcagttctacaacaacatctacatcaaacagattaagacatttgccatgaagtactcacaggcaaatatggatgctcctccactctctccctatccatttgtaagaacaggctcccctcgccgaatacagttgtctcaaaatcatcctgtctacatttccccacataaaaatgaaacaatgctttctcctcgagaaaagattttctattacttcagcaacagtccttcaaagagactgagagaaattaatagtatgatacgcacaggagaaactcctactaaaaagagaggaattcttttggaagatggaagtgaatcacctgcaaaaagaatttgcccagaaaatcattctgccttattacgccgtctccaagatgtagctaatgaccgtggttcccactgaggttagtctcttgtattaaactcttcacaaaatctgtttagcagcagcctttaatgcatctagattatggagcttttttccttaatccagctgatgagttacagcctgttagtaacatgaggggacattttggtgagaaatgggacttaactccttccagtgtccttagaacattttaattcatcccaactgtctttttttccctaccattcagtgattactgtcaaggctgcttagaatccaaacttggatttttgactctggcaaagcttttagaaatactgcaagaaaatgatgtgtacccaaacgtgagcataggaggcttctgttgacgtactccaacagaagaactgtgtttcaagttcaatcctacctgttttgtggtcagctgtagtcctcataaaaagcaaaacaaaaattaggtattttgtcctaaaacacctggtaggagtgtgtgattttttgcattcctgacaaaggagagcacacccaggtttggaggtcctaggtcattagccctcgtctcccgttccctttgtgcacatcttccctctccccattcggtgtggtgcagtgtgaaaagtccttgattgttcgggtgtgcaatgtctgagtgaacctgtataagtggaggcactttagggctgtaaaatgcatgattttgtaacccagattttgctgtatatttgtgatagcactttctacaatgtgaactttattaaatacaaaacttccaggctaaacatccaatattttctttaatgcttttatatttttttaaaatgttaaaacccctatagccaccttttgggaatgttttaaattctccagttttttgttatatagggatcaaccagctaagaaaagattttaatcaagttgaattgaggggattaatatgaaaacttatgacctcttcctttaggagggagttatctaaaagaaatgtctattaaggtgatatatttaaaaatatttttgggtgttcctggcagtttaaaaaaattggttggagaatttaggtttttattagtaccatagtaccatttatacaaattagaaaatgttatttaacagctgaattatctatacatatctttattaatcactattgttccagcagttttcaagtcaaattaataatcttattagggagaaaattcaattgtaaattgaatcagtataaacaaagttactaggtaacttcatattgctgagagaaatatggaacttacattgttcaattagaatagtgttctgcaaaaatatttataaaacttctcaagatactgctactgtaattttatatgaagataagtgtatttttcaataaagcatttataaat

SEQ ID NO: 3644 - DNA, 1995 bp, Homo sapiens
atttaaacctgaggccatttgatttctcaagtcgttttataattaatttgtagaaagagtcgggcaaataggtccaggatgcaaagcctaaccaagggaaatgatcttcattggttagcatgtgccttatatgtggcttgcagaaaatctgttccaactgtaagcaaagggacagtggaaggaaactatgtatctttaactagaatcctgaaatgttcagagcagagcttaatcgaattttttaataagatgaagaagtgggaagacatggcaaatctacccccacatttcagagaacgtactgagagattagaaagaaacttcactgtttctgctgtaatttttaagaaatatgaacccatttttcaggacatctttaaataccctcaagaggagcaacctcgtcagcagcgaggaaggaaacagcggcgacagccctgtactgtgtctgaaattttccatttttgttgggtgctttttatatatgcaaaaggtaatttccccatgattagtgatgatttggtcaattcttatcacctgctgctgtgtgctttggacttagtttatggaaatgcacttcagtgttctaatcgtaaagaacttgtgaaccctaattttaaaggcttatctgaagattttcatgctaaagattctaaaccttcctctgaccccccttgtatcattgagaaactgtgttccttacatgatggcctagttttggaagcaaaggggataaaggaacatttctggaaaccctatattaggaaactttatgaaaaaaagctccttaagggaaaagaagaaaatctcactgggtttctagaacctgggaactttggagagagttttaaagccatcaataaggcctatgaggagtatgttttatctgttgggaatttagatgagcggatatttcttggagaggatgctgaggaggaaattgggactctctcaaggtgtctgaacgctggttcaggaacagagactgctgaaagggtgcagatgaaaaacatcttacagcagcattttgacaagtccaaagcacttagaatctccacaccactaactggtgttaggtacattaaggagaatagcccttgtgtgactccagtttctacagctacgcatagcttgagtcgtcttcacaccatgctgacaggcctcaggaatgcaccaagtgagaaactggaacagattctcaggacatgttccagagatccaacccaggctattgctaacagactgaaagaaatgtttgaaatatattctcagcatttccagccagacgaggatttcagtaattgtgctaaagaaattgccagcaaacattttcgttttgcggagatgctttactataaagtattagaatctgttattgagcaggaacaaaaaagactaggagacatggatttatctggtattctggaacaagatgcgttccacagatctctcttggcctgctgccttgaggtcgtcactttttcttataagcctcctgggaattttccatttattactgaaatatttgatgtgcctctttatcatttttataaggtgatagaagtattcattagagcagaagatggcctttgtagagaggtggtaaaacaccttaatcagattgaagaacagatcttagatcatttggcatggaaaccagagtctccactctgggaaaaaattagagacaatgaaaacagagttcctacatgtgaagaggtcatgccacctcagaacctggaaagggcagatgaaatttgcattgctggctcccctttgactcccagaagggtgactgaagttcgtgctgatactggaggacttggaaggagcataacatctccaaccacattatacgataggtacagctccccaccagccagcactaccagaaggcggctatttgttgagaatgatagcccctctgatggagggacgcctgggcgcatgcccccacagcccctagtcaatgctgtccctgtgcagaatgtatct

SEQ ID NO: 3645 - DNA, 2098 bp, Homo sapiens
acacatgaggaaccaagtatattttaatattaaacctctttatagaagaaccaagcaagttggtttggctgtatcaatgcacagtttaatgtgttgattatcgtttgcctctttggcagagaagaatttttttttctctttagttcatttaagttgatttgttgaatgtttccatctatacaaaaaaagaattgctttgtatacgctgaggtaatttccccatgattagtgatgatttggtcaattcttatcacctgctgctgtgtgctttggacttagtttatggaaatgcacttcagtgttctaatcgtaaagaacttgtgaaccctaattttaaaggcttatctgaagattttcatgctaaagattctaaaccttcctctgaccccccttgtatcattgagaaactgtgttccttacatgatggcctagttttggaagcaaaggggataaaggaacatttctggaaaccctatattaggaaactttatgaaaaaaagctccttaagggaaaagaagaaaatctcactgggtttctagaacctgggaactttggagagagttttaaagccatcaataaggcctatgaggagtatgttttatctgttgggaatttagatgagcggatatttcttggagaggatgctgaggaggaaattgggactctctcaaggtgtctgaacgctggttcaggaacagagactgctgaaagggtgcagatgaaaaacatcttacagcagcattttgacaagtccaaagcacttagaatctccacaccactaactggtgttaggtacattaaggagaatagcccttgtgtgactccagtttctacagctacgcatagcttgagtcgtcttcacaccatgctgacaggcctcaggaatgcaccaagtgagaaactggaacagattctcaggacatgttccagagatccaacccaggctattgctaacagactgaaagaaatgtttgaaatatattctcagcatttccagccagacgaggatttcagtaattgtgctaaagaaattgccagcaaacattttcgttttgcggagatgctttactataaagtattagaatctgttattgagcaggaacaaaaaagactaggagacatggatttatctggtattctggaacaagatgcgttccacagatctctcttggcctgctgccttgaggtcgtcactttttcttataagcctcctgggaattttccatttattactgaaatatttgatgtgcctctttatcatttttataaggtgatagaagtattcattagagcagaagatggcctttgtagagaggtggtaaaacaccttaatcagattgaagaacagatcttagatcatttggcatggaaaccagagtctccactctgggaaaaaattagagacaatgaaaacagagttcctacatgtgaagaggtcatgccacctcagaacctggaaagggcagatgaaatttgcattgctggctcccctcgccgaatacagttgtctcaaaatcatcctgtctacatttccccacataaaaatgaaacaatgctttctcctcgagaaaagattttctattacttcagcaacagtccttcaaagagactgagagaaattaatagtatgatacgcacaggagaaactcctactaaaaagagaggaattcttttggaagatggaagtgaatcacctgcaaaaagaatttgcccagaaaatcattctgccttattacgccgtctccaagatgtagctaatgaccgtggttcccactgaggttagtctcttgtattaaactcttcacaaaatctgtttagcagcagcctttaatgcatctagattatggagcttttttccttaatccagctgatgagttacagcctgttagtaacatgaggggacattttggtgagaaatgggacttaactccttccagtgtccttagaacattttaattcatcccaactgtctttttttccctaccattcagtgattactgtcaaggctgcttagaatccaaacttggatttttgactctggcaaagcttttagaaatactgcaagaaaatgatgtgtacccaaacgtgagcatagga

SEQ ID NO: 3646 - DNA, 3084 bp, Homo sapiens
tctttgccaaaggggggaccagaattcccccatgcgagctgtttgaggactgggatgccgagaacgcgagcgatccgagcagggtttgtctgggcaccgtcggggtaggatccggaacgcattcggaaggctttttgcaagcatttacttggaaggagaacttgggatctttctgggaaccccccgccccggctggattggccgagcaagcctggaaaatggtaaatgatcatttggatcaattacaggcttttagctggcttgtctgtcataattcatgattcggggctgggaaaaagaccaacagcctacgtgccaaaaaaggggcagagtttgatggagttgggtggacttttctatgccatttgcctccacacctagaggataagcacttttgcagacattcagtgcaagggagatcatgtttgactgtatggatgttctgtcagtgagtcctgggcaaatcctggatttctacactgcgagtccgtcttcctgcatgctccaggagaaagctctcaaagcatgcttcagtggattgacccaaaccgaatggcagcatcggcacactgctcaatcaattgaaacacagagcaccagctctgaggaactcgtcccaagccccccatctccacttcctccccctcgagtgtacaaaccctgcttcgtctgccaggacaaatcatcagggtaccactatggggtcagcgcctgtgagggatgtaagggctttttccgcagaagtattcagaagaatatgatttacacttgtcaccgagataagaactgtgttattaataaagtcaccaggaatcgatgccaatactgtcgactccagaagtgctttgaagtgggaatgtccaaagaatctgtcaggaatgacaggaacaagaaaaagaaggagacttcgaagcaagaatgcacagagagctatgaaatgacagctgagttggacgatctcacagagaagatccgaaaagctcaccaggaaactttcccttcactctgccagctgggtaaatacaccacgaattccagtgctgaccatcgagtccgactggacctgggcctctgggacaaattcagtgaactggccaccaagtgcattattaagatcgtggagtttgctaaacgtctgcctggtttcactggcttgaccatcgcagaccaaattaccctgctgaaggccgcctgcctggacatcctgattcttagaatttgcaccaggtataccccagaacaagacaccatgactttctcagacggccttaccctaaatcgaactcagatgcacaatgctggatttggtcctctgactgaccttgtgttcacctttgccaaccagctcctgcctttggaaatggatgacacagaaacaggccttctcagtgccatctgcttaatctgtggagaccgccaggaccttgaggaaccgacaaaagtagataagctacaagaaccattgctggaagcactaaaaatttatatcagaaaaagacgacccagcaagcctcacatgtttccaaagatcttaatgaaaatcacagatctccgtagcatcagtgctaaaggtgcagagcgtgtaattaccttgaaaatggaaattcctggatcaatgccacctctcattcaagaaatgctggagaattctgaaggacatgaacccttgaccccaagttcaagtgggaacacagcagagcacagtcctagcatctcacccagctcagtggaaaacagtggggtcagtcagtcaccactcgtgcaataagacattttctagctacttcaaacattccccagtaccttcagttccaggatttaaaatgcaagaaaaaacatttttactgctgcttagtttttggactgaaaagatattaaaactcaagaaggaccaagaagttttcatatgtatcaatatatatactcctcactgtgtaacttacctagaaatacaaacttttccaattttaaaaaatcagccatttcatgcaaccagaaactagttaaaagcttctattttcctctttgaacactcaagattgcatggcaaagacccagtcaaaatgatttacccctggttaagtttctgaagactttgtacatacagaagtatggctctgttctttctatactgtatgtttggtgctttccttttgtcttgcatactcaaaataaccatgacaccaaggttatgaaatagactactgtacacgtctacctaggttcaaaaagataactgtcttgctttcatggaatagtcaagacatcaaggtaaggaaacaggactattgacaggactattgtacagtatgacaagataaggctgaagatattctactttagttagtatggaagcttgtctttgctctttctgatgctctcaaactgcatcttttatttcatgttgcccagtaaaagtatacaaattccctgcactagcagaagagaattctgtatcagtgtaactgccagttcagttaatcaaatgtcatttgttcaattgttaatgtcactttaaattaaaagtggtttattacttgtttaatgacataactacacagttagttaaaaaaaatttttttacagtaatgatagcctccaaggcagaaacacttttcagtgttaagtttttgtttacttgttcacaagccattagggaaatttcatgggataattagcaggctggtctaccacctggaccatgtaactctagtgtccttcctgattcatgcctgatattgggatttttttttccagccttcttgatgccaaggggctaattaatattaacaactcccaaagaaacaggcatagaatctgcctcctttgaccttgttcaatcactatgaagcagagtgaaagctgtggtagagtggttaacagatacaagtgtcagtttcttagttctcatttaagcactagtggaattttttttttttgatatattagcaagtctgtgatgtactttcactggctctgtttgtacattgagattgtttgtttaacaatgctttctatgttcatatactgtttacctttttccatggagtctcctggcaaagaataaaatatatttattttaaa

SEQ ID NO: 3647 - DNA, 1368 bp, Homo sapiens
atgaccaccagcggccacgcatgtccggtcccagcagtgaacggacacatgactcactatccagccacaccctacccgttactctttccacctgtcatcggaggactttccctgcctcccctccatggccttcatggacatccgcctccgagtggatgcagcaccccgtcgccggcaacaattgaaacacagagcaccagctctgaggaactcgtcccaagccccccatctccacttcctccccctcgagtgtacaaaccctgcttcgtctgccaggacaaatcatcagggtaccactatggggtcagcgcctgtgagggatgtaagggctttttccgcagaagtattcagaagaatatgatttacacttgtcaccgagataagaactgtgttattaataaagtcaccaggaatcgatgccaatactgtcgactccagaagtgctttgaagtgggaatgtccaaagaatctgtcaggaatgacaggaacaagaaaaagaaggagacttcgaagcaagaatgcacagagagctatgaaatgacagctgagttggacgatctcacagagaagatccgaaaagctcaccaggaaactttcccttcactctgccagctgggtaaatacaccacgaattccagtgctgaccatcgagtccgactggacctgggcctctgggacaaattcagtgaactggccaccaagtgcattattaagatcgtggagtttgctaaacgtctgcctggtttcactggcttgaccatcgcagaccaaattaccctgctgaaggccgcctgcctggacatcctgattcttagaatttgcaccaggtataccccagaacaagacaccatgactttctcagacggccttaccctaaatcgaactcagatgcacaatgctggatttggtcctctgactgaccttgtgttcacctttgccaaccagctcctgcctttggaaatggatgacacagaaacaggccttctcagtgccatctgcttaatctgtggagaccgccaggaccttgaggaaccgacaaaagtagataagctacaagaaccattgctggaagcactaaaaatttatatcagaaaaagacgacccagcaagcctcacatgtttccaaagatcttaatgaaaatcacagatctccgtagcatcagtgctaaaggtgcagagcgtgtaattaccttgaaaatggaaattcctggatcaatgccacctctcattcaagaaatgctggagaattctgaaggacatgaacccttgaccccaagttcaagtgggaacacagcagagcacagtcctagcatctcacccagctcagtggaaaacagtggggtcagtcagtcaccactcgtgcaataa

SEQ ID NO: 3648 - DNA, 2775 bp, Homo sapiens
gtgacagaagtagtaggaagtgagctgttcagaggcaggagggtctattctttgccaaaggggggaccagaattcccccatgcgagctgtttgaggactgggatgccgagaacgcgagcgatccgagcagggtttgtctgggcaccgtcggggtaggatccggaacgcattcggaaggctttttgcaagcatttacttggaaggagaacttgggatctttctgggaaccccccgccccggctggattggccgagcaagcctggaaaatgcaattgaaacacagagcaccagctctgaggaactcgtcccaagccccccatctccacttcctccccctcgagtgtacaaaccctgcttcgtctgccaggacaaatcatcagggtaccactatggggtcagcgcctgtgagggatgtaagggctttttccgcagaagtattcagaagaatatgatttacacttgtcaccgagataagaactgtgttattaataaagtcaccaggaatcgatgccaatactgtcgactccagaagtgctttgaagtgggaatgtccaaagaatctgtcaggaatgacaggaacaagaaaaagaaggagacttcgaagcaagaatgcacagagagctatgaaatgacagctgagttggacgatctcacagagaagatccgaaaagctcaccaggaaactttcccttcactctgccagctgggtaaatacaccacgaattccagtgctgaccatcgagtccgactggacctgggcctctgggacaaattcagtgaactggccaccaagtgcattattaagatcgtggagtttgctaaacgtctgcctggtttcactggcttgaccatcgcagaccaaattaccctgctgaaggccgcctgcctggacatcctgattcttagaatttgcaccaggtataccccagaacaagacaccatgactttctcagacggccttaccctaaatcgaactcagatgcacaatgctggatttggtcctctgactgaccttgtgttcacctttgccaaccagctcctgcctttggaaatggatgacacagaaacaggccttctcagtgccatctgcttaatctgtggagaccgccaggaccttgaggaaccgacaaaagtagataagctacaagaaccattgctggaagcactaaaaatttatatcagaaaaagacgacccagcaagcctcacatgtttccaaagatcttaatgaaaatcacagatctccgtagcatcagtgctaaaggtgcagagcgtgtaattaccttgaaaatggaaattcctggatcaatgccacctctcattcaagaaatgctggagaattctgaaggacatgaacccttgaccccaagttcaagtgggaacacagcagagcacagtcctagcatctcacccagctcagtggaaaacagtggggtcagtcagtcaccactcgtgcaataagacattttctagctacttcaaacattccccagtaccttcagttccaggatttaaaatgcaagaaaaaacatttttactgctgcttagtttttggactgaaaagatattaaaactcaagaaggaccaagaagttttcatatgtatcaatatatatactcctcactgtgtaacttacctagaaatacaaacttttccaattttaaaaaatcagccatttcatgcaaccagaaactagttaaaagcttctattttcctctttgaacactcaagattgcatggcaaagacccagtcaaaatgatttacccctggttaagtttctgaagactttgtacatacagaagtatggctctgttctttctatactgtatgtttggtgctttccttttgtcttgcatactcaaaataaccatgacaccaaggttatgaaatagactactgtacacgtctacctaggttcaaaaagataactgtcttgctttcatggaatagtcaagacatcaaggtaaggaaacaggactattgacaggactattgtacagtatgacaagataaggctgaagatattctactttagttagtatggaagcttgtctttgctctttctgatgctctcaaactgcatcttttatttcatgttgcccagtaaaagtatacaaattccctgcactagcagaagagaattctgtatcagtgtaactgccagttcagttaatcaaatgtcatttgttcaattgttaatgtcactttaaattaaaagtggtttattacttgtttaatgacataactacacagttagttaaaaaaaatttttttacagtaatgatagcctccaaggcagaaacacttttcagtgttaagtttttgtttacttgttcacaagccattagggaaatttcatgggataattagcaggctggtctaccacctggaccatgtaactctagtgtccttcctgattcatgcctgatattgggatttttttttccagccttcttgatgccaaggggctaattaatattaacaactcccaaagaaacaggcatagaatctgcctcctttgaccttgttcaatcactatgaagcagagtgaaagctgtggtagagtggttaacagatacaagtgtcagtttcttagttctcatttaagcactagtggaattttttttttttgatatattagcaagtctgtgatgtactttcactggctctgtttgtacattgagattgtttgtttaacaatgctttctatgttcatatactgtttacctttttccatggagtctcctggcaaagaataaaatatatttattttaaa

SEQ ID NO: 3649 - DNA, 2590 bp, Homo sapiens
agacaaacccaaaacatttatgtgcatagaaaaaaattctggaaggtcgtacacagtgaatttctctgagtgaaaagattgtggcaattgaaacacagagcaccagctctgaggaactcgtcccaagccccccatctccacttcctccccctcgagtgtacaaaccctgcttcgtctgccaggacaaatcatcagggtaccactatggggtcagcgcctgtgagggatgtaagggctttttccgcagaagtattcagaagaatatgatttacacttgtcaccgagataagaactgtgttattaataaagtcaccaggaatcgatgccaatactgtcgactccagaagtgctttgaagtgggaatgtccaaagaatctgtcaggaatgacaggaacaagaaaaagaaggagacttcgaagcaagaatgcacagagagctatgaaatgacagctgagttggacgatctcacagagaagatccgaaaagctcaccaggaaactttcccttcactctgccagctgggtaaatacaccacgaattccagtgctgaccatcgagtccgactggacctgggcctctgggacaaattcagtgaactggccaccaagtgcattattaagatcgtggagtttgctaaacgtctgcctggtttcactggcttgaccatcgcagaccaaattaccctgctgaaggccgcctgcctggacatcctgattcttagaatttgcaccaggtataccccagaacaagacaccatgactttctcagacggccttaccctaaatcgaactcagatgcacaatgctggatttggtcctctgactgaccttgtgttcacctttgccaaccagctcctgcctttggaaatggatgacacagaaacaggccttctcagtgccatctgcttaatctgtggagaccgccaggaccttgaggaaccgacaaaagtagataagctacaagaaccattgctggaagcactaaaaatttatatcagaaaaagacgacccagcaagcctcacatgtttccaaagatcttaatgaaaatcacagatctccgtagcatcagtgctaaaggtgcagagcgtgtaattaccttgaaaatggaaattcctggatcaatgccacctctcattcaagaaatgctggagaattctgaaggacatgaacccttgaccccaagttcaagtgggaacacagcagagcacagtcctagcatctcacccagctcagtggaaaacagtggggtcagtcagtcaccactcgtgcaataagacattttctagctacttcaaacattccccagtaccttcagttccaggatttaaaatgcaagaaaaaacatttttactgctgcttagtttttggactgaaaagatattaaaactcaagaaggaccaagaagttttcatatgtatcaatatatatactcctcactgtgtaacttacctagaaatacaaacttttccaattttaaaaaatcagccatttcatgcaaccagaaactagttaaaagcttctattttcctctttgaacactcaagattgcatggcaaagacccagtcaaaatgatttacccctggttaagtttctgaagactttgtacatacagaagtatggctctgttctttctatactgtatgtttggtgctttccttttgtcttgcatactcaaaataaccatgacaccaaggttatgaaatagactactgtacacgtctacctaggttcaaaaagataactgtcttgctttcatggaatagtcaagacatcaaggtaaggaaacaggactattgacaggactattgtacagtatgacaagataaggctgaagatattctactttagttagtatggaagcttgtctttgctctttctgatgctctcaaactgcatcttttatttcatgttgcccagtaaaagtatacaaattccctgcactagcagaagagaattctgtatcagtgtaactgccagttcagttaatcaaatgtcatttgttcaattgttaatgtcactttaaattaaaagtggtttattacttgtttaatgacataactacacagttagttaaaaaaaatttttttacagtaatgatagcctccaaggcagaaacacttttcagtgttaagtttttgtttacttgttcacaagccattagggaaatttcatgggataattagcaggctggtctaccacctggaccatgtaactctagtgtccttcctgattcatgcctgatattgggatttttttttccagccttcttgatgccaaggggctaattaatattaacaactcccaaagaaacaggcatagaatctgcctcctttgaccttgttcaatcactatgaagcagagtgaaagctgtggtagagtggttaacagatacaagtgtcagtttcttagttctcatttaagcactagtggaattttttttttttgatatattagcaagtctgtgatgtactttcactggctctgtttgtacattgagattgtttgtttaacaatgctttctatgttcatatactgtttacctttttccatggagtctcctggcaaagaataaaatatatttattttaaa

SEQ ID NO: 3650 - DNA, 1326 bp, Homo sapiens
atgaccaccagcggccacgcatgtccggtcccagcagtgaacggacacatgactcactatccagccacaccctacccgttactctttccacctgtcatcggaggactttccctgcctcccctccatggccttcatggacatccgcctccgagtggatgcagcaccccgtcgccggcaacaattgaaacacagagcaccagctctgaggaactcgtcccaagccccccatctccacttcctccccctcgagtgtacaaaccctgcttcgtctgccaggacaaatcatcagggtaccactatggggtcagcgcctgtgagggatgtaagggctttttccgcagaagtattcagaagaatatgatttacacttgtcaccgagataagaactgtgttattaataaagtcaccaggaatcgatgccaatactgtcgactccagaagtgctttgaagtgggaatgtccaaagaatctgtcaggaatgacaggaacaagaaaaagaaggagacttcgaagcaagaatgcacagagagctatgaaatgacagctgagttggacgatctcacagagaagatccgaaaagctcaccaggaaactttcccttcactctgccagctgggtaaatacaccacgaattccagtgctgaccatcgagtccgactggacctgggcctctgggacaaattcagtgaactggccaccaagtgcattattaagatcgtggagtttgctaaacgtctgcctggtttcactggcttgaccatcgcagaccaaattaccctgctgaaggccgcctgcctggacatcctgattcttagaatttgcaccaggtataccccagaacaagacaccatgactttctcagacggccttaccctaaatcgaactcagatgcacaatgctggatttggtcctctgactgaccttgtgttcacctttgccaaccagctcctgcctttggaaatggatgacacagaaacaggccttctcagtgccatctgcttaatctgtggagaccgccaggaccttgaggaaccgacaaaagtagataagctacaagaaccattgctggaagcactaaaaatttatatcagaaaaagacgacccagcaagcctcacatgtttccaaagatcttaatgaaaatcacagatctccgtagcatcagtgctaaaggtgcagagcgtgtaattaccttgaaaatggaaattcctgaaggacatgaacccttgaccccaagttcaagtgggaacacagcagagcacagtcctagcatctcacccagctcagtggaaaacagtggggtcagtcagtcaccactcgtgcaataa

SEQ ID NO: 3651 - DNA, 1935 bp, Homo sapiens
aatggatcctcccgcaggctttgtgcgcgctgggaatccagctgtcgccgccccgcagagccccctgtccccggagggcgctcatttccgggccgcccaccacccgcgtagcaccggcagccgctgtcccggcagtctccagccgtcccgcccgcttgtggccaactggctccagtcactccccgaaatgccagtcgacttcactgggtactggaagatgttggtcaacgagaatttcgaggagtacctgcgcgccctcgacgtcaatgtggccttgcgcaaaatcgccaacttgctgaagccagacaaagagatcgtgcaggacggtgaccatatgatcatccgcacgctgagcacttttaggaactacatcatggacttccaggttgggaaggagtttgaggaggatctgacaggcatagatgaccgcaagtgcatgagtgaaactggcttttcctcttgaatgtgctgacttttgattccagccccccaggaatggatcagagaagaggagccgctacccacccactcatcagcctggcctcaggggcagctcatggactttttagccagagagaaccgggttcaagttatggctcaagccctaaccccttggtgatgggctggttacttatagaagcctaatttttatcagctctaaagcttgaagatttagtgaaacattgtggaaagctcccagcacagtacctggcacctggcaggttctctgtcatctcccctacttttccctcctgatcacttatttaacacaagcaccagatgctgaaaaccctctaattgtcccaggaacacacataccctcaaagggagaagcacactttcaaatcaaactccaggatttgcatcttttagcaatttccattatgcggagaaagtatctactcactgtctggttttgaaattttaccccaaatcgaaagagcatgggttttggtgtcagacctgggtcggtcctggctctggcctttgcaggcagtatcaccacgggcaaggcttcacctctcataacctggctgtggaaccacagaaacaacagaattcagtcccagccctccagaggtggatccgtaaacagagggactactagggctgggtggagggctgtgagtgatccaacatcccctgctcttgagagtggtgttttagcatgggagtgttaatgaatgtcacaagtttcttgataccaaatagagttcctaccatttgcaggtcataccggtcactgccaagagatggcttatttagtgggaattgtctggcactcctagtataagtcacctaagtggggcaagtgggccttgaaacatccctgggagacactcactcaggctgcctgtgggagctgggctttttgtgtcactctcccatgcagcagtgacggctggggtttctaagtggtcagaggagctggaaaatggcttctgaagtaacagtcccttgtcatagtggtacaaagatgtcttcattcatctgttggcacatgtctctgggtaaactgccggcaaggccaaagtgatgggggttattattagtttttaatagaaaagttagactggcttcactttccaaccagcttccctagttccagcccatttgcagacttttgggtggtctgtgggatgaaaatttcttgtgaggaggtgagctgaagatggccatccctcctggttgctcttggattgtctgggcttcatttctaaggcggtcccagagcccatgtgggggttgggggaagcagcattgtctagcccctttggtttgtacccatgttcaccccacccccacagccacctgccttttctgtgggacttgaaaagcatcaggaatatcttcctacctgaaattcttccattagaccctgattaattggattaatctaggaaaccagattaaatgaccatttaacgacccttt

SEQ ID NO: 3652 - DNA, 898 bp, Homo sapiens
aaacgaactgaacgtctgaaacgaaggtggcgcggcctggacaaacctgacccttcgacatcccccgcccctgcgcccgccctcgctaagcggggaggagcgaccgctacaatggatcctcccgcaggctttgtgcgcgctgggaatccagctgtcgccgccccgcagagccccctgtccccggagggcgctcatttccgggccgcccaccacccgcgtagcaccggcagccgctgtcccggcagtctccagccgtcccgcccgcttgtggccaactggctccagtcactccccgaaatgccagtcgacttcactgggtactggaagatgttggtcaacgagaatttcgaggagtacctgcgcgccctcgacgtcaatgtggccttgcgcaaaatcgccaacttgctgaagccagacaaagagatcgtgcaggacggtgaccatatgatcatccgcacgctgagcacttttaggaactacatcatggacttccaggttgggaaggagtttgaggaggatctgacaggcatagatgaccgcaagtgcatgacaacagtgagctgggacggagacaagctccagtgtgtgcagaagggtgagaaggaggggcgtggctggacccagtggatcgagggtgatgagctgcacctggagatgagagtggaaggtgtggtctgcaagcaagtattcaagaaggtgcagtgaggcccaggcagacaaccttgtcccaaggaatcagcaggatgtgtgggccaggatccccctctttgcacagcatgaggcaaaaatgtccagccacccccaggcatctgttagcagagtctgtctcttggctttgtcacttttccttttcttaaaacaaagccatgccaataaagtgatctgtgttcaaaacgtc

SEQ ID NO: 3653 - DNA, 1487 bp, Homo sapiens
aaacgaactgaacgtctgaaacgaaggtggcgcggcctggacaaacctgacccttcgacatcccccgcccctgcgcccgccctcgctaagcggggaggagcgaccgctacaatggatcctcccgcaggctttgtgcgcgctgggaatccagctgtcgccgccccgcagagccccctgtccccggagggcgctcatttccgggccgcccaccacccgcgtagcaccggcagccgctgtcccggcagtctccagccgtcccgcccgcttgtggccaactggctccagtcactccccgaaatgccagtcgacttcactgggtactggaagatgttggtcaacgagaatttcgaggagtacctgcgcgccctcgacgtcaatgtggccttgcgcaaaatcgccaacttgctgaagccagacaaagagatcgtgcaggacggtgaccatatgatcatccgcacgctgagcacttttaggaactacatcatggacttccaggttgggaaggagtttgaggaggatctgacaggcatagatgaccgcaagtgcatggctggagtgcaatcgcgtgatctcagctcactgtaacctctgcctcccgggttcaagcaattctcctgcctcagcctcccaagtagctgggattacagtcacacgccaccacacctggataattttgtatttttggtagagacagggtttcactatgttggtcaggctggtctcaaactcctgagctcaggtgatccatctgcctcagcctcccaaaatgctgggattacaagtgtgagccactacacctggttcttctttccactgtttgctaactcccatggtgttttctggcatcacttccagcattatttctagccttacctcttccaggaagccttccctgatgggcctctgtctctaccttaaaggctgtcgaggtgccttctgacttccataacctccagcatttgtctaccagtacttaccattctgctggaattctctgtcttcttaccttcttctcagataatctgtgagccctcaagagcaggccactgaccttacttccctctctccagcacctacagctggtgcataggaggtgtgaaacccatgattgctgaatgccgttcccttgcacagaaccacgtggtgaattcctattgctcagtcaagggtcagtttaaagcagggaactgcagagcacagtcatcaagagcatgagctctagagccaaatctcatctccccacttcacggctgggtgaacttcaggcctcagtctccacatttgtaaaatgatgagaagcatacctgctctaggaggttgtcaggagtcaactggtatgacatatactttgcctagtaccctgcccagcacataatgttgggcattatcattatcataacaacacatgttgttatgatattgattatggtgactgataatgacagcaatgctatcactcccaccagggagccttccctgacccccca

SEQ ID NO: 3654 - DNA, 4751 bp, Homo sapiens
cggagggggaggggcggagagccaccgcggagcgcgcgcggggttggttgccgcgagcgtgggggagcgtggaccgcggcgctgctcagcggtggggctgccttcccccggccctcctccctggtccctggcgagggcactggcggcggcggggccggggtccgcaaggccggagaaggccgccgggcccgggcatggtggtctggggcaacgcggaagaagctccaccatgaggcgaggtggatggaggaagcgagctgaaaatgatggctgggaaacatggggtgggtatatggctgccaaggtccagaaattggaggaacagtttcgatcagatgctgctatgcagaaggatgggacttcatctacaatttttagtggagttgccatctatgttaatggatacacagatccttccgctgaggaattgagaaaactaatgatgttgcatggaggtcaataccatgtatattattccagatctaaaacaacacatattattgccacaaatcttcccaatgccaaaattaaagaattaaagggggaaaaagtaattcgaccagaatggattgtggaaagcatcaaagctggacgactcctctcctacattccatatcagctgtacaccaagcagtccagtgtgcagaaaggtctcagctttaatcctgtatgcagacctgaggatcctctgccaggtccaagcaatatagccaaacagctcaacaacagggtaaatcacatcgttaagaagattgaaacggaaaatgaagtcaaagtcaatggcatgaacagttggaatgaagaagatgaaaataatgattttagttttgtggatctggagcagacctctccgggaaggaaacagaatggaattccgcatcccagagggagcactgccatttttaatggacacactcctagctctaatggtgccttaaagacacaggattgcttggtgcccatggtcaacagtgttgccagcaggctttctccagccttttcccaggaggaggataaggctgagaagagcagcactgatttcagagactgcactctgcagcagttgcagcaaagcaccagaaacacagatgctttgcggaatccacacagaactaattctttctcattatcacctttgcacagtaacactaaaatcaatggtgctcaccactccactgttcaggggccttcaagcacaaaaagcacttcttcagtatctacgtttagcaaggcagcaccttcagtgccatccaaaccttcagactgcaattttatttcaaacttctattctcattcaagactgcatcacatatcaatgtggaagtgtgaattgactgagtttgtcaataccctacaaagacaaagtaatggtatctttccaggaagggaaaagttaaaaaaaatgaaaacaggcaggtctgcacttgttgtaactgacacaggagatatgtcagtattgaattctcccagacatcagagctgtataatgcatgttgatatggattgcttctttgtatcagtgggtatacgaaatagaccagatctcaaaggaaaaccagtggctgttacaagtaacagaggcacaggaagggcacctttacgtcctggcgctaacccccagctggagtggcagtattaccagaataaaatcctgaaaggcaaagcagcagatataccagattcatcattgtgggagaatccagattctgcgcaagcaaatggaattgattctgttttgtcaagggctgaaattgcatcttgtagttatgaggccaggcaacttggcattaagaacggaatgttttttgggcatgctaaacaactatgtcctaatcttcaagctgttccatacgattttcatgcatataaggaagtcgcacaaacattgtatgaaacattggcaagctacactcataacattgaagctgtcagttgtgatgaagcgctggtagacattaccgaaatccttgcagagaccaaacttactcctgatgaatttgcaaatgctgttcgtatggaaatcaaagaccagacgaaatgtgctgcctctgttggaattggttctaatattctcctggctagaatggcaactagaaaagcaaaaccagatgggcagtaccacctaaaaccagaagaagtagatgattttatcagaggccagctagtgaccaatctaccaggagttggacattcaatggaatctaagttggcatctttgggaattaaaacttgtggagacttgcagtatatgaccatggcaaaactccaaaaagaatttggtcccaaaacaggtcagatgctttataggttctgccgtggcttggatgatagaccagttcgaactgaaaaggaaagaaaatctgtttcagctgagatcaactatggaataaggtttactcagccaaaagaggcagaagcttttcttctgagtctttcagaagaaattcaaagaagactagaagccactggcatgaagggtaaacgtctaactctcaaaatcatggtacgaaagcctggggctcctgtagaaactgcaaaatttggaggccatggaatttgtgataacattgccaggactgtaactcttgaccaggcaacagataatgcaaaaataattggaaaggcgatgctaaacatgtttcatacaatgaaactaaatatatcagatatgagaggggttgggattcacgtgaatcagttggttccaactaatctgaacccttccacatgtcccagtcgcccatcagttcagtcaagccactttcctagtgggtcatactctgtccgtgatgtcttccaagttcagaaagctaagaaatccaccgaagaggagcacaaagaagtatttcgggctgctgtggatctggaaatatcatctgcttctagaacttgcactttcttgccaccttttcctgcacatctgccgaccagtcctgatactaacaaggctgagtcttcagggaaatggaatggtctacatactcctgtcagtgtgcagtcgagacttaacctgagtatagaggtcccgtcaccttcccagctggatcagtctgttttagaagcacttccacctgatctccgggaacaagtagagcaagtctgtgctgtccagcaagcagagtcacatggcgacaaaaagaaagaaccagtaaatggctgtaatacaggaattttgccacaaccagttgggacagtcttgttgcaaataccagaacctcaagaatcgaacagtgacgcaggaataaatttaatagcccttccagcattttcacaggtggaccctgaggtatttgctgcccttcctgctgaacttcagagggagctgaaagcagcgtatgatcaaagacaaaggcagggcgagaacagcactcaccagcagtcagccagcgcatctgtgccaaagaatcctttacttcatctaaaggcagcagtgaaagaaaagaaaagaaacaagaagaaaaaaaccattggttcaccaaaaaggattcagagtcctttgaataacaagctgcttaacagtcctgcaaaaactctgccaggggcctgtggcagtccccagaagttaattgatgggtttctaaaacatgaaggacctcctgcagagaaacccctggaagaactctctgcttctacttcaggtgtgccaggcctttctagtttgcagtctgacccagctggctgtgtgagacctccagcacccaatctagctggagctgttgaattcaatgatgtgaagaccttgctcagagaatggataactacaatttcagatccaatggaagaagacattctccaagttgtgaaatactgtactgatctaatagaagaaaaagatttggaaaaactggatctagttataaaatacatgaaaaggctgatgcagcaatcggtggaatcggtttggaatatggcatttgactttattcttgacaatgtccaggtggttttacaacaaacttatggaagcacattaaaagttacataaatattaccagagagcctgatgctctctgatagctgtgccataagtgcttgtgaggtatttgcaaagtgcatgatagtaatgctcggagtttttataattttaaatttcttttaaagcaagtgttttgtacatttcttttcaaaaagtgccaaatttgtcagtattgcatgtaaataattgtgttaattattttactgtagcatagattctatttacaaaatgtttgtttataaagttttatggatttttacagtgaagtgtttacagttgtttaataaagaactgtatgtatattttgtacaggctcctttttgtgaatccttaaaaactcaactctaggaagcaactactgtttattatactaaaaggctgaaaaacctccaggccagactgctaagctctgaaattcctgagaggtctcagaccgggattctacttgttccaagaaagggtaaagcttctaaaccatcttattcttgtctccaagcatgaacacaggagcatgttaagaaaatctttactacttcttccatgcggagaaatctacatattttgaattagaaacaccctcacacccacttgaagatttttttcctgggaacattatgtcccgtagatcagaggtggtgttgtctttttgcttctactggccattgagaaactttgatgataaaaaagaacggtatagatttttcaaacgtatataaaatatttttatgttatatgttatgccataactttaaaataaaaatagtttaaaattcta

SEQ ID NO: 3655 - DNA, 4686 bp, Homo sapiens
gggagcgtggaccgcggcgctgctcagcggtggggctgccttcccccggccctcctccctggtccctggcgagggcactggcggcggcggggccggggtccgcaaggccggagaaggccgccgggcccgggcatggtggtctggggcaacgcggaagaagctccaccatgaggcgaggtggatggaggaagcgagctgaaaatgatggctgggaaacatggggtgggtatatggctgccaaggtccagaaattggaggaacagtttcgatcagatgctgctatgcagaaggatgggacttcatctacaatttttagtggagttgccatctatgttaatggatacacagatccttccgctgaggaattgagaaaactaatgatgttgcatggaggtcaataccatgtatattattccagatctaaaacaacacatattattgccacaaatcttcccaatgccaaaattaaagaattaaagggggaaaaagtaattcgaccagaatggattgtggaaagcatcaaagctggacgactcctctcctacattccatatcagctgtacaccaagcagtccagtgtgcagaaaggtctcagctttaatcctgtatgcagacctgaggatcctctgccaggtccaagcaatatagccaaacagctcaacaacagggtaaatcacatcgttaagaagattgaaacggaaaatgaagtcaaagtcaatggcatgaacagttggaatgaagaagatgaaaataatgattttagttttgtggatctggagcagacctctccgggaaggaaacagaatggaattccgcatcccagagggagcactgccatttttaatggacacactcctagctctaatggtgccttaaagacacaggattgcttggtgcccatggtcaacagtgttgccagcaggctttctccagccttttcccaggaggaggataaggctgagaagagcagcactgatttcagagactgcactctgcagcagttgcagcaaagcaccagaaacacagatgctttgcggaatccacacagaactaattctttctcattatcacctttgcacagtaacactaaaatcaatggtgctcaccactccactgttcaggggccttcaagcacaaaaagcacttcttcagtatctacgtttagcaaggcagcaccttcagtgccatccaaaccttcagactgcaattttatttcaaacttctattctcattcaagactgcatcacatatcaatgtggaagtgtgaattgactgagtttgtcaataccctacaaagacaaagtaatggtatctttccaggaagggaaaagttaaaaaaaatgaaaacaggcaggtctgcacttgttgtaactgacacaggagatatgtcagtattgaattctcccagacatcagagctgtataatgcatgttgatatggattgcttctttgtatcagtgggtatacgaaatagaccagatctcaaaggaaaaccagtggctgttacaagtaacagaggcacaggaagggcacctttacgtcctggcgctaacccccagctggagtggcagtattaccagaataaaatcctgaaaggcaaagcagatataccagattcatcattgtgggagaatccagattctgcgcaagcaaatggaattgattctgttttgtcaagggctgaaattgcatcttgtagttatgaggccaggcaacttggcattaagaacggaatgttttttgggcatgctaaacaactatgtcctaatcttcaagctgttccatacgattttcatgcatataaggaagtcgcacaaacattgtatgaaacattggcaagctacactcataacattgaagctgtcagttgtgatgaagcgctggtagacattaccgaaatccttgcagagaccaaacttactcctgatgaatttgcaaatgctgttcgtatggaaatcaaagaccagacgaaatgtgctgcctctgttggaattggttctaatattctcctggctagaatggcaactagaaaagcaaaaccagatgggcagtaccacctaaaaccagaagaagtagatgattttatcagaggccagctagtgaccaatctaccaggagttggacattcaatggaatctaagttggcatctttgggaattaaaacttgtggagacttgcagtatatgaccatggcaaaactccaaaaagaatttggtcccaaaacaggtcagatgctttataggttctgccgtggcttggatgatagaccagttcgaactgaaaaggaaagaaaatctgtttcagctgagatcaactatggaataaggtttactcagccaaaagaggcagaagcttttcttctgagtctttcagaagaaattcaaagaagactagaagccactggcatgaagggtaaacgtctaactctcaaaatcatggtacgaaagcctggggctcctgtagaaactgcaaaatttggaggccatggaatttgtgataacattgccaggactgtaactcttgaccaggcaacagataatgcaaaaataattggaaaggcgatgctaaacatgtttcatacaatgaaactaaatatatcagatatgagaggggttgggattcacgtgaatcagttggttccaactaatctgaacccttccacatgtcccagtcgcccatcagttcagtcaagccactttcctagtgggtcatactctgtccgtgatgtcttccaagttcagaaagctaagaaatccaccgaagaggagcacaaagaagtatttcgggctgctgtggatctggaaatatcatctgcttctagaacttgcactttcttgccaccttttcctgcacatctgccgaccagtcctgatactaacaaggctgagtcttcagggaaatggaatggtctacatactcctgtcagtgtgcagtcgagacttaacctgagtatagaggtcccgtcaccttcccagctggatcagtctgttttagaagcacttccacctgatctccgggaacaagtagagcaagtctgtgctgtccagcaagcagagtcacatggcgacaaaaagaaagaaccagtaaatggctgtaatacaggaattttgccacaaccagttgggacagtcttgttgcaaataccagaacctcaagaatcgaacagtgacgcaggaataaatttaatagcccttccagcattttcacaggtggaccctgaggtatttgctgcccttcctgctgaacttcagagggagctgaaagcagcgtatgatcaaagacaaaggcagggcgagaacagcactcaccagcagtcagccagcgcatctgtgccaaagaatcctttacttcatctaaaggcagcagtgaaagaaaagaaaagaaacaagaagaaaaaaaccattggttcaccaaaaaggattcagagtcctttgaataacaagctgcttaacagtcctgcaaaaactctgccaggggcctgtggcagtccccagaagttaattgatgggtttctaaaacatgaaggacctcctgcagagaaacccctggaagaactctctgcttctacttcaggtgtgccaggcctttctagtttgcagtctgacccagctggctgtgtgagacctccagcacccaatctagctggagctgttgaattcaatgatgtgaagaccttgctcagagaatggataactacaatttcagatccaatggaagaagacattctccaagttgtgaaatactgtactgatctaatagaagaaaaagatttggaaaaactggatctagttataaaatacatgaaaaggctgatgcagcaatcggtggaatcggtttggaatatggcatttgactttattcttgacaatgtccaggtggttttacaacaaacttatggaagcacattaaaagttacataaatattaccagagagcctgatgctctctgatagctgtgccataagtgcttgtgaggtatttgcaaagtgcatgatagtaatgctcggagtttttataattttaaatttcttttaaagcaagtgttttgtacatttcttttcaaaaagtgccaaatttgtcagtattgcatgtaaataattgtgttaattattttactgtagcatagattctatttacaaaatgtttgtttataaagttttatggatttttacagtgaagtgtttacagttgtttaataaagaactgtatgtatattttgtacaggctcctttttgtgaatccttaaaaactcaactctaggaagcaactactgtttattatactaaaaggctgaaaaacctccaggccagactgctaagctctgaaattcctgagaggtctcagaccgggattctacttgttccaagaaagggtaaagcttctaaaccatcttattcttgtctccaagcatgaacacaggagcatgttaagaaaatctttactacttcttccatgcggagaaatctacatattttgaattagaaacaccctcacacccacttgaagatttttttcctgggaacattatgtcccgtagatcagaggtggtgttgtctttttgcttctactggccattgagaaactttgatgataaaaaagaacggtatagatttttcaaacgtatataaaatatttttatgttatatgttatgccataactttaaaataaaaatagtttaaaattcta

SEQ ID NO: 3656 - DNA, 4888 bp, Homo sapiens
gatgaacccttgtcagggggccgtgtctgcgggaggccgaaggatcccgggtgacatgctttctttgggtgcgaggcagcgtctcggcagaaagaatattgcgagtattactgagggtacatgaaggagagaagcccctttggttcggccttggactaagcccttgttctcaggtgaacttgcagtgtgatcttgagtaaggtcagtctcctctctcacctcagtggcccgaaacctcaggaggtggcagaggttttctaatgactctcccagctctgacatcctctgacttcactctgggagaacgtgggctggtggactcctggcagaagccgacacacagttgggccataacaaagagccctggtacggggcacgttcccgcccccgggaggttttggaaacactgtgaggcagggggcggggcttgagcgggccgcagccagtcaccaaagggccgggcgctgggggcggggcctcgcgcgagcggcggcggtagcggcggcagcggctgcggccaagctgggtccgagcatcccgcggctctggagccgcccggcccggacatggcgaccgtccgggcctctctgcgaggtgcgctgctccttctgctggccgtggcgggggtcgcggaggtggcagggggcctggctccgggcagtgcgggtgcattgtgttgtaatcattcaaaggataaccaaatgtgccgtgatgtatgtgaacagattttctcctcaaaaagtgaatcccgactaaaacatctgttgcagcgagccccagattattgcccagagacaatggttgaaatttggaattgtatgaattcatctttgccaggtgtgtttaagaagtctgatggctgggttggcttaggctgctgtgaactggctattgccttggagtgtcgacaggcatgcaagcaggcatcttcaaagaatgatatttccaaagtttgcagaaaagaatatgagaatgctcttttcagttgcattagcagaaatgaaatgggctcggtttgttgcagttatgcaggtcatcacacaaactgccgagaatactgtcaagccatttttcgaacagactcttctcctggtccatctcagataaaagcagtggaaaattattgcgcctctattagtccacaattaatacattgtgtgaacaattatactcaatcttatccaatgaggaacccaacggatagtttatattgctgtgacagagctgaagaccatgcttgccaaaatgcctgcaagagaatcctgatgtccaagaaaacggaaatggagattgttgatggtctcatcgagggttgtaagacccagcccttgcctcaagatcctctttggcaatgttttcttgaaagctcacaatctgttcaccctggagtcactgtacaccctcctccctctacaggcctcgatggggctaaattgcattgttgttctaaagcaaacacttcaacatgtagggaactctgcactaaactttacagcatgagctggggcaatacacagagttggcaagagtttgatcgcttttgtgaatataatccagtggaagtgtccatgttgacctgtttagcggatgtccgggaaccttgccagttgggctgtagaaaccttacttactgtactaattttaacaacaggccaacagaacttttcaggagttgtaatgcacagtcagatcaaggagccatgaatgacatgaagttgtgggagaaaggaagcataaagatgccatttatcaatatacctgttcttgatattaaaaagtgccagccagagatgtggaaagcaatagcttgttcactgcagattaaaccttgtcatagtaaatctcggggaagtattatttgcaaatcagattgtgtggagattcttaaaaaatgtggagaccagaacaaattccctgaagaccacacagctgaaagtatttgtgagcttctgtcacctacagatgatctgaagaattgtatacctttggatacatacctcaggccaagtactttaggtaacattgtagaagaagtgactcatccctgtaacccaaatccttgccctgccaatgagctctgtgaagtaaaccgaaaaggatgtccatctggagatccctgtcttccatacttttgtgttcaaggttgcaaactgggagaagcttctgatttcattgtccgtcaagggacactaatccaggtgccatcatctgcaggggaagttggttgttataaaatctgttcatgtggacaaagtggactcttagaaaactgtatggaaatgcactgtatagacctccagaagtcttgtattgttggaggaaaaagaaaaagtcatggaacatcctttagtattgactgcaatgtctgttcttgttttgctggcaatttggtgtgctctacccgcctttgcctcagtgagcacagttcagaagatgaccgtcgtaccttcacaggtctgccctgtaactgtgcagatcagtttgtccctgtatgtgggcagaatgggcgcacttaccccagtgcctgcattgctcgctgtgtgggcctccaagaccatcagtttgagtttggatcatgcatgtcaaaggatccatgtaatcctaatccctgccaaaaaaaccaaaggtgcatacccaaaccacaggtctgcctgacgacttttgataaatttggatgtagccagtatgagtgtgtaccaagacagctcgcgtgtgaccaggtccaagatcctgtttgtgacacagaccacatggagcacaacaatctctgcactttataccaaagaggaaaaagcctctcttacaaaggtccctgccagcccttttgcagagcaaccgagcccgtatgtgggcacaatggtgagacctacagcagtgtgtgtgctgcctactcggatcgcgtggcagtcgattactatggggactgccaggccgtcggagtcctctcagagcacagctccgtcgccgagtgtgcttctgtcaagtgtccttcgctcttggcagctggatgcaaacccatcatcccaccgggtgcttgttgcccattatgtgctgggatgttaagagttttatttgacaaagaaaaactggatactattgctaaggtaacaaataaaaagccaataacagttctggaaatacttcagaaaatccgcatgcacgtgtctgtcccacagtgtgatgtgtttggatacttcagcattgaatcagaaattgtgatcctgatcattcccgtcgatcactatccaaaagctctgcagattgaagcctgcaataaagaagcagagaagattgagtcccttatcaactctgacagcccgactttggcgtcccatgtccctctctctgccctcatcatttcccaggtacaggtctccagcagtgtgccatcggccggtgtcagggccaggccttcttgccactccctcctccttcccctcagcttgggccttgccttgcacttgctctggacatataactgactgcccacggaaagtgcagaatgctcctccacctcactctcctgccttgaaaaagacattcaggactgctggtttgtagttgaatattggccaaggaaaggcacatgtcacctctattcgccacacagtatttttttttttaatccgccaatattagtaggatttttgttttgtttttacaaatgttaaaatgtgttgttccaaatactaatgaaaacagaatgtctcttcctggtagaccactgccatatgatttacatttcctcaccataagggtcccccactctaaagcaaatttatcgctgggaaatgagatgaccactttttagaaagataattcactgtactatcaggttcacaaacttcatttcagagttctttttgaagtatttaaggttcccgttgcatttgttttgtttacagataattacctactctggctagaagctaggggtcccagtgaagagccactgccattaaagaatatgaaacatagataaaacatctttgaaattatgtaaattatgtaaattatcaggcaaatttgcattaaattacagaaatttaattcagaaccccaactactgtgttatgcaaaagcaagctgattaaatgacactcatataattatatgttgtaagcaacaggctcactggtcacggatttgtgtctgtgacttttgtgaaagggagaagtgacattgcatcaaagcatcttgcattatgcaatttttatattaaccagatatatattcatcggtattcatccaagttaaatgtagagtttttaaacatcaatctttaaaccaattgctgctacttatataattgccaaaaagtgaaataatgtgtagttcatgtaaataatacattatatttctattttattatgaagaaggtgaatagccatatttgtaaaatgacaatcatgtgtgttaacccagtgctttccattcgtgaaaacacatttgctttttgtgatatgcacaatgtagataagtgttctgtctgactttcttttttgatatagaagtataaagaattgtggtttatatatttaaaagtgtcaagctgagtattaaaatgtatgcatgttgtctaagaaattgaatactttgaatgtgtttcacagtttgaaataagctatttgatgtaatacttcttgtgtgtatgcacatgaacttagattttacatgaagtattttttcagtattatatgtaccctctgaaatacatagggatatgcgtattataccaaaatgttgctgaaaaatgggcacttaaagctttcagaatatgtcagtgctgatgtagcatgcttgttgcaattgccttttttctgtataaatgtctttaatgcaatatactggaaagcttttctattttaataaaaataatttttatatg

SEQ ID NO: 3657 - DNA, 2711 bp, Homo sapiens
aaagccgcgcagagagcgtgaaacaaagcagtcggctcggaattggacttgggaggcgcggtgaggagtcaggcttaaaacttgttggaggggagtaaccagcctgctcctctcgctctcctcctcgtctgcgccgcgtttcagagagaaaattcctgttccaagagaaaataaggcaacatcaatgaaggagagaagagccagccagaaattatccagcaaatctatcatggatcctaatcagaacgtgaaatgcaagatagttgtggtgggagacagtcagtgtggaaaaactgcgctgctccatgtcttcgccaaggactgcttccccgagaattacgttcctacagtgtttgagaattacacggccagttttgaaatcgacacacaaagaatagagttgagcctgtgggacacttcgggttctccttactatgacaatgtccgccccctctcttaccctgattcggatgctgtgctgatttgctttgacatcagtagaccagagaccctggacagtgtcctcaaaaagtggaaaggtgaaatccaggaattttgtccaaataccaaaatgctcttggtcggctgcaagtctgatctgcggacagatgttagtacattagtagagctctccaatcacaggcagacgccagtgtcctatgaccagggggcaaatatggccaaacagattggagcagctacttatatcgaatgctcagctttacagtcggaaaatagcgtcagagacatttttcacgttgccaccttggcatgtgtaaataagacaaataaaaacgttaagcggaacaaatcacagagagccacaaagcggatttcacacatgcctagcagaccagaactctcggcagttgctacggacttacgaaaggacaaagcgaagagctgcactgtgatgtgaatctttcattatctttaatgaagacaaaggaatctagtgtaaaaaacaacagcaaacaaaaaggtgaagtctaaatgaagtgcacagccaaagtcatgtataccagaggcttaggaggcgtttgagaggatactcatctttttggaatcctgaccttaggttcggcatgtagaccaagtgatgagaagtgaatacatggaagagtttttaagtgtgacttgaaaaatatgccaaaaaatgagagatacaaatgagctagaggaagatgaggggggatgcgagtacctccaagaagaaaaatcacactctgaatggtgcttgcatttttgggttttttttttttgttataatctattcatggatctccactttgatttaatttttaaatgttttaatctcctttacaaaaagtatacgttaatataccgtcctcaagggggaactggcactgtgaccttagcatttagttttctagaggatgtgatctaatttctttctagctcatcattaaaaaggaaattgtatcaggacccatgggatatatccagaggcaaactttatgaggctttgaaatcttgccttcctgaagatagctgagtaggatggttctaaggaaagcctttgcaatcttgcaagatttgtagaccagcactacaaagatcgcatagatcaaataggaaaaaaaatgtcgatttttattcagtctgatggttctgttcttcattgtgattgtcattaaaaagtggtaaattgctcaatgtaatatttttgtgcgctgtttagaagttgtgtgattttttgccatcgttgataaaaatgcaaagtcaaataaaaggtgtcttggtttgatgtcatagaatgatccaaggagagaaaaaaggtagttactgttttcaccagaaaaggtaatgagtgaaggaaagaatagtagcagaaagcacagtttgtgagtaaagctgtctggaattaagttaccaaaaatacaaagcaaaaggactattattttgggttgaagctccaaaactgacagcatctgataatctgttggtttatttcacttttcattaaatgaacattgatgagagaagatgccacttacccaagctttagagaatccctagtggaagattatatgataaactttcagtcctgacataacactagggcatttctagagtgtcattgctaaaacctcactgaacagatgcagccaaggtctgtgttcagcacttggtctctgttgttacgtaaaataataagcatttaaaatagtttacagatatttttgaccagttccttttagagattctttcagagaagaaaccagatctgacctgtttattgttggcgcttgttgaaaacgagctttctttcccatgatagtgcttcgtttttgaagtgttgaagctgtgctccccttaaatcgtggcaggagagattaaggtaattacaacactcagttctatgtcttacaagcactttgtcttgtctctgcaagaaaattcgattccagtcatttcccataaaatacagacattttaccaacataatatgctttgattgatgcagcattatgctttgggcagtattacaaaatagctggcgagtgctttctgtatttaaatattgtaaaaagaaaataagttataactgttataaagcagaacttttgttgcattttttaaactgttgaagtcactgtgtatgtttgtttggtcaatgtttccgcagtatttattaaaacatactttttttttcttcaaataaaaaagtaaccatgtctttgtctaaa

SEQ ID NO: 3658 - DNA, 2777 bp, Homo sapiens
gcagtcggctcggaattggacttgggaggcgcggtgaggagtcaggcttaaaacttgttggaggggagtaaccagcctgctcctctcgctctcctcctcgtctgcgccgcgtttcagaggttgcccatcagccttgtgatttatttttatatctgctttttataaagagagaaatatatatatatatatatatttttttttttcttcttaagagaaaattcctgttccaagagaaaataaggcaacatcaatgaaggagagaagagccagccagaaattatccagcaaatctatcatggatcctaatcagaacgtgaaatgcaagatagttgtggtgggagacagtcagtgtggaaaaactgcgctgctccatgtcttcgccaaggactgcttccccgagaattacgttcctacagtgtttgagaattacacggccagttttgaaatcgacacacaaagaatagagttgagcctgtgggacacttcgggttctccttactatgacaatgtccgccccctctcttaccctgattcggatgctgtgctgatttgctttgacatcagtagaccagagaccctggacagtgtcctcaaaaagtggaaaggtgaaatccaggaattttgtccaaataccaaaatgctcttggtcggctgcaagtctgatctgcggacagatgttagtacattagtagagctctccaatcacaggcagacgccagtgtcctatgaccagggggcaaatatggccaaacagattggagcagctacttatatcgaatgctcagctttacagtcggaaaatagcgtcagagacatttttcacgttgccaccttggcatgtgtaaataagacaaataaaaacgttaagcggaacaaatcacagagagccacaaagcggatttcacacatgcctagcagaccagaactctcggcagttgctacggacttacgaaaggacaaagcgaagagctgcactgtgatgtgaatctttcattatctttaatgaagacaaaggaatctagtgtaaaaaacaacagcaaacaaaaaggtgaagtctaaatgaagtgcacagccaaagtcatgtataccagaggcttaggaggcgtttgagaggatactcatctttttggaatcctgaccttaggttcggcatgtagaccaagtgatgagaagtgaatacatggaagagtttttaagtgtgacttgaaaaatatgccaaaaaatgagagatacaaatgagctagaggaagatgaggggggatgcgagtacctccaagaagaaaaatcacactctgaatggtgcttgcatttttgggttttttttttttgttataatctattcatggatctccactttgatttaatttttaaatgttttaatctcctttacaaaaagtatacgttaatataccgtcctcaagggggaactggcactgtgaccttagcatttagttttctagaggatgtgatctaatttctttctagctcatcattaaaaaggaaattgtatcaggacccatgggatatatccagaggcaaactttatgaggctttgaaatcttgccttcctgaagatagctgagtaggatggttctaaggaaagcctttgcaatcttgcaagatttgtagaccagcactacaaagatcgcatagatcaaataggaaaaaaaatgtcgatttttattcagtctgatggttctgttcttcattgtgattgtcattaaaaagtggtaaattgctcaatgtaatatttttgtgcgctgtttagaagttgtgtgattttttgccatcgttgataaaaatgcaaagtcaaataaaaggtgtcttggtttgatgtcatagaatgatccaaggagagaaaaaaggtagttactgttttcaccagaaaaggtaatgagtgaaggaaagaatagtagcagaaagcacagtttgtgagtaaagctgtctggaattaagttaccaaaaatacaaagcaaaaggactattattttgggttgaagctccaaaactgacagcatctgataatctgttggtttatttcacttttcattaaatgaacattgatgagagaagatgccacttacccaagctttagagaatccctagtggaagattatatgataaactttcagtcctgacataacactagggcatttctagagtgtcattgctaaaacctcactgaacagatgcagccaaggtctgtgttcagcacttggtctctgttgttacgtaaaataataagcatttaaaatagtttacagatatttttgaccagttccttttagagattctttcagagaagaaaccagatctgacctgtttattgttggcgcttgttgaaaacgagctttctttcccatgatagtgcttcgtttttgaagtgttgaagctgtgctccccttaaatcgtggcaggagagattaaggtaattacaacactcagttctatgtcttacaagcactttgtcttgtctctgcaagaaaattcgattccagtcatttcccataaaatacagacattttaccaacataatatgctttgattgatgcagcattatgctttgggcagtattacaaaatagctggcgagtgctttctgtatttaaatattgtaaaaagaaaataagttataactgttataaagcagaacttttgttgcattttttaaactgttgaagtcactgtgtatgtttgtttggtcaatgtttccgcagtatttattaaaacatactttttttttcttcaaataaaaaagtaaccatgtctttgtctaaa

SEQ ID NO: 3659 - DNA, 2372 bp, Homo sapiens
gcttgaaccgctggagcccccgagggacgcgggggttcagagagcaagaggaaggaaccagactgacagggtcgccagaggcagtcccagcacaaaggttctccttactatgacaatgtccgccccctctcttaccctgattcggatgctgtgctgatttgctttgacatcagtagaccagagaccctggacagtgtcctcaaaaagtggaaaggtgaaatccaggaattttgtccaaataccaaaatgctcttggtcggctgcaagtctgatctgcggacagatgttagtacattagtagagctctccaatcacaggcagacgccagtgtcctatgaccagggggcaaatatggccaaacagattggagcagctacttatatcgaatgctcagctttacagtcggaaaatagcgtcagagacatttttcacgttgccaccttggcatgtgtaaataagacaaataaaaacgttaagcggaacaaatcacagagagccacaaagcggatttcacacatgcctagcagaccagaactctcggcagttgctacggacttacgaaaggacaaagcgaagagctgcactgtgatgtgaatctttcattatctttaatgaagacaaaggaatctagtgtaaaaaacaacagcaaacaaaaaggtgaagtctaaatgaagtgcacagccaaagtcatgtataccagaggcttaggaggcgtttgagaggatactcatctttttggaatcctgaccttaggttcggcatgtagaccaagtgatgagaagtgaatacatggaagagtttttaagtgtgacttgaaaaatatgccaaaaaatgagagatacaaatgagctagaggaagatgaggggggatgcgagtacctccaagaagaaaaatcacactctgaatggtgcttgcatttttgggttttttttttttgttataatctattcatggatctccactttgatttaatttttaaatgttttaatctcctttacaaaaagtatacgttaatataccgtcctcaagggggaactggcactgtgaccttagcatttagttttctagaggatgtgatctaatttctttctagctcatcattaaaaaggaaattgtatcaggacccatgggatatatccagaggcaaactttatgaggctttgaaatcttgccttcctgaagatagctgagtaggatggttctaaggaaagcctttgcaatcttgcaagatttgtagaccagcactacaaagatcgcatagatcaaataggaaaaaaaatgtcgatttttattcagtctgatggttctgttcttcattgtgattgtcattaaaaagtggtaaattgctcaatgtaatatttttgtgcgctgtttagaagttgtgtgattttttgccatcgttgataaaaatgcaaagtcaaataaaaggtgtcttggtttgatgtcatagaatgatccaaggagagaaaaaaggtagttactgttttcaccagaaaaggtaatgagtgaaggaaagaatagtagcagaaagcacagtttgtgagtaaagctgtctggaattaagttaccaaaaatacaaagcaaaaggactattattttgggttgaagctccaaaactgacagcatctgataatctgttggtttatttcacttttcattaaatgaacattgatgagagaagatgccacttacccaagctttagagaatccctagtggaagattatatgataaactttcagtcctgacataacactagggcatttctagagtgtcattgctaaaacctcactgaacagatgcagccaaggtctgtgttcagcacttggtctctgttgttacgtaaaataataagcatttaaaatagtttacagatatttttgaccagttccttttagagattctttcagagaagaaaccagatctgacctgtttattgttggcgcttgttgaaaacgagctttctttcccatgatagtgcttcgtttttgaagtgttgaagctgtgctccccttaaatcgtggcaggagagattaaggtaattacaacactcagttctatgtcttacaagcactttgtcttgtctctgcaagaaaattcgattccagtcatttcccataaaatacagacattttaccaacataatatgctttgattgatgcagcattatgctttgggcagtattacaaaatagctggcgagtgctttctgtatttaaatattgtaaaaagaaaataagttataactgttataaagcagaacttttgttgcattttttaaactgttgaagtcactgtgtatgtttgtttggtcaatgtttccgcagtatttattaaaacatactttttttttcttcaaataaaaaagtaacca

SEQ ID NO: 3660 - DNA, 505 bp, Homo sapiens
aatgctgaaggcaaagcaaaagatggtgattttggataaatgagaaaaaggagagagtaataggaagacaagcaagaatcacaaaaggaagcacgctaggtaatatacgatcctcccagagaaaattcctgttccaagagaaaataaggcaacatcaatgaaggagagaagagccagccagaaattatccagcaaatctatcatggatcctaatcagaacgtgaaatgcaagatagttgtggtgggagacagtcagtgtggaaaaactgcgctgctccatgtcttcgccaaggactgcttccccgagaattacgttcctacagtgtttgagaattacacggccagttttgaaatcgacacacaaagaatagagttgagcctgtgggacacttcgggttctccttactatgacaatgtccgccccctctcttaccctgattcggatgctgtgctgatttgctttgacatcagtagaccagagaccctggacagtgtcctcaaaaag

SEQ ID NO: 3661 - DNA, 481 bp, Homo sapiens
attgagaaagaagaggattggaaggccgggcgtataaagccgcgcagagagcgtgaaacaaagcagtcggctcggaattggacttgggaggcgcgagaaaattcctgttccaagagaaaataaggcaacatcaatgaaggagagaagagccagccagaaattatccagcaaatctatcatggatcctaatcagaacgtgaaatgcaagatagttgtggtgggagacagtcagtgtggaaaaactgcgctgctccatgtcttcgccaaggactgcttccccgagaattacgttcctacagtgtttgagaattacacggccagttttgaaatcgacacacaaagaatagagttgagcctgtgggacacttcgggttctccttactatgacaatgtccgccccctctcttaccctgattcggatgctgtgctgatttgctttgacatcagtagaccagagaccctggacagtgtcctcaaaaag

SEQ ID NO: 3662 - DNA, 1905 bp, Homo sapiens
gagcggaagtctcgtgaccccggaagtgacaggcagggcgggcggggcggccgacgacgttcgtcatttagtgcgggagggatcctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggcagctatgggccccgggccgaggagtacgagttcctgacccccgtggaggaggcacccaagggtatgctggcccggggcagctacagcatcaagtcccgcttcacagacgacgacaagaccgaccacctgtcctgggagtggaatctcaccatcaagaaggactggaaggactgagcccagccagaggcgggcagggcagactgacggacggacgacggacaggcggatgtgtcccccccagcccctcccctccccataccaaagtgctgacaggccctccgtgcccctcccaccctggtccgcctccctggcctggctcaaccgagtgcctccgacccccctcctcagccctcccccacccacaggcccagcctcctcggtctcctgtctcgttgctgcttctgcctgtgctgtgggggagagaggccgcagccaggcctctgctgccctttctgtgccccccaggttctatctccccgtcacacccgaggcctggcttcaggagggagcggagcagccattctccaggccccgtggttgcccctggacgtgtgcgtctgctgctccggggtggagctggggtgtgggatgcacggcctcgtgggggccgggccgtcctccagccccgctgctccctggccagcccccttgtcgctgtcggtcccgtctaaccatgatgccttaacatgtggagtgtaccgtggggcctcactagcctctaactccctgtgtctgcatgagcatgtggcctccccgtcccttccccggtggcgaacccagtgacccagggacacgtggggtgtgctgctgctgctccccagcccaccagtgcctggccagcctgcccccttccctggacagggctgtggagatggctccggcggcttggggaaagccaaattgccaaaactcaagtcacctcagtaccatccaggaggctgggtattgtcctgcctctgccttttctgtctcagcgggcagtgcccagagcccacacccccccaagagccctcgatggacagcctcactcaccccacctgggcccagccaggagccccgcctggccatcagtatttattgcctccgtccgtgccgtccctgggccactggcctggcgcctgttcccccaggctctcagtgccaccacccccggcaggccttccctgacccagccaggaacaaacaagggaccaagtgcacacattgctgagagccgtctcctgtgcctcccccgccccatccccggtcttcgtgttgtgtctgccaggctcaggcagaggcgcctgtccctgcttcttttctgaccgggaaataaatgcccctgaagg

SEQ ID NO: 3663 - DNA, 1482 bp, Homo sapiens
acgttcgtcatttagtgcgggagggatcctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggcagctacagcatcaagtcccgcttcacagacgacgacaagaccgaccacctgtcctgggagtggaatctcaccatcaagaaggactggaaggactgagcccagccagaggcgggcagggcagactgacggacggacgacggacaggcggatgtgtcccccccagcccctcccctccccataccaaagtgctgacaggccctccgtgcccctcccaccctggtccgcctccctggcctggctcaaccgagtgcctccgacccccctcctcagccctcccccacccacaggcccagcctcctcggtctcctgtctcgttgctgcttctgcctgtgctgtgggggagagaggccgcagccaggcctctgctgccctttctgtgccccccaggttctatctccccgtcacacccgaggcctggcttcaggagggagcggagcagccattctccaggccccgtggttgcccctggacgtgtgcgtctgctgctccggggtggagctggggtgtgggatgcacggcctcgtgggggccgggccgtcctccagccccgctgctccctggccagcccccttgtcgctgtcggtcccgtctaaccatgatgccttaacatgtggagtgtaccgtggggcctcactagcctctaactccctgtgtctgcatgagcatgtggcctccccgtcccttccccggtggcgaacccagtgacccagggacacgtggggtgtgctgctgctgctccccagcccaccagtgcctggccagcctgcccccttccctggacagggctgtggagatggctccggcggcttggggaaagccaaattgccaaaactcaagtcacctcagtaccatccaggaggctgggtattgtcctgcctctgccttttctgtctcagcgggcagtgcccagagcccacacccccccaagagccctcgatggacagcctcactcaccccacct

SEQ ID NO: 3664 - DNA, 2075 bp, Homo sapiens
ggcagccgcggtccatcgcgttcgggggcgacgcggggattggggcgcggcctcccccagcgcccgggccacgcccggcacggattgcgggccctgcggaagtgcgggccgcgccctaggatcccggcgcctacggctatcctcgcgcggcgcggaggccccagcccctggaggaagcagggcggcctggaccccggcctgggtgtcccgggtgtgctgctccctgacccacctcccacgctgccgggaaggatctgagcctgacagatcccctgccgggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggcagctatgggccccgggccgaggagtacgagttcctgacccccgtggaggaggcacccaagggtatgctggcccggggcagctacagcatcaagtcccgcttcacagacgacgacaagaccgaccacctgtcctgggagtggaatctcaccatcaagaaggactggaaggactgagcccagccagaggcgggcagggcagactgacggacggacgacggacaggcggatgtgtcccccccagcccctcccctccccataccaaagtgctgacaggccctccgtgcccctcccaccctggtccgcctccctggcctggctcaaccgagtgcctccgacccccctcctcagccctcccccacccacaggcccagcctcctcggtctcctgtctcgttgctgcttctgcctgtgctgtgggggagagaggccgcagccaggcctctgctgccctttctgtgccccccaggttctatctccccgtcacacccgaggcctggcttcaggagggagcggagcagccattctccaggccccgtggttgcccctggacgtgtgcgtctgctgctccggggtggagctggggtgtgggatgcacggcctcgtgggggccgggccgtcctccagccccgctgctccctggccagcccccttgtcgctgtcggtcccgtctaaccatgatgccttaacatgtggagtgtaccgtggggcctcactagcctctaactccctgtgtctgcatgagcatgtggcctccccgtcccttccccggtggcgaacccagtgacccagggacacgtggggtgtgctgctgctgctccccagcccaccagtgcctggccagcctgcccccttccctggacagggctgtggagatggctccggcggcttggggaaagccaaattgccaaaactcaagtcacctcagtaccatccaggaggctgggtattgtcctgcctctgccttttctgtctcagcgggcagtgcccagagcccacacccccccaagagccctcgatggacagcctcactcaccccacctgggcccagccaggagccccgcctggccatcagtatttattgcctccgtccgtgccgtccctgggccactggcctggcgcctgttcccccaggctctcagtgccaccacccccggcaggccttccctgacccagccaggaacaaacaagggaccaagtgcacacattgctgagagccgtctcctgtgcctcccccgccccatccccggtcttcgtgttgtgtctgccaggctcaggcagaggcgcctgtccctgcttcttttctgaccgggaaataaatgcccctgaagg

SEQ ID NO: 3665 - DNA, 6189 bp, Homo sapiens
gaggcgcgtgtccgtgcactagaggcccccgtgcgtgacacaggccgatgagctcctgcgggctgcacccacgcggagtcacagaccgaaaagcccgcggtgtcgagcgcaggcggaggtacatggccccgacgggaggcgcgcggcgagcacccggagctcggctccctgcctgagcacggcagccgcgcctccgcccgcgcgtcctcgcccctccggccggcagcccgcggacatgatcgtgtagcctcctcctgggctgggatttgtttgaagattttcttcatggaagcgatgtccccccagcaggagactctagggggacagccggggcgctcctcttccctgacaggagtgtctcggctcgcgggaggcagctgcaccaagaagaaaatgaaaacactagcagaaaggaggaggagcgctccatctcttatcctggataaagccctacaaaaacggcctactaccagggacagtccttctgctagtgttgacacatgcacatttctgtcatcattagtgtgctccaataggactctgctgattgatggccgggcagaactcaaaagaggcctccagaggcaggagcggcatcttttcctattcaatgatctgtttgttgtggccaaaatcaaatataacaataactttaagataaaaaataaaattaaattaactgatatgtggacagcaagctgtgtggatgaagtgggagaaggcaacaccaatgccatgaaatcctttgttttgggctggcccacagtgaactttgtggccactttcagttctccagaacaaaaggacaaatggctctctctccttcagagatacatcaatctagagaaagaaaaggactacccgaagagcattcccctcaaaatcttcgccaaggacattgggaattgtgcctactctaaaactataacagtaatgaattcagatacagcgaatgaagttatcaacatgtcattaccaatgctagggataactggctctgagagagattaccagttgtgggtcaattctggcaaagaagaggctccatacccactcattgggcatgaatatccatatggaattaaaatgagccatcttcgagactctgcactcctgacaccgggatcaaaggactctaccacccctttcaacctccaggagcccttccttatggaacagctcccccgagagatgcagtgccagttcatcctgaagcccagccgcctggctgcagcccagcaactgagtgattcaggtcataagacatttaaaaggagaagatctatcataaactgggccttctggcgaggttctagcactcacctggacaacttgccctcatcgccaacatcacctatgccaggacagctctttggaatttctctgccaaatatttgtgagaatgacaatctgcccaaacctgtcttggatatgcttttctttcttaatcaaaaaggacctctcaccaaaggtatcttcaggcaatcagccaatgtgaaatcctgcagagaactaaaagagaaattgaattctggagtcgaagtacacctagactgtgaatctatttttgtgatagcatctgtcttaaaggattttctgcgaaatattccaggaagtattttttcatcagatctctatgatcactgggtctctgtaatggatcaaggaaatgatgaagagaaaataaatactgttcaaaggctattagaccagcttccgagagccaatgttgttctcctaaggtatctttttggggtgttacacaacattgagcaacattcctcatccaatcagatgactgcatttaatttagctgtgtgtgtcgctccaagtattctttggcctcctgcttcctccagcccagaactagaaaacgaatttacaaaaaaggtttccctgcttatacaatttctgattgagaattgccttaggatatttggagaagaaatcacttccctcttcagagaggtttcagtgagatgtgacactagagagaatgcctcagatatttcttgctttcaactgaatgactcctcctatgacagcttggaaaatgagctaaatgaggatgttgatgcaccatgcagtgacttggtaaagaaacttggccaggggagcagaagcatggactctgtcttaaccctcagtgactatgatcttgaccagcccgaggtggaaggccttttaaccctaagcgactttgacttggcccattctaaagatgaagatgttcaaatgaaacggcctcttgaatccaagccggtgaacattttagtgtacacaaagatcccactgcgggatcatgccagggccccatctgccatgtgcacacccagctacctgtccacagctgcagcaaatgctgcaaaaagcctgaggcgacaccggcgttgctcagagcccagcatcgactatctggattcaaagctttcctacctcagggagttttatcagaaaaagctacgcaagtccagctgtgatgcaattctttctcaaaaagatgaagactatctgaagcagaatcaacccctccaggaggaaggaaagacatgttttaaacagagtttagtcacaggcactgatgtcagcaagaaaaatgccactactcaaaacactaagaagaaaagcttgtctggtagtgaaggaaatcacgtgaaacttttccctaagtctaagccagtggccatttctgtggcatcttatagtcctatgtcctcacaggatcattccaagaaccagccctttgatgtgaatacatctggatactccccaccacacacagcagatgccctcaagggtccaaggacacatcggcgctgctcagagcccaacatagaagaccagaaccgcaagctgacctatctcaggggaatttattcaaagaaacaacataaaaccagctgtgaagctggtctcttgcatggagaggaggattatctcaaacggcataagtctttgcaaatggaggggcagaagctcattaatcagagtttagtcatggggattgaggtgggcaagagtagtgccacaaaccaaaacactgagaaggttttacccccaagattaaacctttgcccaaggaccagctattccagcttatcctccccaggcacttccccatccggctcatcagtaagctcccaagacagtgctttttctcagatttctgaacactctgtgtttacacccactgagacttcctctccaatagattgcacttttcaggctcagagaaaacgggaagacctttctcctgactttagcaatgccagccatgtttccggaatgcccggtccctcatcagggcaggcttgcagccgcccagcctatacaaagaaggacaccatggagtggcattcacaaatgcattctgtaactcttcatcccagcacatggttgagaaatggtgtggccagtttgaaaaactggtccctcaaaaagaaagcaaaggcagccagaccagaggaagagaaaatagcttctccaaaaggacccttagagccacccccacatgcttctggtgttccagaagccaactcactgcaagaggaacaaaaagacttgcccttaagggcagctgaaggactgtcccctgtgcagtcagcccaaaggtgtagttcttctcccttccaggactcagagagacactgtagctctccattcagcctggtggagagcagacttaagctgtgcatgaagtcacatgaggaaatagagcctggtagtcagagctcttctggttctctgccttgggaaagagcctcagccagctcttggactctagaggatgcgaccagcccagactcagggcctacagtggtctgcgacattgaggacaggtatttaaccaaagacatttaagcatagtaagaatctgatgtccacaagaacaggaactgggttaataataatagacaataattattatgacccctttgtataagatacctgggagaggtagcataaggattatcattgctaatacttaggacaacgaaataattctctttattgagactacttgacaaatactttatgctaaaaattttgtcacctaagtgtttgggaggctttttcttattaaaggttgggattggtcctgtcatgtggttttagagatactaacagagggctagagaaagcatcttctgcagaggaagcacttatgggaacagtctgtgagattgatgtcctgagaagaccaagatatcaggaatgaggaataggggcctgaggagagaggggaagggtacagagaaaccatctacattccatggaatgtttttaataagtaggcaagaaaaatgccactaatcaaagcattaagtgtgtccagtaatgaagaacatcatataaaatctttccctaaatctaagccagtggccatttttgtgggatcttactaatcacgtgtccttacagaatcattccaagaaccagcccattgctacagctagagtggagaaaaacagagtgactcaaaagccatgggtaccatgatatcagttttgttggttgtatttgtcggtttgttttttcattcatgttgaagtgctttgcaaggcttcaggaaacagagttgtgaggagaaagaagaaaatggctgcccatttcagtaccctttcaaaggtatctctgcctaggaacattcttcagaaatgcaacttcttctatttagaaggtgacctcctgacagcgttcactctcaatatggaggaaaagaccacaacaactgtcctttctcaattacacaaatgctgttaaaatgtgatcaaaccatggcatcactttgctgaaatgtttctgcacagtcctgcctcttagattacagtcagccagaaaaacatacttataaatcatcccttttctgatttttgtagtttggcaattgagagagcaatattgaggttggccggttataaggagtcccacaatagaatacccaacaaagtggctgccaggccttctcagacagccatttgctttgggttttgcttccagacgttgttccatatttttgccccaaatgtttcatggcttataccccattggtttattttatatccatggacctttctttctctgctttcttgacttaaaggttgcagcagtacatctcgtcacctaggaatagattatcaggccttgccaactagtatgcagggatggcactaaaaatggatgtgcatcttctttcacattaactactaacctataagaagttgctctgagcccatttatttaaactctttagttcaccatcagatggacctttctctcacaagctagcttattccaaattatttgtcttattaatcaccagaaaatggtcatatcaaatgttctttcttttttgttctaaaggttgcattttcagttataggggaaaaaatattttctctaagatagaagaagttatttcagtattagctataggtgctacctacctcttggggacatggccctgtttgcgctaaccattacaatgatcttttagaactctgtatccaaagagctacttcgtgacactggccatctgagtcacagatgtgaagtcgatttcactttataactaaccagtcctacatattaagacttctaagtgtccatatgcatcttttttggtataatatataaagtcagcagggactcccctttcccttagggcatactactgtcagtcagaactgcaagatgtgaatgaagctcttaacggcttggagtgtctttctggaagaaattgccttttttttttttttcatgttagcaggtaaaaaatcattcacccaatttgaagcatagaagaaaatagttgctgaggttttttaataaccattcctactatctgtgttcccttagatactcctgtaattcttaatgtgaatagtttgttaatattgctgtaaagtattatattgtatgatttgaagacagactatatgtcattttattatactccatcaatctataatatattagactgatgctttatctaaaatgctttgagtttgtataatatatcttgacaaattttactaccatatgttatgtaataaatgtgtatttttgtacttgcagaaactgctgctaacttttaaagttgtttggttttcaaggcactgataatggatatgtatgaagtccatgctgtctgttaaataaaatgccattctgcagaattaaccatcc

SEQ ID NO: 3666 - DNA, 5826 bp, Homo sapiens
atgacattttggattataataaataagaaaatgaaaacactagcagaaaggaggaggagcgctccatctcttatcctggataaagccctacaaaaacggcctactaccagggacagtccttctgctagtgttgacacatgcacatttctgtcatcattagtgtgctccaataggactctgctgattgatggccgggcagaactcaaaagaggcctccagaggcaggagcggcatcttttcctattcaatgatctgtttgttgtggccaaaatcaaatataacaataactttaagataaaaaataaaattaaattaactgatatgtggacagcaagctgtgtggatgaagtgggagaaggcaacaccaatgccatgaaatcctttgttttgggctggcccacagtgaactttgtggccactttcagttctccagaacaaaaggacaaatggctctctctccttcagagatacatcaatctagagaaagaaaaggactacccgaagagcattcccctcaaaatcttcgccaaggacattgggaattgtgcctactctaaaactataacagtaatgaattcagatacagcgaatgaagttatcaacatgtcattaccaatgctagggataactggctctgagagagattaccagttgtgggtcaattctggcaaagaagaggctccatacccactcattgggcatgaatatccatatggaattaaaatgagccatcttcgagactctgcactcctgacaccgggatcaaaggactctaccacccctttcaacctccaggagcccttccttatggaacagctcccccgagagatgcagtgccagttcatcctgaagcccagccgcctggctgcagcccagcaactgagtgattcaggtcataagacatttaaaaggagaagatctatcataaactgggccttctggcgaggttctagcactcacctggacaacttgccctcatcgccaacatcacctatgccaggacagctctttggaatttctctgccaaatatttgtgagaatgacaatctgcccaaacctgtcttggatatgcttttctttcttaatcaaaaaggacctctcaccaaaggtatcttcaggcaatcagccaatgtgaaatcctgcagagaactaaaagagaaattgaattctggagtcgaagtacacctagactgtgaatctatttttgtgatagcatctgtcttaaaggattttctgcgaaatattccaggaagtattttttcatcagatctctatgatcactgggtctctgtaatggatcaaggaaatgatgaagagaaaataaatactgttcaaaggctattagaccagcttccgagagccaatgttgttctcctaaggtatctttttggggtgttacacaacattgagcaacattcctcatccaatcagatgactgcatttaatttagctgtgtgtgtcgctccaagtattctttggcctcctgcttcctccagcccagaactagaaaacgaatttacaaaaaaggtttccctgcttatacaatttctgattgagaattgccttaggatatttggagaagaaatcacttccctcttcagagaggtttcagtgagatgtgacactagagagaatgcctcagatatttcttgctttcaactgaatgactcctcctatgacagcttggaaaatgagctaaatgaggatgttgatgcaccatgcagtgacttggtaaagaaacttggccaggggagcagaagcatggactctgtcttaaccctcagtgactatgatcttgaccagcccgaggtggaaggccttttaaccctaagcgactttgacttggcccattctaaagatgaagatgttcaaatgaaacggcctcttgaatccaagccggtgaacattttagtgtacacaaagatcccactgcgggatcatgccagggccccatctgccatgtgcacacccagctacctgtccacagctgcagcaaatgctgcaaaaagcctgaggcgacaccggcgttgctcagagcccagcatcgactatctggattcaaagctttcctacctcagggagttttatcagaaaaagctacgcaagtccagctgtgatgcaattctttctcaaaaagatgaagactatctgaagcagaatcaacccctccaggaggaaggaaagacatgttttaaacagagtttagtcacaggcactgatgtcagcaagaaaaatgccactactcaaaacactaagaagaaaagcttgtctggtagtgaaggaaatcacgtgaaacttttccctaagtctaagccagtggccatttctgtggcatcttatagtcctatgtcctcacaggatcattccaagaaccagccctttgatgtgaatacatctggatactccccaccacacacagcagatgccctcaagggtccaaggacacatcggcgctgctcagagcccaacatagaagaccagaaccgcaagctgacctatctcaggggaatttattcaaagaaacaacataaaaccagctgtgaagctggtctcttgcatggagaggaggattatctcaaacggcataagtctttgcaaatggaggggcagaagctcattaatcagagtttagtcatggggattgaggtgggcaagagtagtgccacaaaccaaaacactgagaaggttttacccccaagattaaacctttgcccaaggaccagctattccagcttatcctccccaggcacttccccatccggctcatcagtaagctcccaagacagtgctttttctcagatttctgaacactctgtgtttacacccactgagacttcctctccaatagattgcacttttcaggctcagagaaaacgggaagacctttctcctgactttagcaatgccagccatgtttccggaatgcccggtccctcatcagggcaggcttgcagccgcccagcctatacaaagaaggacaccatggagtggcattcacaaatgcattctgtaactcttcatcccagcacatggttgagaaatggtgtggccagtttgaaaaactggtccctcaaaaagaaagcaaaggcagccagaccagaggaagagaaaatagcttctccaaaaggacccttagagccacccccacatgcttctggtgttccagaagccaactcactgcaagaggaacaaaaagacttgcccttaagggcagctgaaggactgtcccctgtgcagtcagcccaaaggtgtagttcttctcccttccaggactcagagagacactgtagctctccattcagcctggtggagagcagacttaagctgtgcatgaagtcacatgaggaaatagagcctggtagtcagagctcttctggttctctgccttgggaaagagcctcagccagctcttggactctagaggatgcgaccagcccagactcagggcctacagtggtctgcgacattgaggacaggtatttaaccaaagacatttaagcatagtaagaatctgatgtccacaagaacaggaactgggttaataataatagacaataattattatgacccctttgtataagatacctgggagaggtagcataaggattatcattgctaatacttaggacaacgaaataattctctttattgagactacttgacaaatactttatgctaaaaattttgtcacctaagtgtttgggaggctttttcttattaaaggttgggattggtcctgtcatgtggttttagagatactaacagagggctagagaaagcatcttctgcagaggaagcacttatgggaacagtctgtgagattgatgtcctgagaagaccaagatatcaggaatgaggaataggggcctgaggagagaggggaagggtacagagaaaccatctacattccatggaatgtttttaataagtaggcaagaaaaatgccactaatcaaagcattaagtgtgtccagtaatgaagaacatcatataaaatctttccctaaatctaagccagtggccatttttgtgggatcttactaatcacgtgtccttacagaatcattccaagaaccagcccattgctacagctagagtggagaaaaacagagtgactcaaaagccatgggtaccatgatatcagttttgttggttgtatttgtcggtttgttttttcattcatgttgaagtgctttgcaaggcttcaggaaacagagttgtgaggagaaagaagaaaatggctgcccatttcagtaccctttcaaaggtatctctgcctaggaacattcttcagaaatgcaacttcttctatttagaaggtgacctcctgacagcgttcactctcaatatggaggaaaagaccacaacaactgtcctttctcaattacacaaatgctgttaaaatgtgatcaaaccatggcatcactttgctgaaatgtttctgcacagtcctgcctcttagattacagtcagccagaaaaacatacttataaatcatcccttttctgatttttgtagtttggcaattgagagagcaatattgaggttggccggttataaggagtcccacaatagaatacccaacaaagtggctgccaggccttctcagacagccatttgctttgggttttgcttccagacgttgttccatatttttgccccaaatgtttcatggcttataccccattggtttattttatatccatggacctttctttctctgctttcttgacttaaaggttgcagcagtacatctcgtcacctaggaatagattatcaggccttgccaactagtatgcagggatggcactaaaaatggatgtgcatcttctttcacattaactactaacctataagaagttgctctgagcccatttatttaaactctttagttcaccatcagatggacctttctctcacaagctagcttattccaaattatttgtcttattaatcaccagaaaatggtcatatcaaatgttctttcttttttgttctaaaggttgcattttcagttataggggaaaaaatattttctctaagatagaagaagttatttcagtattagctataggtgctacctacctcttggggacatggccctgtttgcgctaaccattacaatgatcttttagaactctgtatccaaagagctacttcgtgacactggccatctgagtcacagatgtgaagtcgatttcactttataactaaccagtcctacatattaagacttctaagtgtccatatgcatcttttttggtataatatataaagtcagcagggactcccctttcccttagggcatactactgtcagtcagaactgcaagatgtgaatgaagctcttaacggcttggagtgtctttctggaagaaattgccttttttttttttttcatgttagcaggtaaaaaatcattcacccaatttgaagcatagaagaaaatagttgctgaggttttttaataaccattcctactatctgtgttcccttagatactcctgtaattcttaatgtgaatagtttgttaatattgctgtaaagtattatattgtatgatttgaagacagactatatgtcattttattatactccatcaatctataatatattagactgatgctttatctaaaatgctttgagtttgtataatatatcttgacaaattttactaccatatgttatgtaataaatgtgtatttttgtacttgcagaaactgctgctaacttttaaagttgtttggttttcaaggcactgataatggatatgtatgaagtccatgctgtctgttaaataaaatgccattctgcagaattaaccatcc

SEQ ID NO: 3667 - DNA, 6180 bp, Homo sapiens
acagcagcgcgctaggcggacgccgcgggaatttgacgctcgaggctcgcggcccctaatgagagtcccagaacacttcccgcccttgacggccagcggcagcgccgccgcctcccgcagagcgcccgcttctccgtttctagagccttagtctctcctcgagcgacctcgcagcctccctcccgtctccatccgccgccggttctgcagcccggctcctccctcagtctaggcgcgcgggctgtagtgggcgatcgcctttccccgacccctcgccgtgcccctgggcctcccgaagtggcctgggcgagcactgactgccctttggcggtgtcagccccaaagtcagggccggcgatgtctgcccgggagcggcagccggcgctgaagaagaaaatgaaaacactagcagaaaggaggaggagcgctccatctcttatcctggataaagccctacaaaaacggcctactaccagggacagtccttctgctagtgttgacacatgcacatttctgtcatcattagtgtgctccaataggactctgctgattgatggccgggcagaactcaaaagaggcctccagaggcaggagcggcatcttttcctattcaatgatctgtttgttgtggccaaaatcaaatataacaataactttaagataaaaaataaaattaaattaactgatatgtggacagcaagctgtgtggatgaagtgggagaaggcaacaccaatgccatgaaatcctttgttttgggctggcccacagtgaactttgtggccactttcagttctccagaacaaaaggacaaatggctctctctccttcagagatacatcaatctagagaaagaaaaggactacccgaagagcattcccctcaaaatcttcgccaaggacattgggaattgtgcctactctaaaactataacagtaatgaattcagatacagcgaatgaagttatcaacatgtcattaccaatgctagggataactggctctgagagagattaccagttgtgggtcaattctggcaaagaagaggctccatacccactcattgggcatgaatatccatatggaattaaaatgagccatcttcgagactctgcactcctgacaccgggatcaaaggactctaccacccctttcaacctccaggagcccttccttatggaacagctcccccgagagatgcagtgccagttcatcctgaagcccagccgcctggctgcagcccagcaactgagtgattcaggtcataagacatttaaaaggagaagatctatcataaactgggccttctggcgaggttctagcactcacctggacaacttgccctcatcgccaacatcacctatgccaggacagctctttggaatttctctgccaaatatttgtgagaatgacaatctgcccaaacctgtcttggatatgcttttctttcttaatcaaaaaggacctctcaccaaaggtatcttcaggcaatcagccaatgtgaaatcctgcagagaactaaaagagaaattgaattctggagtcgaagtacacctagactgtgaatctatttttgtgatagcatctgtcttaaaggattttctgcgaaatattccaggaagtattttttcatcagatctctatgatcactgggtctctgtaatggatcaaggaaatgatgaagagaaaataaatactgttcaaaggctattagaccagcttccgagagccaatgttgttctcctaaggtatctttttggggtgttacacaacattgagcaacattcctcatccaatcagatgactgcatttaatttagctgtgtgtgtcgctccaagtattctttggcctcctgcttcctccagcccagaactagaaaacgaatttacaaaaaaggtttccctgcttatacaatttctgattgagaattgccttaggatatttggagaagaaatcacttccctcttcagagaggtttcagtgagatgtgacactagagagaatgcctcagatatttcttgctttcaactgaatgactcctcctatgacagcttggaaaatgagctaaatgaggatgttgatgcaccatgcagtgacttggtaaagaaacttggccaggggagcagaagcatggactctgtcttaaccctcagtgactatgatcttgaccagcccgaggtggaaggccttttaaccctaagcgactttgacttggcccattctaaagatgaagatgttcaaatgaaacggcctcttgaatccaagccggtgaacattttagtgtacacaaagatcccactgcgggatcatgccagggccccatctgccatgtgcacacccagctacctgtccacagctgcagcaaatgctgcaaaaagcctgaggcgacaccggcgttgctcagagcccagcatcgactatctggattcaaagctttcctacctcagggagttttatcagaaaaagctacgcaagtccagctgtgatgcaattctttctcaaaaagatgaagactatctgaagcagaatcaacccctccaggaggaaggaaagacatgttttaaacagagtttagtcacaggcactgatgtcagcaagaaaaatgccactactcaaaacactaagaagaaaagcttgtctggtagtgaaggaaatcacgtgaaacttttccctaagtctaagccagtggccatttctgtggcatcttatagtcctatgtcctcacaggatcattccaagaaccagccctttgatgtgaatacatctggatactccccaccacacacagcagatgccctcaagggtccaaggacacatcggcgctgctcagagcccaacatagaagaccagaaccgcaagctgacctatctcaggggaatttattcaaagaaacaacataaaaccagctgtgaagctggtctcttgcatggagaggaggattatctcaaacggcataagtctttgcaaatggaggggcagaagctcattaatcagagtttagtcatggggattgaggtgggcaagagtagtgccacaaaccaaaacactgagaaggttttacccccaagattaaacctttgcccaaggaccagctattccagcttatcctccccaggcacttccccatccggctcatcagtaagctcccaagacagtgctttttctcagatttctgaacactctgtgtttacacccactgagacttcctctccaatagattgcacttttcaggctcagagaaaacgggaagacctttctcctgactttagcaatgccagccatgtttccggaatgcccggtccctcatcagggcaggcttgcagccgcccagcctatacaaagaaggacaccatggagtggcattcacaaatgcattctgtaactcttcatcccagcacatggttgagaaatggtgtggccagtttgaaaaactggtccctcaaaaagaaagcaaaggcagccagaccagaggaagagaaaatagcttctccaaaaggacccttagagccacccccacatgcttctggtgttccagaagccaactcactgcaagaggaacaaaaagacttgcccttaagggcagctgaaggactgtcccctgtgcagtcagcccaaaggtgtagttcttctcccttccaggactcagagagacactgtagctctccattcagcctggtggagagcagacttaagctgtgcatgaagtcacatgaggaaatagagcctggtagtcagagctcttctggttctctgccttgggaaagagcctcagccagctcttggactctagaggatgcgaccagcccagactcagggcctacagtggtctgcgacattgaggacaggtatttaaccaaagacatttaagcatagtaagaatctgatgtccacaagaacaggaactgggttaataataatagacaataattattatgacccctttgtataagatacctgggagaggtagcataaggattatcattgctaatacttaggacaacgaaataattctctttattgagactacttgacaaatactttatgctaaaaattttgtcacctaagtgtttgggaggctttttcttattaaaggttgggattggtcctgtcatgtggttttagagatactaacagagggctagagaaagcatcttctgcagaggaagcacttatgggaacagtctgtgagattgatgtcctgagaagaccaagatatcaggaatgaggaataggggcctgaggagagaggggaagggtacagagaaaccatctacattccatggaatgtttttaataagtaggcaagaaaaatgccactaatcaaagcattaagtgtgtccagtaatgaagaacatcatataaaatctttccctaaatctaagccagtggccatttttgtgggatcttactaatcacgtgtccttacagaatcattccaagaaccagcccattgctacagctagagtggagaaaaacagagtgactcaaaagccatgggtaccatgatatcagttttgttggttgtatttgtcggtttgttttttcattcatgttgaagtgctttgcaaggcttcaggaaacagagttgtgaggagaaagaagaaaatggctgcccatttcagtaccctttcaaaggtatctctgcctaggaacattcttcagaaatgcaacttcttctatttagaaggtgacctcctgacagcgttcactctcaatatggaggaaaagaccacaacaactgtcctttctcaattacacaaatgctgttaaaatgtgatcaaaccatggcatcactttgctgaaatgtttctgcacagtcctgcctcttagattacagtcagccagaaaaacatacttataaatcatcccttttctgatttttgtagtttggcaattgagagagcaatattgaggttggccggttataaggagtcccacaatagaatacccaacaaagtggctgccaggccttctcagacagccatttgctttgggttttgcttccagacgttgttccatatttttgccccaaatgtttcatggcttataccccattggtttattttatatccatggacctttctttctctgctttcttgacttaaaggttgcagcagtacatctcgtcacctaggaatagattatcaggccttgccaactagtatgcagggatggcactaaaaatggatgtgcatcttctttcacattaactactaacctataagaagttgctctgagcccatttatttaaactctttagttcaccatcagatggacctttctctcacaagctagcttattccaaattatttgtcttattaatcaccagaaaatggtcatatcaaatgttctttcttttttgttctaaaggttgcattttcagttataggggaaaaaatattttctctaagatagaagaagttatttcagtattagctataggtgctacctacctcttggggacatggccctgtttgcgctaaccattacaatgatcttttagaactctgtatccaaagagctacttcgtgacactggccatctgagtcacagatgtgaagtcgatttcactttataactaaccagtcctacatattaagacttctaagtgtccatatgcatcttttttggtataatatataaagtcagcagggactcccctttcccttagggcatactactgtcagtcagaactgcaagatgtgaatgaagctcttaacggcttggagtgtctttctggaagaaattgccttttttttttttttcatgttagcaggtaaaaaatcattcacccaatttgaagcatagaagaaaatagttgctgaggttttttaataaccattcctactatctgtgttcccttagatactcctgtaattcttaatgtgaatagtttgttaatattgctgtaaagtattatattgtatgatttgaagacagactatatgtcattttattatactccatcaatctataatatattagactgatgctttatctaaaatgctttgagtttgtataatatatcttgacaaattttactaccatatgttatgtaataaatgtgtatttttgtacttgcagaaactgctgctaacttttaaagttgtttggttttcaaggcactgataatggatatgtatgaagtccatgctgtctgttaaataaaatgccattctgcag

SEQ ID NO: 3668 - DNA, 5998 bp, Homo sapiens
gtagccttctcaatagcttagccaaatttcggcgtcctcgctctgtctgcattttccttcattgctctttcacgtttggaatgcccccgtctctgcagcctgcagacagcggaaaccgcgggtgcaaatgtgcaggggccgctgacatgaccggctgcagaagcccactcagggttacccgaacaggctagcgttcgggattgcacaagagaaaatgaaaacactagcagaaaggaggaggagcgctccatctcttatcctggataaagccctacaaaaacggcctactaccagggacagtccttctgctagtgttgacacatgcacatttctgtcatcattagtgtgctccaataggactctgctgattgatggccgggcagaactcaaaagaggcctccagaggcaggagcggcatcttttcctattcaatgatctgtttgttgtggccaaaatcaaatataacaataactttaagataaaaaataaaattaaattaactgatatgtggacagcaagctgtgtggatgaagtgggagaaggcaacaccaatgccatgaaatcctttgttttgggctggcccacagtgaactttgtggccactttcagttctccagaacaaaaggacaaatggctctctctccttcagagatacatcaatctagagaaagaaaaggactacccgaagagcattcccctcaaaatcttcgccaaggacattgggaattgtgcctactctaaaactataacagtaatgaattcagatacagcgaatgaagttatcaacatgtcattaccaatgctagggataactggctctgagagagattaccagttgtgggtcaattctggcaaagaagaggctccatacccactcattgggcatgaatatccatatggaattaaaatgagccatcttcgagactctgcactcctgacaccgggatcaaaggactctaccacccctttcaacctccaggagcccttccttatggaacagctcccccgagagatgcagtgccagttcatcctgaagcccagccgcctggctgcagcccagcaactgagtgattcaggtcataagacatttaaaaggagaagatctatcataaactgggccttctggcgaggttctagcactcacctggacaacttgccctcatcgccaacatcacctatgccaggacagctctttggaatttctctgccaaatatttgtgagaatgacaatctgcccaaacctgtcttggatatgcttttctttcttaatcaaaaaggacctctcaccaaaggtatcttcaggcaatcagccaatgtgaaatcctgcagagaactaaaagagaaattgaattctggagtcgaagtacacctagactgtgaatctatttttgtgatagcatctgtcttaaaggattttctgcgaaatattccaggaagtattttttcatcagatctctatgatcactgggtctctgtaatggatcaaggaaatgatgaagagaaaataaatactgttcaaaggctattagaccagcttccgagagccaatgttgttctcctaaggtatctttttggggtgttacacaacattgagcaacattcctcatccaatcagatgactgcatttaatttagctgtgtgtgtcgctccaagtattctttggcctcctgcttcctccagcccagaactagaaaacgaatttacaaaaaaggtttccctgcttatacaatttctgattgagaattgccttaggatatttggagaagaaatcacttccctcttcagagaggtttcagtgagatgtgacactagagagaatgcctcagatatttcttgctttcaactgaatgactcctcctatgacagcttggaaaatgagctaaatgaggatgttgatgcaccatgcagtgacttggtaaagaaacttggccaggggagcagaagcatggactctgtcttaaccctcagtgactatgatcttgaccagcccgaggtggaaggccttttaaccctaagcgactttgacttggcccattctaaagatgaagatgttcaaatgaaacggcctcttgaatccaagccggtgaacattttagtgtacacaaagatcccactgcgggatcatgccagggccccatctgccatgtgcacacccagctacctgtccacagctgcagcaaatgctgcaaaaagcctgaggcgacaccggcgttgctcagagcccagcatcgactatctggattcaaagctttcctacctcagggagttttatcagaaaaagctacgcaagtccagctgtgatgcaattctttctcaaaaagatgaagactatctgaagcagaatcaacccctccaggaggaaggaaagacatgttttaaacagagtttagtcacaggcactgatgtcagcaagaaaaatgccactactcaaaacactaagaagaaaagcttgtctggtagtgaaggaaatcacgtgaaacttttccctaagtctaagccagtggccatttctgtggcatcttatagtcctatgtcctcacaggatcattccaagaaccagccctttgatgtgaatacatctggatactccccaccacacacagcagatgccctcaagggtccaaggacacatcggcgctgctcagagcccaacatagaagaccagaaccgcaagctgacctatctcaggggaatttattcaaagaaacaacataaaaccagctgtgaagctggtctcttgcatggagaggaggattatctcaaacggcataagtctttgcaaatggaggggcagaagctcattaatcagagtttagtcatggggattgaggtgggcaagagtagtgccacaaaccaaaacactgagaaggttttacccccaagattaaacctttgcccaaggaccagctattccagcttatcctccccaggcacttccccatccggctcatcagtaagctcccaagacagtgctttttctcagatttctgaacactctgtgtttacacccactgagacttcctctccaatagattgcacttttcaggctcagagaaaacgggaagacctttctcctgactttagcaatgccagccatgtttccggaatgcccggtccctcatcagggcaggcttgcagccgcccagcctatacaaagaaggacaccatggagtggcattcacaaatgcattctgtaactcttcatcccagcacatggttgagaaatggtgtggccagtttgaaaaactggtccctcaaaaagaaagcaaaggcagccagaccagaggaagagaaaatagcttctccaaaaggacccttagagccacccccacatgcttctggtgttccagaagccaactcactgcaagaggaacaaaaagacttgcccttaagggcagctgaaggactgtcccctgtgcagtcagcccaaaggtgtagttcttctcccttccaggactcagagagacactgtagctctccattcagcctggtggagagcagacttaagctgtgcatgaagtcacatgaggaaatagagcctggtagtcagagctcttctggttctctgccttgggaaagagcctcagccagctcttggactctagaggatgcgaccagcccagactcagggcctacagtggtctgcgacattgaggacaggtatttaaccaaagacatttaagcatagtaagaatctgatgtccacaagaacaggaactgggttaataataatagacaataattattatgacccctttgtataagatacctgggagaggtagcataaggattatcattgctaatacttaggacaacgaaataattctctttattgagactacttgacaaatactttatgctaaaaattttgtcacctaagtgtttgggaggctttttcttattaaaggttgggattggtcctgtcatgtggttttagagatactaacagagggctagagaaagcatcttctgcagaggaagcacttatgggaacagtctgtgagattgatgtcctgagaagaccaagatatcaggaatgaggaataggggcctgaggagagaggggaagggtacagagaaaccatctacattccatggaatgtttttaataagtaggcaagaaaaatgccactaatcaaagcattaagtgtgtccagtaatgaagaacatcatataaaatctttccctaaatctaagccagtggccatttttgtgggatcttactaatcacgtgtccttacagaatcattccaagaaccagcccattgctacagctagagtggagaaaaacagagtgactcaaaagccatgggtaccatgatatcagttttgttggttgtatttgtcggtttgttttttcattcatgttgaagtgctttgcaaggcttcaggaaacagagttgtgaggagaaagaagaaaatggctgcccatttcagtaccctttcaaaggtatctctgcctaggaacattcttcagaaatgcaacttcttctatttagaaggtgacctcctgacagcgttcactctcaatatggaggaaaagaccacaacaactgtcctttctcaattacacaaatgctgttaaaatgtgatcaaaccatggcatcactttgctgaaatgtttctgcacagtcctgcctcttagattacagtcagccagaaaaacatacttataaatcatcccttttctgatttttgtagtttggcaattgagagagcaatattgaggttggccggttataaggagtcccacaatagaatacccaacaaagtggctgccaggccttctcagacagccatttgctttgggttttgcttccagacgttgttccatatttttgccccaaatgtttcatggcttataccccattggtttattttatatccatggacctttctttctctgctttcttgacttaaaggttgcagcagtacatctcgtcacctaggaatagattatcaggccttgccaactagtatgcagggatggcactaaaaatggatgtgcatcttctttcacattaactactaacctataagaagttgctctgagcccatttatttaaactctttagttcaccatcagatggacctttctctcacaagctagcttattccaaattatttgtcttattaatcaccagaaaatggtcatatcaaatgttctttcttttttgttctaaaggttgcattttcagttataggggaaaaaatattttctctaagatagaagaagttatttcagtattagctataggtgctacctacctcttggggacatggccctgtttgcgctaaccattacaatgatcttttagaactctgtatccaaagagctacttcgtgacactggccatctgagtcacagatgtgaagtcgatttcactttataactaaccagtcctacatattaagacttctaagtgtccatatgcatcttttttggtataatatataaagtcagcagggactcccctttcccttagggcatactactgtcagtcagaactgcaagatgtgaatgaagctcttaacggcttggagtgtctttctggaagaaattgccttttttttttttttcatgttagcaggtaaaaaatcattcacccaatttgaagcatagaagaaaatagttgctgaggttttttaataaccattcctactatctgtgttcccttagatactcctgtaattcttaatgtgaatagtttgttaatattgctgtaaagtattatattgtatgatttgaagacagactatatgtcattttattatactccatcaatctataatatattagactgatgctttatctaaaatgctttgagtttgtataatatatcttgacaaattttactaccatatgttatgtaataaatgtgtatttttgtacttgcagaaactgctgctaacttttaaagttgtttggttttcaaggcactgataatggatatgtatgaagtccatgctgtctgttaaataaaatgccattctgcag

SEQ ID NO: 3669 - DNA, 5880 bp, Homo sapiens
gaggcgcgtgtccgtgcactagaggcccccgtgcgtgacacaggccgatgagctcctgcgggctgcacccacgcggagtcacagaccgaaaagaaaatgaaaacactagcagaaaggaggaggagcgctccatctcttatcctggataaagccctacaaaaacggcctactaccagggacagtccttctgctagtgttgacacatgcacatttctgtcatcattagtgtgctccaataggactctgctgattgatggccgggcagaactcaaaagaggcctccagaggcaggagcggcatcttttcctattcaatgatctgtttgttgtggccaaaatcaaatataacaataactttaagataaaaaataaaattaaattaactgatatgtggacagcaagctgtgtggatgaagtgggagaaggcaacaccaatgccatgaaatcctttgttttgggctggcccacagtgaactttgtggccactttcagttctccagaacaaaaggacaaatggctctctctccttcagagatacatcaatctagagaaagaaaaggactacccgaagagcattcccctcaaaatcttcgccaaggacattgggaattgtgcctactctaaaactataacagtaatgaattcagatacagcgaatgaagttatcaacatgtcattaccaatgctagggataactggctctgagagagattaccagttgtgggtcaattctggcaaagaagaggctccatacccactcattgggcatgaatatccatatggaattaaaatgagccatcttcgagactctgcactcctgacaccgggatcaaaggactctaccacccctttcaacctccaggagcccttccttatggaacagctcccccgagagatgcagtgccagttcatcctgaagcccagccgcctggctgcagcccagcaactgagtgattcaggtcataagacatttaaaaggagaagatctatcataaactgggccttctggcgaggttctagcactcacctggacaacttgccctcatcgccaacatcacctatgccaggacagctctttggaatttctctgccaaatatttgtgagaatgacaatctgcccaaacctgtcttggatatgcttttctttcttaatcaaaaaggacctctcaccaaaggtatcttcaggcaatcagccaatgtgaaatcctgcagagaactaaaagagaaattgaattctggagtcgaagtacacctagactgtgaatctatttttgtgatagcatctgtcttaaaggattttctgcgaaatattccaggaagtattttttcatcagatctctatgatcactgggtctctgtaatggatcaaggaaatgatgaagagaaaataaatactgttcaaaggctattagaccagcttccgagagccaatgttgttctcctaaggtatctttttggggtgttacacaacattgagcaacattcctcatccaatcagatgactgcatttaatttagctgtgtgtgtcgctccaagtattctttggcctcctgcttcctccagcccagaactagaaaacgaatttacaaaaaaggtttccctgcttatacaatttctgattgagaattgccttaggatatttggagaagaaatcacttccctcttcagagaggtttcagtgagatgtgacactagagagaatgcctcagatatttcttgctttcaactgaatgactcctcctatgacagcttggaaaatgagctaaatgaggatgttgatgcaccatgcagtgacttggtaaagaaacttggccaggggagcagaagcatggactctgtcttaaccctcagtgactatgatcttgaccagcccgaggtggaaggccttttaaccctaagcgactttgacttggcccattctaaagatgaagatgttcaaatgaaacggcctcttgaatccaagccggtgaacattttagtgtacacaaagatcccactgcgggatcatgccagggccccatctgccatgtgcacacccagctacctgtccacagctgcagcaaatgctgcaaaaagcctgaggcgacaccggcgttgctcagagcccagcatcgactatctggattcaaagctttcctacctcagggagttttatcagaaaaagctacgcaagtccagctgtgatgcaattctttctcaaaaagatgaagactatctgaagcagaatcaacccctccaggaggaaggaaagacatgttttaaacagagtttagtcacaggcactgatgtcagcaagaaaaatgccactactcaaaacactaagaagaaaagcttgtctggtagtgaaggaaatcacgtgaaacttttccctaagtctaagccagtggccatttctgtggcatcttatagtcctatgtcctcacaggatcattccaagaaccagccctttgatgtgaatacatctggatactccccaccacacacagcagatgccctcaagggtccaaggacacatcggcgctgctcagagcccaacatagaagaccagaaccgcaagctgacctatctcaggggaatttattcaaagaaacaacataaaaccagctgtgaagctggtctcttgcatggagaggaggattatctcaaacggcataagtctttgcaaatggaggggcagaagctcattaatcagagtttagtcatggggattgaggtgggcaagagtagtgccacaaaccaaaacactgagaaggttttacccccaagattaaacctttgcccaaggaccagctattccagcttatcctccccaggcacttccccatccggctcatcagtaagctcccaagacagtgctttttctcagatttctgaacactctgtgtttacacccactgagacttcctctccaatagattgcacttttcaggctcagagaaaacgggaagacctttctcctgactttagcaatgccagccatgtttccggaatgcccggtccctcatcagggcaggcttgcagccgcccagcctatacaaagaaggacaccatggagtggcattcacaaatgcattctgtaactcttcatcccagcacatggttgagaaatggtgtggccagtttgaaaaactggtccctcaaaaagaaagcaaaggcagccagaccagaggaagagaaaatagcttctccaaaaggacccttagagccacccccacatgcttctggtgttccagaagccaactcactgcaagaggaacaaaaagacttgcccttaagggcagctgaaggactgtcccctgtgcagtcagcccaaaggtgtagttcttctcccttccaggactcagagagacactgtagctctccattcagcctggtggagagcagacttaagctgtgcatgaagtcacatgaggaaatagagcctggtagtcagagctcttctggttctctgccttgggaaagagcctcagccagctcttggactctagaggatgcgaccagcccagactcagggcctacagtggtctgcgacattgaggacaggtatttaaccaaagacatttaagcatagtaagaatctgatgtccacaagaacaggaactgggttaataataatagacaataattattatgacccctttgtataagatacctgggagaggtagcataaggattatcattgctaatacttaggacaacgaaataattctctttattgagactacttgacaaatactttatgctaaaaattttgtcacctaagtgtttgggaggctttttcttattaaaggttgggattggtcctgtcatgtggttttagagatactaacagagggctagagaaagcatcttctgcagaggaagcacttatgggaacagtctgtgagattgatgtcctgagaagaccaagatatcaggaatgaggaataggggcctgaggagagaggggaagggtacagagaaaccatctacattccatggaatgtttttaataagtaggcaagaaaaatgccactaatcaaagcattaagtgtgtccagtaatgaagaacatcatataaaatctttccctaaatctaagccagtggccatttttgtgggatcttactaatcacgtgtccttacagaatcattccaagaaccagcccattgctacagctagagtggagaaaaacagagtgactcaaaagccatgggtaccatgatatcagttttgttggttgtatttgtcggtttgttttttcattcatgttgaagtgctttgcaaggcttcaggaaacagagttgtgaggagaaagaagaaaatggctgcccatttcagtaccctttcaaaggtatctctgcctaggaacattcttcagaaatgcaacttcttctatttagaaggtgacctcctgacagcgttcactctcaatatggaggaaaagaccacaacaactgtcctttctcaattacacaaatgctgttaaaatgtgatcaaaccatggcatcactttgctgaaatgtttctgcacagtcctgcctcttagattacagtcagccagaaaaacatacttataaatcatcccttttctgatttttgtagtttggcaattgagagagcaatattgaggttggccggttataaggagtcccacaatagaatacccaacaaagtggctgccaggccttctcagacagccatttgctttgggttttgcttccagacgttgttccatatttttgccccaaatgtttcatggcttataccccattggtttattttatatccatggacctttctttctctgctttcttgacttaaaggttgcagcagtacatctcgtcacctaggaatagattatcaggccttgccaactagtatgcagggatggcactaaaaatggatgtgcatcttctttcacattaactactaacctataagaagttgctctgagcccatttatttaaactctttagttcaccatcagatggacctttctctcacaagctagcttattccaaattatttgtcttattaatcaccagaaaatggtcatatcaaatgttctttcttttttgttctaaaggttgcattttcagttataggggaaaaaatattttctctaagatagaagaagttatttcagtattagctataggtgctacctacctcttggggacatggccctgtttgcgctaaccattacaatgatcttttagaactctgtatccaaagagctacttcgtgacactggccatctgagtcacagatgtgaagtcgatttcactttataactaaccagtcctacatattaagacttctaagtgtccatatgcatcttttttggtataatatataaagtcagcagggactcccctttcccttagggcatactactgtcagtcagaactgcaagatgtgaatgaagctcttaacggcttggagtgtctttctggaagaaattgccttttttttttttttcatgttagcaggtaaaaaatcattcacccaatttgaagcatagaagaaaatagttgctgaggttttttaataaccattcctactatctgtgttcccttagatactcctgtaattcttaatgtgaatagtttgttaatattgctgtaaagtattatattgtatgatttgaagacagactatatgtcattttattatactccatcaatctataatatattagactgatgctttatctaaaatgctttgagtttgtataatatatcttgacaaattttactaccatatgttatgtaataaatgtgtatttttgtacttgcagaaactgctgctaacttttaaagttgtttggttttcaaggcactgataatggatatgtatgaagtccatgctgtctgttaaataaaatgccattctgcag

SEQ ID NO: 3670 - DNA, 2623 bp, Homo sapiens
gttttctgcccccacattcttggaaatgctctacatttttggaaacacctacagtcaaaatgagctttaagcagagcttttgaccttagcagtatcttctgcagacctgtgtcaggctctcacctcccaaaggattggaatgcaccagagctaggggtcgagacaaggccccagcctgtatctcaggctgaaacgtgaaaaccaagttaaggaaaatatggtgaagaagattcttgcatacccctactccagctgagtgcccaggattttctgcgaaatattccaggaagtattttttcatcagatctctatgatcactgggtctctgtaatggatcaaggaaatgatgaagagaaaataaatactgttcaaaggctattagaccagcttccgagagccaatgttgttctcctaaggtatctttttggggtgttacacaacattgagcaacattcctcatccaatcagatgactgcatttaatttagctgtgtgtgtcgctccaagtattctttggcctcctgcttcctccagcccagaactagaaaacgaatttacaaaaaaggtttccctgcttatacaatttctgattgagaattgccttaggatatttggagaagaaatcacttccctcttcagagaggtttcagtgagatgtgacactagagagaatgcctcagatatttcttgctttcaactgaatgactcctcctatgacagcttggaaaatgagctaaatgaggatgttgatgcaccatgcagtgacttggtaaagaaacttggccaggggagcagaagcatggactctgtcttaaccctcagtgactatgatcttgaccagcccgaggtggaaggccttttaaccctaagcgactttgacttggcccattctaaagatgaagatgttcaaatgaaacggcctcttgaatccaagccggtgaacattttagtgtacacaaagatcccactgcgggatcatgccagggccccatctgccatgtgcacacccagctacctgtccacagctgcagcaaatgctgcaaaaagcctgaggcgacaccggcgttgctcagagcccagcatcgactatctggattcaaagctttcctacctcagggagttttatcagaaaaagctacgcaagtccagctgtgatgcaattctttctcaaaaagatgaagactatctgaagcagaatcaacccctccaggaggaaggaaagacatgttttaaacagagtttagtcacaggcactgatgtcagcaagaaaaatgccactactcaaaacactaagaagaaaagcttgtctggtagtgaaggaaatcacgtgaaacttttccctaagtctaagccagtggccatttctgtggcatcttatagtcctatgtcctcacaggatcattccaagaaccagccctttgatgtgaatacatctggatactccccaccacacacagcagatgccctcaagggtccaaggacacatcggcgctgctcagagcccaacatagaagaccagaaccgcaagctgacctatctcaggggaatttattcaaagaaacaacataaaaccagctgtgaagctggtctcttgcatggagaggaggattatctcaaacggcataagtctttgcaaatggaggggcagaagctcattaatcagagtttagtcatggggattgaggtgggcaagagtagtgccacaaaccaaaacactgagaaggttttacccccaagattaaacctttgcccaaggaccagctattccagcttatcctccccaggcacttccccatccggctcatcagtaagctcccaagacagtgctttttctcagatttctgaacactctgtgtttacacccactgagacttcctctccaatagattgcacttttcaggctcagagaaaacgggaagacctttctcctgactttagcaatgccagccatgtttccggaatgcccggtccctcatcagggcaggcttgcagccgcccagcctatacaaagaaggacaccatggagtggcattcacaaatgcattctgtaactcttcatcccagcacatggttgagaaatggtgtggccagtttgaaaaactggtccctcaaaaagaaagcaaaggcagccagaccagaggaagagaaaatagcttctccaaaaggacccttagagccacccccacatgcttctggtgttccagaagccaactcactgcaagaggaacaaaaagacttgcccttaagggcagctgaaggactgtcccctgtgcagtcagcccaaaggtgtagttcttctcccttccaggactcagagagacactgtagctctccattcagcctggtggagagcagacttaagctgtgcatgaagtcacatgaggaaatagagcctggtagtcagagctcttctggttctctgccttgggaaagagcctcagccagctcttggactctagaggatgcgaccagcccagactcagggcctacagtggtctgcgacattgaggacagaaactgctgctaacttttaaagttgtttggttttcaaggcactgataatggatatgtatgaagtccatgctgtctgttaaataaaatgccattctgcagaattaaccatc

SEQ ID NO: 3671 - DNA, 6066 bp, Homo sapiens
gtagccttctcaatagcttagccaaatttcggcgtcctcgctctgtctgcattttccttcattgctctttcacgtttggaatgcccccgtctctgcagcctgcagacagcggaaaccgcgggtgcaaatgtgcaggggccgctgacatgaccggctgcagaagcccactcagggttacccgaacaggctagcgttcgggattgcacaagagccaaatttgcctgtgaaataaagatagtagtatctacccggatgacattttggattataataaataagaaaatgaaaacactagcagaaaggaggaggagcgctccatctcttatcctggataaagccctacaaaaacggcctactaccagggacagtccttctgctagtgttgacacatgcacatttctgtcatcattagtgtgctccaataggactctgctgattgatggccgggcagaactcaaaagaggcctccagaggcaggagcggcatcttttcctattcaatgatctgtttgttgtggccaaaatcaaatataacaataactttaagataaaaaataaaattaaattaactgatatgtggacagcaagctgtgtggatgaagtgggagaaggcaacaccaatgccatgaaatcctttgttttgggctggcccacagtgaactttgtggccactttcagttctccagaacaaaaggacaaatggctctctctccttcagagatacatcaatctagagaaagaaaaggactacccgaagagcattcccctcaaaatcttcgccaaggacattgggaattgtgcctactctaaaactataacagtaatgaattcagatacagcgaatgaagttatcaacatgtcattaccaatgctagggataactggctctgagagagattaccagttgtgggtcaattctggcaaagaagaggctccatacccactcattgggcatgaatatccatatggaattaaaatgagccatcttcgagactctgcactcctgacaccgggatcaaaggactctaccacccctttcaacctccaggagcccttccttatggaacagctcccccgagagatgcagtgccagttcatcctgaagcccagccgcctggctgcagcccagcaactgagtgattcaggtcataagacatttaaaaggagaagatctatcataaactgggccttctggcgaggttctagcactcacctggacaacttgccctcatcgccaacatcacctatgccaggacagctctttggaatttctctgccaaatatttgtgagaatgacaatctgcccaaacctgtcttggatatgcttttctttcttaatcaaaaaggacctctcaccaaaggtatcttcaggcaatcagccaatgtgaaatcctgcagagaactaaaagagaaattgaattctggagtcgaagtacacctagactgtgaatctatttttgtgatagcatctgtcttaaaggattttctgcgaaatattccaggaagtattttttcatcagatctctatgatcactgggtctctgtaatggatcaaggaaatgatgaagagaaaataaatactgttcaaaggctattagaccagcttccgagagccaatgttgttctcctaaggtatctttttggggtgttacacaacattgagcaacattcctcatccaatcagatgactgcatttaatttagctgtgtgtgtcgctccaagtattctttggcctcctgcttcctccagcccagaactagaaaacgaatttacaaaaaaggtttccctgcttatacaatttctgattgagaattgccttaggatatttggagaagaaatcacttccctcttcagagaggtttcagtgagatgtgacactagagagaatgcctcagatatttcttgctttcaactgaatgactcctcctatgacagcttggaaaatgagctaaatgaggatgttgatgcaccatgcagtgacttggtaaagaaacttggccaggggagcagaagcatggactctgtcttaaccctcagtgactatgatcttgaccagcccgaggtggaaggccttttaaccctaagcgactttgacttggcccattctaaagatgaagatgttcaaatgaaacggcctcttgaatccaagccggtgaacattttagtgtacacaaagatcccactgcgggatcatgccagggccccatctgccatgtgcacacccagctacctgtccacagctgcagcaaatgctgcaaaaagcctgaggcgacaccggcgttgctcagagcccagcatcgactatctggattcaaagctttcctacctcagggagttttatcagaaaaagctacgcaagtccagctgtgatgcaattctttctcaaaaagatgaagactatctgaagcagaatcaacccctccaggaggaaggaaagacatgttttaaacagagtttagtcacaggcactgatgtcagcaagaaaaatgccactactcaaaacactaagaagaaaagcttgtctggtagtgaaggaaatcacgtgaaacttttccctaagtctaagccagtggccatttctgtggcatcttatagtcctatgtcctcacaggatcattccaagaaccagccctttgatgtgaatacatctggatactccccaccacacacagcagatgccctcaagggtccaaggacacatcggcgctgctcagagcccaacatagaagaccagaaccgcaagctgacctatctcaggggaatttattcaaagaaacaacataaaaccagctgtgaagctggtctcttgcatggagaggaggattatctcaaacggcataagtctttgcaaatggaggggcagaagctcattaatcagagtttagtcatggggattgaggtgggcaagagtagtgccacaaaccaaaacactgagaaggttttacccccaagattaaacctttgcccaaggaccagctattccagcttatcctccccaggcacttccccatccggctcatcagtaagctcccaagacagtgctttttctcagatttctgaacactctgtgtttacacccactgagacttcctctccaatagattgcacttttcaggctcagagaaaacgggaagacctttctcctgactttagcaatgccagccatgtttccggaatgcccggtccctcatcagggcaggcttgcagccgcccagcctatacaaagaaggacaccatggagtggcattcacaaatgcattctgtaactcttcatcccagcacatggttgagaaatggtgtggccagtttgaaaaactggtccctcaaaaagaaagcaaaggcagccagaccagaggaagagaaaatagcttctccaaaaggacccttagagccacccccacatgcttctggtgttccagaagccaactcactgcaagaggaacaaaaagacttgcccttaagggcagctgaaggactgtcccctgtgcagtcagcccaaaggtgtagttcttctcccttccaggactcagagagacactgtagctctccattcagcctggtggagagcagacttaagctgtgcatgaagtcacatgaggaaatagagcctggtagtcagagctcttctggttctctgccttgggaaagagcctcagccagctcttggactctagaggatgcgaccagcccagactcagggcctacagtggtctgcgacattgaggacaggtatttaaccaaagacatttaagcatagtaagaatctgatgtccacaagaacaggaactgggttaataataatagacaataattattatgacccctttgtataagatacctgggagaggtagcataaggattatcattgctaatacttaggacaacgaaataattctctttattgagactacttgacaaatactttatgctaaaaattttgtcacctaagtgtttgggaggctttttcttattaaaggttgggattggtcctgtcatgtggttttagagatactaacagagggctagagaaagcatcttctgcagaggaagcacttatgggaacagtctgtgagattgatgtcctgagaagaccaagatatcaggaatgaggaataggggcctgaggagagaggggaagggtacagagaaaccatctacattccatggaatgtttttaataagtaggcaagaaaaatgccactaatcaaagcattaagtgtgtccagtaatgaagaacatcatataaaatctttccctaaatctaagccagtggccatttttgtgggatcttactaatcacgtgtccttacagaatcattccaagaaccagcccattgctacagctagagtggagaaaaacagagtgactcaaaagccatgggtaccatgatatcagttttgttggttgtatttgtcggtttgttttttcattcatgttgaagtgctttgcaaggcttcaggaaacagagttgtgaggagaaagaagaaaatggctgcccatttcagtaccctttcaaaggtatctctgcctaggaacattcttcagaaatgcaacttcttctatttagaaggtgacctcctgacagcgttcactctcaatatggaggaaaagaccacaacaactgtcctttctcaattacacaaatgctgttaaaatgtgatcaaaccatggcatcactttgctgaaatgtttctgcacagtcctgcctcttagattacagtcagccagaaaaacatacttataaatcatcccttttctgatttttgtagtttggcaattgagagagcaatattgaggttggccggttataaggagtcccacaatagaatacccaacaaagtggctgccaggccttctcagacagccatttgctttgggttttgcttccagacgttgttccatatttttgccccaaatgtttcatggcttataccccattggtttattttatatccatggacctttctttctctgctttcttgacttaaaggttgcagcagtacatctcgtcacctaggaatagattatcaggccttgccaactagtatgcagggatggcactaaaaatggatgtgcatcttctttcacattaactactaacctataagaagttgctctgagcccatttatttaaactctttagttcaccatcagatggacctttctctcacaagctagcttattccaaattatttgtcttattaatcaccagaaaatggtcatatcaaatgttctttcttttttgttctaaaggttgcattttcagttataggggaaaaaatattttctctaagatagaagaagttatttcagtattagctataggtgctacctacctcttggggacatggccctgtttgcgctaaccattacaatgatcttttagaactctgtatccaaagagctacttcgtgacactggccatctgagtcacagatgtgaagtcgatttcactttataactaaccagtcctacatattaagacttctaagtgtccatatgcatcttttttggtataatatataaagtcagcagggactcccctttcccttagggcatactactgtcagtcagaactgcaagatgtgaatgaagctcttaacggcttggagtgtctttctggaagaaattgccttttttttttttttcatgttagcaggtaaaaaatcattcacccaatttgaagcatagaagaaaatagttgctgaggttttttaataaccattcctactatctgtgttcccttagatactcctgtaattcttaatgtgaatagtttgttaatattgctgtaaagtattatattgtatgatttgaagacagactatatgtcattttattatactccatcaatctataatatattagactgatgctttatctaaaatgctttgagtttgtataatatatcttgacaaattttactaccatatgttatgtaataaatgtgtatttttgtacttgcagaaactgctgctaacttttaaagttgtttggttttcaaggcactgataatggatatgtatgaagtccatgctgtctgttaaataaaatgccattctgcag

SEQ ID NO: 3672 - DNA, 4542 bp, Homo sapiens
atgatgatggcaagaaagcaagatgtccgaattcccacctacaacatcagtgtggtgggattatctgggaccgagaaggaaaagggccagtgtgggattggaaagtcttgtttgtgcaaccgcttcgtgcgcccgagtgctgacgagtttcacttggaccatacctccgtcctcagcaccagtgactttggagggcgagtggtcaataatgaccactttctctactggggagaagttagccgctccctggaggattgtgtggaatgtaagatgcacattgtggagcagactgaatttattgatgatcagacttttcaacctcatcgaagcacggccctgcagccctatatcaagagagctgctgcgaccaagcttgcatcagctgaaaaactcatgtacttttgcactgaccagctggggctggagcaggactttgagcagaaacaaatgccagacggaaagctgctggttgatggttttcttcttggtattgatgttagcaggggcatgaataggaactttgatgaccagctcaagtttgtctccaatctctacaatcagcttgcaaaaacaaaaaagcccatagtggtggtcctgactaagtgtgacgaaggtgttgagcggtacattagagatgcacatacttttgccttaagcaaaaagaacctccaggttgtggagacctcagcgagatccaatgtaaacgtggacttggctttcagcaccttagtgcaactcattgataaaagtcggggaaagacaaaaatcattccttattttgaagctctcaagcagcagagtcagcagatagctacagcaaaagacaagtatgagtggctggtgagtcgcattgtgaaaaaccacaatgagaactggctgagtgtcagccgaaagatgcaggcctctccagaataccaggactatgtctacctggaagggactcagaaagccaagaagctgtttctacagcacatccaccgcctcaagcatgagcatatcgagcgtaggagaaagctgtacctggcagccctgccattagcttttgaagctcttatacctaatctagatgaaatagaccacctaagctgcataaaagccaaaaagctcttagaaaccaagccagaattcttgaagtggtttgttgtgcttgaagagaccccatgggatgccaccagtcacattgacaacatggaaaacgaacggattccctttgatttaatggataccgtccctgcagagcagctatacgaggcccacttagagaagctgaggaacgaaaggaaaagagttgagatgcgaagggcgtttaaagaaaacctggagacttctcctttcataactcccggaaagccttgggaagaggcccgtagttttattatgaatgaggatttctaccagtggctggaggaatctgtatacatggatatttatggcaaacaccaaaagcaaattatagataaagcaaaggaagaatttcaggagttgcttttggaatattcagaattgttttatgaactggagctggatgctaagcccagcaaggagaagatgggtgttattcaggatgttctgggagaggaacagcgatttaaagcattacaaaagctccaagcagagcgtgatgcccttattctgaaacacattcattttgtgtaccacccaacaaaggagacatgccccagctgcccagcttgtgtggacgctaagattgagcacttgattagttctcggtttatccggccgtctgaccggaatcagaaaaattcactctctgaccctaacattgatagaatcaacttggttatattgggcaaagacggccttgcccgagagttggccaatgagattcgagctctttgtacaaatgatgacaagtatgtgatagatggtaaaatgtatgagctttccctgaggccaatagaggggaatgtcaggcttcctgtgaactctttccagacgccaacatttcagccccacggctgtctctgcctttacaattcaaaggaatcgctatcctatgtagtggaaagtatagagaagagtagagagtccacgctgggccggcgggataatcatttagtccatctcccccttacattaattttggttaacaagagaggagacaccagtggagagactctgcatagcttaatacagcaaggtcaacaaattgctagcaaacttcagtgtgtctttctcgaccctgcttctgctggcattggttacggacgcaacattaatgaaaagcaaatcagtcaagttttgaagggactcctggactctaagcgtaacttaaacctggtcagttctactgctagcatcaaagatttggctgatgttgatctgcgaattgttatgtgtctgatgtgtggagatccttttagtgcagatgacatactttttcctgtccttcagtcccaaacctgtaaatcttcccattgtggaagcaacaactctgttttacttgaactaccaatcggactgcacaagaagcggattgaactgtctgttctttcataccattcctcctttagcatcagaaagagccggttggttcatgggtacattgttttttattcagccaaacgtaaggcctctttggctatgttacgtgcctttctttgtgaagtgcaggatattatccctattcagcttgtagcactcactgatggcgctgtagatgtcctggacaatgacttaagtagggaacagctaactgagggggaggagattgctcaagaaattgacggaaggttcacaagcatcccctgtagccaaccccagcataaacttgagatctttcacccattttttaaagatgtggtggaaaaaaagaacataatcgaggctactcatatgtacgataatgctgccgaggcctgtagcaccaccgaagaggtgtttaactccccccgggcaggatcaccgctctgcaactcaaacctgcaggattcagaagaagatatcgagccatcttacagcctgtttcgagaagacacatcactgccttctctgtccaaagaccattctaagctctctatggaactggagggaaatgatgggctgtctttcattatgagcaattttgagagtaaactgaacaacaaagtacctccgccagtcaaaccaaagcctcctgtccattttgaaattacaaagggggatctatcttatttagaccaaggccatagggatggacagaggaagtctgtgtcttctagcccctggctgcctcaggatgggtttgatccttctgactatgctgaacccatggatgctgtggtgaagccaaggaatgaagaagaaaacatatactccgtgccccatgacagcacccaaggcaaaatcatcaccattcggaatatcaacaaagcccagtccaacggcagcgggaatggttctgacagtgaaatggacaccagctctctagagcgagggcgcaaggtttccatcgtgagcaagccagtgctgtacaggacgagatgcacccggctggggcggtttgctagttaccggaccagcttcagcgtggggagtgatgatgagctggggcccatccggaagaaagaggaggatcaggcatcccagggttataaaggggacaatgctgtcattccatacgaaacagacgaagacccgcggaggaggaatattcttcgcagcctaaggaggaacactaagaaaccaaagcccaaaccccggccatccatcacaaaggcaacctgggagagtaactattttggggtgcccttaacaactgtcgtgactccagagaagccgatccccatttttattgaaagatgtattgagtacattgaagccacaggactgagcacggaaggcatctaccgggtcagcgggaacaagtctgagatggagagtctgcagagacagtttgatcaagaccacaacctggacctggcagagaaagactttacggtgaataccgtggctggtgccatgaagagctttttctcagaactgcctgaccccctggtcccgtataacatgcagatcgacttggtggaagcacacaaaatcaacgaccgggagcagaagttgcatgcccttaaggaggtattaaagaaatttccaaaggaaaaccacgaagtcttcaagtatgtcatctctcacctaaacaaggtcagccacaacaacaaggtgaatctcatgaccagcgagaacctctccatctgcttctggcccaccttgatgagacctgatttcagcactatggacgccctcacagccacgcgcacctaccagacaatcattgaactctttatccagcagtgccccttcttcttctacaatcggcccatcaccgagccccccggcgccaggcccagctccccctctgccgtggcttccaccgtccccttcctcacttccacgcctgtcacaagtcagccgtcgcccccacagtcgcctccacccaccccccagtccccaatgcagccactgcttccctccccgcttcatccccaccgtcccactccacagccttcccgaaacattccctggcaaacaaaggaacactag

SEQ ID NO: 3673 - DNA, 8878 bp, Homo sapiens
atgatgatggcaagaaagcaagatgtccgaattcccacctacaacatcagtgtggtgggattatctgggaccgagaaggaaaagggccagtgtgggattggaaagtcttgtttgtgcaaccgcttcgtgcgcccgagtgctgacgagtttcacttggaccatacctccgtcctcagcaccagtgactttggagggcgagtggtcaataatgaccactttctctactggggagaagttagccgctccctggaggattgtgtggaatgtaagatgcacattgtggagcagactgaatttattgatgatcagacttttcaacctcatcgaagcacggccctgcagccctatatcaagagagctgctgcgaccaagcttgcatcagctgaaaaactcatgtacttttgcactgaccagctggggctggagcaggactttgagcagaaacaaatgccagacggaaagctgctggttgatggttttcttcttggtattgatgttagcaggggcatgaataggaactttgatgaccagctcaagtttgtctccaatctctacaatcagcttgcaaaaacaaaaaagcccatagtggtggtcctgactaagtgtgacgaaggtgttgagcggtacattagagatgcacatacttttgccttaagcaaaaagaacctccaggttgtggagacctcagcgagatccaatgtaaacgtggacttggctttcagcaccttagtgcaactcattgataaaagtcggggaaagacaaaaatcattccttattttgaagctctcaagcagcagagtcagcagatagctacagcaaaagacaagtatgagtggctggtgagtcgcattgtgaaaaaccacaatgagaactggctgagtgtcagccgaaagatgcaggcctctccagaataccaggactatgtctacctggaagggactcagaaagccaagaagctgtttctacagcacatccaccgcctcaagcatgagcatatcgagcgtaggagaaagctgtacctggcagccctgccattagcttttgaagctcttatacctaatctagatgaaatagaccacctaagctgcataaaagccaaaaagctcttagaaaccaagccagaattcttgaagtggtttgttgtgcttgaagagaccccatgggatgccaccagtcacattgacaacatggaaaacgaacggattccctttgatttaatggataccgtccctgcagagcagctatacgaggcccacttagagaagctgaggaacgaaaggaaaagagttgagatgcgaagggcgtttaaagaaaacctggagacttctcctttcataactcccggaaagccttgggaagaggcccgtagttttattatgaatgaggatttctaccagtggctggaggaatctgtatacatggatatttatggcaaacaccaaaagcaaattatagataaagcaaaggaagaatttcaggagttgcttttggaatattcagaattgttttatgaactggagctggatgctaagcccagcaaggagaagatgggtgttattcaggatgttctgggagaggaacagcgatttaaagcattacaaaagctccaagcagagcgtgatgcccttattctgaaacacattcattttgtgtaccacccaacaaaggagacatgccccagctgcccagcttgtgtggacgctaagattgagcacttgattagttctcggtttatccggccgtctgaccggaatcagaaaaattcactctctgaccctaacattgatagaatcaacttggttatattgggcaaagacggccttgcccgagagttggccaatgagattcgagctctttgtacaaatgatgacaagtatgtgatagatggtaaaatgtatgagctttccctgaggccaatagaggggaatgtcaggcttcctgtgaactctttccagacgccaacatttcagccccacggctgtctctgcctttacaattcaaaggaatcgctatcctatgtagtggaaagtatagagaagagtagagagtccacgctgggccggcgggataatcatttagtccatctcccccttacattaattttggttaacaagagaggagacaccagtggagagactctgcatagcttaatacagcaaggtcaacaaattgctagcaaacttcagtgtgtctttctcgaccctgcttctgctggcattggttacggacgcaacattaatgaaaagcaaatcagtcaagttttgaagggactcctggactctaagcgtaacttaaacctggtcagttctactgctagcatcaaagatttggctgatgttgatctgcgaattgttatgtgtctgatgtgtggagatccttttagtgcagatgacatactttttcctgtccttcagtcccaaacctgtaaatcttcccattgtggaagcaacaactctgttttacttgaactaccaatcggactgcacaagaagcggattgaactgtctgttctttcataccattcctcctttagcatcagaaagagccggttggttcatgggtacattgttttttattcagccaaacgtaaggcctctttggctatgttacgtgcctttctttgtgaagtgcaggatattatccctattcagcttgtagcactcactgatggcgctgtagatgtcctggacaatgacttaagtagggaacagctaactgagggggaggagattgctcaagaaattgacggaaggttcacaagcatcccctgtagccaaccccagcataaacttgagatctttcacccattttttaaagatgtggtggaaaaaaagaacataatcgaggctactcatatgtacgataatgctgccgaggcctgtagcaccaccgaagaggtgtttaactccccccgggcaggatcaccgctctgcaactcaaacctgcaggattcagaagaagatatcgagccatcttacagcctgtttcgagaagacacatcactgccttctctgtccaaagaccattctaagctctctatggaactggagggaaatgatgggctgtctttcattatgagcaattttgagagtaaactgaacaacaaagtacctccgccagtcaaaccaaagcctcctgtccattttgaaattacaaagggggatctatcttatttagaccaaggccatagggatggacagaggaagtctgtgtcttctagcccctggctgcctcaggatgggtttgatccttctgactatgctgaacccatggatgctgtggtgaagccaaggaatgaagaagaaaacatatactccgtgccccatgacagcacccaaggcaaaatcatcaccattcggaatatcaacaaagcccagtccaacggcagcgggaatggttctgacagtgaaatggacaccagctctctagagcgagggcgcaaggtttccatcgtgagcaagccagtgctgtacaggacgagatgcacccggctggggcggtttgctagttaccggaccagcttcagcgtggggagtgatgatgagctggggcccatccggaagaaagaggaggatcaggcatcccagggttataaaggggacaatgctgtcattccatacgaaacagacgaagacccgcggaggaggaatattcttcgcagcctaaggaggaacactaagaaaccaaagcccaaaccccggccatccatcacaaaggcaacctgggagagtaactattttggggtgcccttaacaactgtcgtgactccagagaagccgatccccatttttattgaaagatgtattgagtacattgaagccacaggactgagcacggaaggcatctaccgggtcagcgggaacaagtctgagatggagagtctgcagagacagtttgatcaagaccacaacctggacctggcagagaaagactttacggtgaataccgtggctggtgccatgaagagctttttctcagaactgcctgaccccctggtcccgtataacatgcagatcgacttggtggaagcacacaaaatcaacgaccgggagcagaagttgcatgcccttaaggaggtattaaagaaatttccaaaggaaaaccacgaagtcttcaagtatgtcatctctcacctaaacaaggtcagccacaacaacaaggtgaatctcatgaccagcgagaacctctccatctgcttctggcccaccttgatgagacctgatttcagcactatggacgccctcacagccacgcgcacctaccagacaatcattgaactctttatccagcagtgccccttcttcttctacaatcggcccatcaccgagccccccggcgccaggcccagctccccctctgccgtggcttccaccgtccccttcctcacttccacgcctgtcacaagtcagccgtcgcccccacagtcgcctccacccaccccccagtccccaatgcagccactgcttccctcccagcttcaagccgaacacacgctgtgagccaccaagacctggggcgacaggagaaccggtcctctctctgacggggtggcatttggccttgaacaaaaccaagtccactggggacagaggcaggggcaagtggctctccccattaccttctcaagacctcagtgggagcaccagccaatggtaccatcggctgggctgccaggtaccctgggcctggcgctgcagacctgagctggcttggacccatttgaggactgaactaggcaggcaatggctccagtgccctccctctgttccctggaccaccaccccacgtagctgctcacaccagcctccgggtgcctccctctgcttgtacagagcccatggtcgggacagtgccctggcctttgccggggaggaggatgctctgagattcagggtggggctggcaacccctgaagagaacacttcctgttggtctgtctcttcccaccttccatctgcacacacccccaaggtaagggtacagcccggctggcggcctccttgggaacgtgtaggccacggctctgccaccactaggtacctgctgagggcgctggctctgcagatcagaacaacggaggatagctttgtgcctggacccagagagtgtgggactccccgcttcatccccaccgtcccactccacagccttcccgaaacattccctggcaaacaaaggaacactaggagaaaaaatggaaaaacccttccagtaattaaaaaggaagaaaccacagaaagaaaactacagacctcaagattccactctgtgcccgcctctgccgggagggagggaggcacacaggtggagctgaccctcgtctttgtggcagcaaaaccaggatgcctggagctgtggcctgagggcctgctggggtcccactcacccacttaggtctagtcgctagatcccccgttttcccaagaagagggttcgagcccttggtggggacagctggggagatggcagtgcaggctggaacctgggctgccccagaacacagtccattacgatagaaacactaattgagcatgtgcgtggggtgggggtgtgtgtgcacatgtgagtgtgagtgtgtgtgggcgcttggtggggggttggggacagctggaaggtgccaggtgcacttggggttggggttggtgtgttgggtgttgaagtggaatcgtttcatcccagccatggaggccaccagcaggagtgttcatggggatgtgggcgaggtggggcactttgaaggaatggcggtctgctggtgccctcgaaggggcatccttcctggtcttcgctgacccagaggcgctgtgcctgcatatcatccaccaccaccctagcccagccttcccactgccccaggaaaagctcttctcctggccacctctgccccccagcacctcaaacttgcatggctgggctgtggcctctgcggccaggaagcctgacactaggcaccccccaggcgagagctagtggggtgcagagggccccatgccagacagcccttggggctcgttgcactttaagaaataggatctgtggtgtattccagggggcctgatggacacctttcccgggcgtctgcagctgccctgcccgtgcccgcctgcagtggttggagacgggagtggcccttcggctcccgagctccctctggggacggctggctcactgtctccagttctcaatggccaacgaaggtgcttggaaacacctaaccttgcaagttttaccgccttttgaggaacacaaatcggagaacaaacccagggttcaggcgtgttttctgtgaatgttggatgatgaatttttgtctcttctggtggagctgtgcctggccctgtaggcccagggttggctggaaggtgacatctgtgtttcgttttagctgaggttggcagaaacgttcccaaactcccccagccctggaccccagcagatgaggaaacggccccatttactgaccccgcccccttttcgaggttatgctcacctggtcagctcctcacgtaattgggggtggagggaaagcatggtggtgccctgggccgtccctgtgtgaacgcaggcaaaagcagcccagtccccctcactgcttgagctaacactgccacctcttttgtgtgagcacaaaagccacgtcccaagccacctggcccgattccacagatgtatgtgcggccagtgacttccccaggagtgtggagggggtggtgaggaggagcacctgggctctctacccctctcctcacagaagtacctgaaactaggtctggggcactcccaatgcagcgccttgtcagccaaggtgggcaggcagggactgtggcagcttatgtccaaagggagcccccatgcacaggaagccacagggttcctcttgtttcccccgctaacttcagcctctcatctgctgctccgggctgagggactagaggacatctcggtcgtttgaggggcatggccagtcgtggcaggccggccttcagcgtccggtcagggaagcgtgcagcccaaatgggcacttgcatgggagccacagaggagcgtccctggggattgttgggaccatgctgcccccactcccgcttttgttggggctctaagttctggaaggtgtgtgcacagagggtgctcatgggactcgcatgcagctctcagcactgggtgggagggcgttggcttgtccagaatggggacgtggggcagccacccctgcccagcgagagcgcagacaccgtgtgaggggacagcagcccttggtgcaaagccagagactgatcctggctctgacggctgaagagggaagacccaaggctgggtggcgtggctcgtgaatccacttagaattcttggcttgtgtcgcatactgggtgtcacggcacacatttactctgcattgtccccgtctttcccatcgcctagcgtttggggaggaacagggagagagcttcggggcgtctgtctccgtgctctcctgcctccaccgccttggttttgcttcctgctggaggcagggcacctgctgcgacccagattcttctgcaggatgtgtctgtctttgtcacggtggacagagggtgacatcataggagcagctcgctggccagaaggggatgggggcatccctgtgcctcactcagctcctgctgctcttagggaaaggaggcctgggtcaagccagcatccccttggtaaagacccccgcaggccaccaggcattctggacacgcacacacacacacacacacacacacacacacaaaacttcacagcaggccagctgcagtgacttgtcatcaagagtcacctcagctgcgcccccctcccatcctttcctatgagaagccactgctttgggggcgccggctagaaaaagtagggtgcggtggccaggagggcccctgccgcgcggggggctgggtctggttgagtcgctgctttcccgagggcagcgcagggatccggggaagctgcggcagggagcgggcgccggcttcgtggctctgaggtgtaacgggggtgggctccctccctcggaggacatcgtctgtgtccaggtcagaaagtggcccaggaagggggcagtttctgtcgcgggtccggtgggggcgcggccgcggtgcggtcggtgcagcgtggccaatgcgcggcgcgcgcgggggacagagcaggaggcggtctgtcacctcggccactgctgacctgggctggcctcccccagccctcccgtggcggagccggcagcgatgctacaggcctaagttattgtttgcataaaaagaatcatgttccctgtgtacatttaagaaaaaaacaaaaaaacggaaatgtcagaattgtatggaaataaaacttgtttgaaaatttggaatagtgctgctgccagcttatttttctggtacttgtattttcacatgttaaatgatctttatatatgttgaattaacaaatattttgagtttctgagaaaaaacaaaacatattaatggtattgaaatgtgttagtagtctggctgtgtgcccaaaattctgtttcgcagcaaaagtgaagacctgtatgtaaagaaagtataacaattatttctttgtattttaggggctttaaccggaacatcgtctagctggtgttaggaatgtttgcttaatttccagacttttttttaaaaacacatcgtgggttttttgaggctccaacctgattagtgcatggtcagccctcaatgaaggctgaggcatctctgactgaggtgtttttgtttggttttgttttttaaaatcatgtatttgctacaaagtattgtacttgtctcaatgggaatggtgtaaaaaacaaaaggccttatgtgatctgtatcatagttaataaatgaatcttgt

SEQ ID NO: 3674 - DNA, 2713 bp, Homo sapiens
atgatgatggcaagaaagcaagatgtccgaattcccacctacaacatcagtgtggtgggattatctgggaccgagaaggaaaagggccagtgtgggattggaaagtcttgtttgtgcaaccgcttcgtgcgcccgagtgctgacgagtttcacttggaccatacctccgtcctcagcaccagtgactttggagggcgagtggtcaataatgaccactttctctactggggagaagttagccgctccctggaggattgtgtggaatgtaagatgcacattgtggagcagactgaatttattgatgatcagacttttcaacctcatcgaagcacggccctgcagccctatatcaagagagctgctgcgaccaagcttgcatcagctgaaaaactcatgtacttttgcactgaccagctggggctggagcaggactttgagcagaaacaaatgccagacggaaagctgctggttgatggttttcttcttggtattgatgttagcaggggcatgaataggaactttgatgaccagctcaagtttgtctccaatctctacaatcagcttgcaaaaacaaaaaagcccatagtggtggtcctgactaagtgtgacgaaggtgttgagcggtacattagagatgcacatacttttgccttaagcaaaaagaacctccaggttgtggagacctcagcgagatccaatgtaaacgtggacttggctttcagcaccttagtgcaactcattgataaaagtcggggaaagacaaaaatcattccttattttgaagctctcaagcagcagagtcagcagatagctacagcaaaagacaagtatgagtggctggtgagtcgcattgtgaaaaaccacaatgagaactggctgagtgtcagccgaaagatgcaggcctctccagaataccaggactatgtctacctggaagggactcagaaagccaagaagctgtttctacagcacatccaccgcctcaagcatgagcatatcgagcgtaggagaaagctgtacctggcagccctgccattagcttttgaagctcttatacctaatctagatgaaatagaccacctaagctgcataaaagccaaaaagctcttagaaaccaagccagaattcttgaagtggtttgttgtgcttgaagagaccccatgggatgccaccagtcacattgacaacatggaaaacgaacggattccctttgatttaatggataccgtccctgcagagcagctatacgaggcccacttagagaagctgaggaacgaaaggaaaagagttgagatgcgaagggcgtttaaagaaaacctggagacttctcctttcataactcccggaaagccttgggaagaggcccgtagttttattatgaatgaggatttctaccagtggctggaggaatctgtatacatggatatttatggcaaacaccaaaagcaaattatagataaagcaaaggaagaatttcaggagttgcttttggaatattcagaattgttttatgaactggagctggatgctaagcccagcaaggagaagatgggtgttattcaggatgttctgggagaggaacagcgatttaaagcattacaaaagctccaagcagagcgtgatgcccttattctgaaacacattcattttgtgtaccacccaacaaaggagacatgccccagctgcccagcttgtgtggacgctaagattgagcacttgattagttctcggtttatccggccgtctgaccggaatcagaaaaattcactctctgaccctaacattgatagaatcaacttggttatattgggcaaagacggccttgcccgagagttggccaatgagattcgagctctttgtacaaatgatgacaagtatgtgatagatggtaaaatgtatgagctttccctgaggccaatagaggggaatgtcaggcttcctgtgaactctttccagacgccaacatttcagccccacggctgtctctgcctttacaattcaaaggaatcgctatcctatgtagtggaaagtatagagaagagtagagagtccacgctgggccggcgggataatcatttagtccatctcccccttacattaattttggttaacaagagaggagacaccagtggagagactctgcatagcttaatacagcaaggtcaacaaattgctagcaaacttcagtgtgtctttctcgaccctgcttctgctggcgctgcagacctgagctggcttggacccatttgaggactgaactaggcaggcaatggctccagtgccctccctctgttccctggaccaccaccccacgtagctgctcacaccagcctccgggtgcctccctctgcttgtacagagcccatggtcgggacagtgccctggcctttgccggggaggaggatgctctgagattcagggtggggctggcaacccctgaagagaacacttcctgttggtctgtctcttcccaccttccatctgcacacacccccaaggtaagggtacagcccggctggcggcctccttgggaacgtgtaggccacggctctgccaccactaggtacctgctgagggcgctggctctgcagatcagaacaacggaggatagctttgtgcctggacccagagagtgtgggactccccgcttcatccccaccgtcccactccacagccttcccgaaacattccctggcaaacaaaggaacactag

SEQ ID NO: 3675 - DNA, 5233 bp, Homo sapiens
aaaaaagggtgaggagaagcagcggctgagcgggttggcatctggggcagcgggctcgctccaggccgtcgggggccgctcgccagcgtcgcccgctgtgttgggagcgcgggccgtgggcgtcgctcggccttgtccgcggcgtccccgctgccggccacggcgctcagcgcttgtgctctgtattgcaggtctaccccgagccccggagcgagagcgagtgcctgagcaacatccgcgagttcctgcgcggctgcggggcttccctgcggctggagacgtttgatgcaaatgatttgtatcaggggcagaattttaacaaggtcctcagttccttagtgactctaaataaagtaacagcagacatcgggctggggagtgactccgtgtgtgcccggccctcgtctcaccgcataaagtcttttgactcccttggatcacagtctttgcacactcggacttcaaaactgttccagggccagtatcggagtttggacatgaccgataatagcaacaatcaactggtagtaagagcaaagtttaacttccagcagaccaatgaggacgagctttccttctcaaaaggagacgtcatccatgtcacccgtgtggaagagggaggctggtgggagggcacactcaacggccggaccggctggttccccagcaactacgtgcgcgaggtcaaggccagcgagaagcctgtgtctcccaaatcaggaacactgaagagccctcccaaaggatttgatacgactgccataaacaaaagctattacaatgtggtgctacagaatattttagaaacagaaaatgaatattctaaagaacttcagactgtgctttcaacgtacctacggccattgcagaccagtgagaagttaagttcagcaaacatttcatatttaatgggaaatctagaagaaatatgttctttccagcaaatgctcgtacagtctttagaagaatgcaccaagttgcccgaagctcagcagagagtcggaggctgctttttaaacctgatgccacagatgaaaaccctgtacctcacgtattgtgccaatcacccttctgcagtgaatgtcctcacggaacacagtgaggagttgggggagttcatggagaccaaaggtgccagcagccctgggattctcgtgctgaccacgggcctgagcaaacccttcatgcgcctggataaataccctacgctgctcaaagagctcgagagacacatggaggattatcatacagatagacaagatattcaaaaatccatggctgccttcaaaaacctttcagcccaatgtcaagaagtccggaagaggaaagagcttgagctgcagatcctgacggaagccatccggaactgggagggcgatgacattaaaactctgggcaacgtcacttacatgtcccaggtcctgattcagtgtgccggaagtgaggaaaagaatgaaagatatcttctactcttcccaaatgttttgctaatgttgtctgccagtcctaggatgagtggctttatctatcagggaaagcttccaacgacaggaatgacaatcacaaagcttgaggacagtgaaaatcatagaaatgcatttgaaatatcagggagcatgattgagcggatattagtgtcgtgcaacaaccagcaggatctgcaggaatgggtggagcacctacagaagcaaacgaaggtcacgtctgtgggaaaccccaccataaagcctcattcagtgccatctcataccctcccctcccacccggtcactccgtccagcaagcacgcagacagcaagcccgcgccgctgacgcccgcctaccacacgctgccccacccctcccaccacggcaccccgcacaccaccatcaactggggacccctggagcctccgaaaacacccaagccctggagcctgagctgcctgcggcccgcgcctcccctccggccctcagctgctctctgctacaaggaggatcttagtaagagccctaagaccatgaaaaagctgctgcccaagcgcaaacctgaacggaagccttcagatgaggagttcgcgtcccggaaaagcacagctgctttggaagaagatgctcagattctgaaagtcattgaagcttactgcaccagcgccaaaacaaggcaaacactcaattcaacatggcaaggcactgacctgatgcataatcacgtcttggctgatgatgaccaaccaagcctagactccctggggcgtcgcagtagcctttctcgtttggagccttcagacctctcggaagactctgactatgacagtatatggacagcccatagttacagaatgggttctacatctcgttcacgcaaagaatctgctccacaagttttgcttccagaagaagagaaaattatagtggaagaaactaaaagtaatggtcagacagtgatagaagaaaagagtcttgtggataccgtatatgcattaaaggatgaagttcaagaattaagacaggacaacaaaaagatgaagaaatctctagaggaagaacagagagcccgcaaagacctggagaagctggtgaggaaagtcctgaagaacatgaatgatcctgcctgggatgagaccaatctataagggatgtcctcagttctttctgttgaagaccagttctgaggtgaagctgggcacccctgacccaagtcggggtgcactcaggaccacagggcagggctgggtggggcgccaccttgctctctgtatatagaaaagctggagcttattctgcgaatggagacgatcaaaccatgactgatgaatccagacaggagggattgactctgaggacctgagctacatcaatccactctgtgaacatctcagttacctcattctgcaataagttcagtgactgactaaaagtcttgtttttccagactttgaattgaatatataaatattatatatacatgtttcttgtaaatatcccattttgaatgcatacctgtggtggttctgtccgggctaatccccatgctagaatgtcctttccagctacgtgaataagaagtcccatgcccgcatccaccggaagcagaagcctggtggatgcctggttcgttccgcagcaccagggcctccaccgtgctgtggcagcaccccccatgtcggtatttctaaataaccttatttatacctgcagagatacacttcagtcccattcagaagtcttctcttaaagcagcattacagtcccagacctgcgggtttctgagggcaacttgctggctgacagactcagtcttgacctcaaggaaggcccatacggcactgccgcatccacctagaggtgtttgctcttgtccgctgtctgagtactgtgattctcagatgagtttgctgcgttttgggaggacacagacggttctgtataggctagttcagtaacaacaaaatacactgttttgtcttccctcaaagagagatcttactagaacctgtaaatagaatgtattatttattataagtcactgcagctgatgaaaacagatggaggccatgctgcaggctgatactgatgggtggagttttgtcatcaggccagcctcatcccgaggtctcctccaccattggccgtagccagcaggcttcagtgctcaccgaaagtaaaatcccctccttcagcaagaataaagcaatatacaccttaggttccactaagtaacataggcataagcagggaacgtttcccccactgtgttccagtgcagaggagacgaagcctgtcctcaccgcggctcgctgggcccaggctggctctggaaagcctgtgcggtcctgggcaggaagcccggcccgtggagcaggttttcgttctgcttcagcaataaataagggtgaccacagggactttgcttttggtttcctttcctgtgaaaaggttggttttaaagtgagatacacttttccgtagaacaagtgttctatctttaaaaacccaaattgcagcaccgtggattactggtctcagaacaactcattgcgcatcagatttgactctctgattttctgtctattggccaaattgccctttaactgcacctgaatcctttgtgtactgatgcctttgagctgggcaccttgggagagtgttgtgttgctgtttacggttcttccttgcccttgctaattacagtctctggtgcccagcaagcccctttggcttccttccgtgactggtcacgttgtctgcctgggctcagcgtggacctgccccatgctgcagaacctggcctcacctggacttttcactagaattgccagcttcctcaacttagcagatcattcactcatgcgggcacaagcaaagatcaacactttcttttttggtaagcttgagttttacaagttattttttggtgatgcgtaagacattgcagtgggaaaccattcaacttgagtttattggagtttgctgttgtagcaggttttaactcaggaacaactcttgtctgatctctccgcccctctgccgggaggcgacattaactgtcctctcggagccggtagcgttgctgtccgagtccccaggacggatctcctgcagacctgccttaatgctcagatcgaagtatttcacaagaatacttgtgtttttaacagcccttcccctggacggtgcggccatgagggcctcatgttacggcattgccttttctttctgtggatccagtatcttcctcggctttttagggagcaggaaaaatgcgtctgagagcaactctttttaaaaacctgccctgttgtatataactgtgtctgtttcaccgtgtgacctcccaagggggtgggaacttgatataaacgtttaaaggggccacgatttgcccgagggttactcctttgctctcaccttgtatggatgaggagatgaagccatttcttatcctgtagatgtgaagcactttcagttttcagcgatgttggaatgtagcatcagaagctcgttccttcacactcagtggcgtctgtgcttgtccacatgcgctgggcgtctgggaccttgaatgcctgccctggttgtgtggactccttaatgccaatcatttcttcacttctctgggacacccagggcgcctgttgacaagtgtggagaaactcctaatttaaatgtcacagacaatgtcctagtgttgactactacaatgttgatgctacactgttgtaattattaaactgattatttttcttatgtc

SEQ ID NO: 3676 - DNA, 4361 bp, Homo sapiens
ccccgagacgcagccaggcgcccggcccggcccggcccggccctctgcacagccccacttcaggccacgccgtttccttgaccttcccccggcagggtctgaagcgtcaccgtccgtctagagcagagtcgcgcaggcccctgccctgccggtgaggtcggcgccgcgctccggagagtcggttcctcccgattcagacccatatggcttcagatggaaccatcatttctgttccgtcatgaccggcttgcaaggtagcaaagcgaaacaaacgtctcgttttcagcctgtccccgccaccttgaaataaaaccggcaaaaataaaaagagcattctgggaagtacttcatcatttcaacgctcacgaattcaaaacataaacaaaggcttccgagtgccccggccaggggcgcggggcgcacggcgggcccggggcaggtaagcgcaggtgcgcgcccgcccccacccccggctccctccccatccgctccccgctccccttcccctttcccttccccgcccgctcccagccgccgccgccgccccgcgcacggcctggagcggaggctgcgcagggcgcggggcggcgcgggccgggcgcgggccgggcggacggccgcgtctttcttctcctggcggtgatgtcattgggcgacggcggccgaggccggggggcggcggcgggcgcccgcaggttcccgagccgctcctgagaaggcgcctgacagcgggccggggcgcacggagaagcgggccgggccggacctgctgggccgcgccgagccaatcgccggcgccggccgctcgatgggcgaggcggcggcggcggcggcgggggccgcgggccgggccgccgctccgaggtgaaggcgcgcgcccctccccgcctgcctcccgggccgcagcgatgaattccgccgagcaaaccgttacgtggctcatcactctgggggtgctggagtcgcccaaaaaaaccatctcggacccggagggctttctgcaggcgtcgctgaaggatggggtggtcctctgcaggctgctggagcgcctgctccccgggaccatcgagaaagtctaccccgagccccggagcgagagcgagtgcctgagcaacatccgcgagttcctgcgcggctgcggggcttccctgcggctggagacgtttgatgcaaatgatttgtatcaggggcagaattttaacaaggtcctcagttccttagtgactctaaataaagtaacagcagacatcgggctggggagtgactccgtgtgtgcccggccctcgtctcaccgcataaagtcttttgactcccttggatcacagtctttgcacactcggacttcaaaactgttccagggccagtatcggagtttggacatgaccgataatagcaacaatcaactggtagtaagagcaaagtttaacttccagcagaccaatgaggacgagctttccttctcaaaaggagacgtcatccatgtcacccgtgtggaagagggaggctggtgggagggcacactcaacggccggaccggctggttccccagcaactacgtgcgcgaggtcaaggccagcgagaagcctgtgtctcccaaatcaggaacactgaagagccctcccaaaggatttgatacgactgccataaacaaaagctattacaatgtggtgctacagaatattttagaaacagaaaatgaatattctaaagaacttcagactgtgctttcaacgtacctacggccattgcagaccagtgagaagttaagttcagcaaacatttcatatttaatgggaaatctagaagaaatatgttctttccagcaaatgctcgtacagtctttagaagaatgcaccaagttgcccgaagctcagcagagagtcggaggctgctttttaaacctgatgccacagatgaaaaccctgtacctcacgtattgtgccaatcacccttctgcagtgaatgtcctcacggaacacagtgaggagttgggggagttcatggagaccaaaggtgccagcagccctgggattctcgtgctgaccacgggcctgagcaaacccttcatgcgcctggataaataccctacgctgctcaaagagctcgagagacacatggaggattatcatacagatagacaagatattcaaaaatccatggctgccttcaaaaacctttcagcccaatgtcaagaagtccggaagaggaaagagcttgagctgcagatcctgacggaagccatccggaactgggagggcgatgacattaaaactctgggcaacgtcacttacatgtcccaggtcctgattcagtgtgccggaagtgaggaaaagaatgaaagatatcttctactcttcccaaatgttttgctaatgttgtctgccagtcctaggatgagtggctttatctatcagggaaagcttccaacgacaggaatgacaatcacaaagcttgaggacagtgaaaatcatagaaatgcatttgaaatatcagggagcatgattgagcggatattagtgtcgtgcaacaaccagcaggatctgcaggaatgggtggagcacctacagaagcaaacgaaggtcacgtctgtgggaaaccccaccataaagcctcattcagtgccatctcataccctcccctcccacccggtcactccgtccagcaagcacgcagacagcaagcccgcgccgctgacgcccgcctaccacacgctgccccacccctcccaccacggcaccccgcacaccaccatcaactggggacccctggagcctccgaaaacacccaagccctggagcctgagctgcctgcggcccgcgcctcccctccggccctcagctgctctctgctacaaggaggatcttagtaagagccctaagaccatgaaaaagctgctgcccaagcgcaaacctgaacggaagccttcagatgaggagttcgcgtcccggaaaagcacagctgctttggaagaagatgctcagattctgaaagtcattgaagcttactgcaccagcgccaaaacaaggcaaacactcaattcaacatggcaaggcactgacctgatgcataatcacgtcttggctgatgatgaccaaccaagcctagactccctggggcgtcgcagtagcctttctcgtttggagccttcagacctctcggaagactctgactatgacagtatatggacagcccatagttacagaatgggttctacatctcgtaagagctgttgctcatatatctctcaccagaactaatgcacttctgagcttttcttaacaaatgcttgttgtatcgcagcctgcttttcttagatgttttcttgctgttccttgtctcttttatgtgatattttaacaacttttgagagtgttcctgatatttcccattgtactttgtggaggcttaactgccgatgcgagtatacattcgaatgactgactattggagggaggtggtgtgttcacgtgagcctacatccgagggtgctcttcgtaaggggtagttgttgttttatagctccaaatggtttttttattctcagtgtagcaactgtttgatttctttctggatacagctgtatgaacacttttctattttatactgaaatcacacaggtttgtgatctaagtgccagaaccatggaggagactctggccttatctgtagggacctaaattttttaagtgctatgaacactgatcaagtagttgtggagagatgagaagaatatatgcagcaaaggtgctgtgagcccagttccaacggctgtgttctggtaatcgtgcagaacagcatgtgggctctgggccttggcaggtgcacagacgggcgggcgtcacgtgtgttcagagcttgtctccacctcacggctctgtgctcttctgtgtgctgcgttgtggccgtgaagtgggagctctcctttccaaaggcagagcttactgtcatggctcagatgttcactcgcatcttcaccccaaacttccctgaattgcagtgatttctgttataaggcacatagcaagcctgtaccactctacagtaaaatctctacactaacagtttaaagcccgaaagctgaagcattcagcctctgcaagtgtagactactggactgtagtagaggcatttggaatacttacaaagtcaagtgctgtggcttcagttcccccggctccccacccctgacatccatacttatgttgtctggaagagccatggacacatcattattttcagcaaccagctgcagtgaaactccatttacagcaaccccatagtataaaaccacaatgcctcattgtaatgggatattgaagttcattgaagaattactaggttgccatgtggctcacttattt

SEQ ID NO: 3677 - DNA, 4814 bp, Homo sapiens
atgaattccgccgagcaaaccgttacgtggctcatcactctgggggtgctggagtcgcccaaaaaaaccatctcggacccggagggctttctgcaggcgtcgctgaaggatggggtggtcctctgcaggctgctggagcgcctgctccccgggaccatcgagaaagtctaccccgagccccggagcgagagcgagtgcctgagcaacatccgcgagttcctgcgcggctgcggggcttccctgcggctggaggacatgaccgataatagcaacaatcaactggtagtaagagcaaagtttaacttccagcagaccaatgaggacgagctttccttctcaaaaggagacgtcatccatgtcacccgtgtggaagagggaggctggtgggagggcacactcaacggccggaccggctggttccccagcaactacgtgcgcgaggtcaaggccagcgagaagcctgtgtctcccaaatcaggaacactgaagagccctcccaaaggatttgatacgactgccataaacaaaagctattacaatgtggtgctacagaatattttagaaacagaaaatgaatattctaaagaacttcagactgtgctttcaacgtacctacggccattgcagaccagtgagaagttaagttcagcaaacatttcatatttaatgggaaatctagaagaaatatgttctttccagcaaatgctcgtacagtctttagaagaatgcaccaagttgcccgaagctcagcagagagtcggaggctgctttttaaacctgatgccacagatgaaaaccctgtacctcacgtattgtgccaatcacccttctgcagtgaatgtcctcacggaacacagtgaggagttgggggagttcatggagaccaaaggtgccagcagccctgggattctcgtgctgaccacgggcctgagcaaacccttcatgcgcctggataaataccctacgctgctcaaagagctcgagagacacatggaggattatcatacagatagacaagatattcaaaaatccatggctgccttcaaaaacctttcagcccaatgtcaagaagtccggaagaggaaagagcttgagctgcagatcctgacggaagccatccggaactgggagggcgatgacattaaaactctgggcaacgtcacttacatgtcccaggtcctgattcagtgtgccggaagtgaggaaaagaatgaaagatatcttctactcttcccaaatgttttgctaatgttgtctgccagtcctaggatgagtggctttatctatcagggaaagcttccaacgacaggaatgacaatcacaaagcttgaggacagtgaaaatcatagaaatgcatttgaaatatcagggagcatgattgagcggatattagtgtcgtgcaacaaccagcaggatctgcaggaatgggtggagcacctacagaagcaaacgaaggtcacgtctgtgggaaaccccaccataaagcctcattcagtgccatctcataccctcccctcccacccggtcactccgtccagcaagcacgcagacagcaagcccgcgccgctgacgcccgcctaccacacgctgccccacccctcccaccacggcaccccgcacaccaccatcaactggggacccctggagcctccgaaaacacccaagccctggagcctgagctgcctgcggcccgcgcctcccctccggccctcagctgctctctgctacaaggaggatcttagtaagagccctaagaccatgaaaaagctgctgcccaagcgcaaacctgaacggaagccttcagatgaggagttcgcgtcccggaaaagcacagctgctttggaagaagatgctcagattctgaaagtcattgaagcttactgcaccagcgccaaaacaaggcaaacactcaattcaagttcacgcaaagaatctgctccacaagttttgcttccagaagaagagaaaattatagtggaagaaactaaaagtaatggtcagacagtgatagaagaaaagagtcttgtggataccgtatatgcattaaaggatgaagttcaagaattaagacaggacaacaaaaagatgaagaaatctctagaggaagaacagagagcccgcaaagacctggagaagctggtgaggaaagtcctgaagaacatgaatgatcctgcctgggatgagaccaatctataagggatgtcctcagttctttctgttgaagaccagttctgaggtgaagctgggcacccctgacccaagtcggggtgcactcaggaccacagggcagggctgggtggggcgccaccttgctctctgtatatagaaaagctggagcttattctgcgaatggagacgatcaaaccatgactgatgaatccagacaggagggattgactctgaggacctgagctacatcaatccactctgtgaacatctcagttacctcattctgcaataagttcagtgactgactaaaagtcttgtttttccagactttgaattgaatatataaatattatatatacatgtttcttgtaaatatcccattttgaatgcatacctgtggtggttctgtccgggctaatccccatgctagaatgtcctttccagctacgtgaataagaagtcccatgcccgcatccaccggaagcagaagcctggtggatgcctggttcgttccgcagcaccagggcctccaccgtgctgtggcagcaccccccatgtcggtatttctaaataaccttatttatacctgcagagatacacttcagtcccattcagaagtcttctcttaaagcagcattacagtcccagacctgcgggtttctgagggcaacttgctggctgacagactcagtcttgacctcaaggaaggcccatacggcactgccgcatccacctagaggtgtttgctcttgtccgctgtctgagtactgtgattctcagatgagtttgctgcgttttgggaggacacagacggttctgtataggctagttcagtaacaacaaaatacactgttttgtcttccctcaaagagagatcttactagaacctgtaaatagaatgtattatttattataagtcactgcagctgatgaaaacagatggaggccatgctgcaggctgatactgatgggtggagttttgtcatcaggccagcctcatcccgaggtctcctccaccattggccgtagccagcaggcttcagtgctcaccgaaagtaaaatcccctccttcagcaagaataaagcaatatacaccttaggttccactaagtaacataggcataagcagggaacgtttcccccactgtgttccagtgcagaggagacgaagcctgtcctcaccgcggctcgctgggcccaggctggctctggaaagcctgtgcggtcctgggcaggaagcccggcccgtggagcaggttttcgttctgcttcagcaataaataagggtgaccacagggactttgcttttggtttcctttcctgtgaaaaggttggttttaaagtgagatacacttttccgtagaacaagtgttctatctttaaaaacccaaattgcagcaccgtggattactggtctcagaacaactcattgcgcatcagatttgactctctgattttctgtctattggccaaattgccctttaactgcacctgaatcctttgtgtactgatgcctttgagctgggcaccttgggagagtgttgtgttgctgtttacggttcttccttgcccttgctaattacagtctctggtgcccagcaagcccctttggcttccttccgtgactggtcacgttgtctgcctgggctcagcgtggacctgccccatgctgcagaacctggcctcacctggacttttcactagaattgccagcttcctcaacttagcagatcattcactcatgcgggcacaagcaaagatcaacactttcttttttggtaagcttgagttttacaagttattttttggtgatgcgtaagacattgcagtgggaaaccattcaacttgagtttattggagtttgctgttgtagcaggttttaactcaggaacaactcttgtctgatctctccgcccctctgccgggaggcgacattaactgtcctctcggagccggtagcgttgctgtccgagtccccaggacggatctcctgcagacctgccttaatgctcagatcgaagtatttcacaagaatacttgtgtttttaacagcccttcccctggacggtgcggccatgagggcctcatgttacggcattgccttttctttctgtggatccagtatcttcctcggctttttagggagcaggaaaaatgcgtctgagagcaactctttttaaaaacctgccctgttgtatataactgtgtctgtttcaccgtgtgacctcccaagggggtgggaacttgatataaacgtttaaaggggccacgatttgcccgagggttactcctttgctctcaccttgtatggatgaggagatgaagccatttcttatcctgtagatgtgaagcactttcagttttcagcgatgttggaatgtagcatcagaagctcgttccttcacactcagtggcgtctgtgcttgtccacatgcgctgggcgtctgggaccttgaatgcctgccctggttgtgtggactccttaatgccaatcatttcttcacttctctgggacacccagggcgcctgttgacaagtgtggagaaactcctaatttaaatgtcacagacaatgtcctagtgttgactactacaatgttgatgctacactgttgtaattattaaactgattatttttcttatgtc

SEQ ID NO: 3678 - DNA, 4957 bp, Homo sapiens
acgtttgatgcaaatgatttgtatcaggggcagaattttaacaaggtcctcagttccttagtgactctaaataaagtaacagcagacatcgggctggggagtgactccgtgtgtgcccggccctcgtctcaccgcataaagtcttttgactcccttggatcacagtctttgcacactcggacttcaaaactgttccagggccagtatcggagtttggacatgaccgataatagcaacaatcaactggtagtaagagcaaagtttaacttccagcagaccaatgaggacgagctttccttctcaaaaggagacgtcatccatgtcacccgtgtggaagagggaggctggtgggagggcacactcaacggccggaccggctggttccccagcaactacgtgcgcgaggtcaaggccagcgagaagcctgtgtctcccaaatcaggaacactgaagagccctcccaaaggatttgatacgactgccataaacaaaagctattacaatgtggtgctacagaatattttagaaacagaaaatgaatattctaaagaacttcagactgtgctttcaacgtacctacggccattgcagaccagtgagaagttaagttcagcaaacatttcatatttaatgggaaatctagaagaaatatgttctttccagcaaatgctcgtacagtctttagaagaatgcaccaagttgcccgaagctcagcagagagtcggaggctgctttttaaacctgatgccacagatgaaaaccctgtacctcacgtattgtgccaatcacccttctgcagtgaatgtcctcacggaacacagtgaggagttgggggagttcatggagaccaaaggtgccagcagccctgggattctcgtgctgaccacgggcctgagcaaacccttcatgcgcctggataaataccctacgctgctcaaagagctcgagagacacatggaggattatcatacagatagacaagatattcaaaaatccatggctgccttcaaaaacctttcagcccaatgtcaagaagtccggaagaggaaagagcttgagctgcagatcctgacggaagccatccggaactgggagggcgatgacattaaaactctgggcaacgtcacttacatgtcccaggtcctgattcagtgtgccggaagtgaggaaaagaatgaaagatatcttctactcttcccaaatgttttgctaatgttgtctgccagtcctaggatgagtggctttatctatcagggaaagcttccaacgacaggaatgacaatcacaaagcttgaggacagtgaaaatcatagaaatgcatttgaaatatcagggagcatgattgagcggatattagtgtcgtgcaacaaccagcaggatctgcaggaatgggtggagcacctacagaagcaaacgaaggtcacgtctgtgggaaaccccaccataaagcctcattcagtgccatctcataccctcccctcccacccggtcactccgtccagcaagcacgcagacagcaagcccgcgccgctgacgcccgcctaccacacgctgccccacccctcccaccacggcaccccgcacaccaccatcaactggggacccctggagcctccgaaaacacccaagccctggagcctgagctgcctgcggcccgcgcctcccctccggccctcagctgctctctgctacaaggaggatcttagtaagagccctaagaccatgaaaaagctgctgcccaagcgcaaacctgaacggaagccttcagatgaggagttcgcgtcccggaaaagcacagctgctttggaagaagatgctcagattctgaaagtcattgaagcttactgcaccagcgccaaaacaaggcaaacactcaattcaacatggcaaggcactgacctgatgcataatcacgtcttggctgatgatgaccaaccaagcctagactccctggggcgtcgcagtagcctttctcgtttggagccttcagacctctcggaagactctgactatgacagtatatggacagcccatagttacagaatgggttctacatctcgtaagagctgttgctcatatatctctcaccagaactaatgcacttctgagcttttcttaacaaatgcttgttgtatcgcagcctgcttttcttagatgttttcttgctgttccttgtctcttttatgtgatattttaacaacttttgagagtgttcctgatatttcccattgtactttgtggaggcttaactgccgatgcgagtatacattcgaatgactgactattggagggaggtggtgtgttcacgtgagcctacatccgagggtgctcttcgtaaggggtagttgttgttttatagctccaaatggtttttttattctcagtgtagcaactgtttgatttctttctggatacagctgtatgaacacttttctattttatactgaaatcacacaggtttgtgatctaagtgccagaaccatggaggagactctggccttatctgtagggacctaaattttttaagtgctatgaacactgatcaagtagttgtggagagatgagaagaatatatgcagcaaaggtgctgtgagcccagttccaacggctgtgttctggtaatcgtgcagaacagcatgtgggctctgggccttggcaggtgcacagacgggcgggcgtcacgtgtgttcagagcttgtctccacctcacggctctgtgctcttctgtgtgctgcgttgtggccgtgaagtgggagctctcctttccaaaggcagagcttactgtcatggctcagatgttcactcgcatcttcaccccaaacttccctgaattgcagtgatttctgttataaggcacatagcaagcctgtaccactctacagtaaaatctctacactaacagtttaaagcccgaaagctgaagcattcagcctctgcaagtgtagactactggactgtagtagaggcatttggaatacttacaaagtcaagtgctgtggcttcagttcccccggctccccacccctgacatccatacttatgttgtctggaagagccatggacacatcattattttcagcaaccagctgcagtgaaactccatttacagcaaccccatagtataaaaccacaatgcctcattgtaatgggatattgaagttcattgaagaattactaggttgccatgtggctcacttatttaaaaaaaaaaaaaaaaaactcacccgttttcctgggatttgttgtaaggagttttcactggcctcactcagaccaatttctgcttcaaaaagcactgaatgtgacctgttgcattcagttgtagcatcaaatccacacctagtcattgcttgaggggccaaattgtgttctgtcccatgcacgctctatttggtgttaaaatggaaccttacggttgtgttttaagtattcattgaaaccagcttcagaaaacaagatgccatagtaaattgagaataacattttttccttcttcagggtggctgtaattccaggtggccgtgatttctttcttccccactgcccactccttcgccaaacccacgtattcagtgttctgatcttgtttgtgcagagtgaactctgatgcagtatcagtcttgtcctgggagccgggtcctgctgctcacaagcccagagctgccagggagctcctggcagtagcacgttgtttagaaagttgggtggcttcattcagcatggaacaagctaatggcacaggagacatcagggcagctgttaattccaaatatttgttcccaagtagctactgaactgctcacaccattggaagattttgtattttcataccaattagtaaaaataagaacattgaggagcagtcagagcccagtgttaatctccggcagagatggggtttatgtatgttcagccagatagtaaatgggatttttggagaaataagataactacaaagtttctatacttactataagtggatttagaagcgattttggttttgtattacatacggtagtcctctgcgtcagggagcacttttttgtttgcctcgagactactcattagcgcactggctaagctgcctttgccttctcgtaggcgtgggttgcctgtgtcatgggctgtgtagaccacaacactcaaacacagttgctgcacttggattttcctttaataccaagtatcatttggttatcttactgggacattttcattgatattctatacaccaaagttttgacggtttaccatcattccattttgtaccagttaaaggcattttgatgatgctttttcttgatgctaagatcactgcagaagaataacctgaccttttctttgcatttgttttgaatgtctaacaccattagcttttgtgatctggttaagaagtattagtgccacaagcctgaaaagacagttctcctgtggcagtggcgatgtggcatccagagggccattgtttctacttttgtgggacttcagtcatgctgataatagaatcttctgttcatacaattctgtaatatttatttgtacagttagtattctaatgaaaggatgaagagtctgaactagaaggtaggtttaagccatcaccaggcctttgcaaatggcctaaatggtgttccctttgaaataacgcttgccacaagtatataataagctatattaattgtgttttgcataaaattgccaaaacacagtaatgtgtatatagtggtataagatcttgaaaaaaatctctataattgtgctctttatctgtgaatgggaaaagccatttttagtaggtgactaccatttgaaaaactcaattggatgtatatctgaatgttgcattgtattgtacagtatgcatattattgtttgtggttgcatatggcaatgaagtgtttgttttatattaaaaaaaacctgttatgtacagttgaaataaattttgcatttgcta

SEQ ID NO: 3679 - DNA, 5032 bp, Homo sapiens
gctgagcgggttggcatctggggcagcgggctcgctccaggccgtcgggggccgctcgccagcgtcgcccgctgtgttgggagcgcgggccgtgggcgtcgctcggccttgtccgcggcgtccccgctgccggccacggcgctcagcgcttgtgctctgtattgcaggtctaccccgagccccggagcgagagcgagtgcctgagcaacatccgcgagttcctgcgcggctgcggggcttccctgcggctggagacgtttgatgcaaatgatttgtatcaggggcagaattttaacaaggtcctcagttccttagtgactctaaataaagtaacagcagacatcgggctggggagtgactccgtgtgtgcccggccctcgtctcaccgcataaagtcttttgactcccttggatcacagtctttgcacactcggacttcaaaactgttccagggccagtatcggagtttggacatgaccgataatagcaacaatcaactggtagtaagagcaaagtttaacttccagcagaccaatgaggacgagctttccttctcaaaaggagacgtcatccatgtcacccgtgtggaagagggaggctggtgggagggcacactcaacggccggaccggctggttccccagcaactacgtgcgcgaggtcaaggccagcgagaagcctgtgtctcccaaatcaggaacactgaagagccctcccaaaggatttgatacgactgccataaacaaaagctattacaatgtggtgctacagaatattttagaaacagaaaatgaatattctaaagaacttcagactgtgctttcaacgtacctacggccattgcagaccagtgagaagttaagttcagcaaacatttcatatttaatgggaaatctagaagaaatatgttctttccagcaaatgctcgtacagtctttagaagaatgcaccaagttgcccgaagctcagcagagagtcggaggctgctttttaaacctgatgccacagatgaaaaccctgtacctcacgtattgtgccaatcacccttctgcagtgaatgtcctcacggaacacagtgaggagttgggggagttcatggagaccaaaggtgccagcagccctgggattctcgtgctgaccacgggcctgagcaaacccttcatgcgcctggataaataccctacgctgctcaaagagctcgagagacacatggaggattatcatacagatagacaagatattcaaaaatccatggctgccttcaaaaacctttcagcccaatgtcaagaagtccggaagaggaaagagcttgagctgcagatcctgacggaagccatccggaactgggagggcgatgacattaaaactctgggcaacgtcacttacatgtcccaggtcctgattcagtgtgccggaagtgaggaaaagaatgaaagatatcttctactcttcccaaatgttttgctaatgttgtctgccagtcctaggatgagtggctttatctatcagggaaagcttccaacgacaggaatgacaatcacaaagcttgaggacagtgaaaatcatagaaatgcatttgaaatatcagggagcatgattgagcggatattagtgtcgtgcaacaaccagcaggatctgcaggaatgggtggagcacctacagaagcaaacgaaggtcacgtctgtgggaaaccccaccataaagcctcattcagtgccatctcataccctcccctcccacccggtcactccgtccagcaagcacgcagacagcaagcccgcgccgctgacgcccgcctaccacacgctgccccacccctcccaccacggcaccccgcacaccaccatcaactggggacccctggagcctccgaaaacacccaagccctggagcctgagctgcctgcggcccgcgcctcccctccggccctcagctgctctctgctacaaggaggatcttagtaagagccctaagaccatgaaaaagctgctgcccaagcgcaaacctgaacggaagccttcagatgaggagttcgcgtcccggaaaagcacagctgctttggaagaagatgctcagattctgaaagtcattgaagcttactgcaccagcgccaaaacaaggcaaacactcaattcaagttcacgcaaagaatctgctccacaagttttgcttccagaagaagagaaaattatagtggaagaaactaaaagtaatggtcagacagtgatagaagaaaagagtcttgtggataccgtatatgcattaaaggatgaagttcaagaattaagacaggacaacaaaaagatgaagaaatctctagaggaagaacagagagcccgcaaagacctggagaagctggtgaggaaagtcctgaagaacatgaatgatcctgcctgggatgagaccaatctataagggatgtcctcagttctttctgttgaagaccagttctgaggtgaagctgggcacccctgacccaagtcggggtgcactcaggaccacagggcagggctgggtggggcgccaccttgctctctgtatatagaaaagctggagcttattctgcgaatggagacgatcaaaccatgactgatgaatccagacaggagggattgactctgaggacctgagctacatcaatccactctgtgaacatctcagttacctcattctgcaataagttcagtgactgactaaaagtcttgtttttccagactttgaattgaatatataaatattatatatacatgtttcttgtaaatatcccattttgaatgcatacctgtggtggttctgtccgggctaatccccatgctagaatgtcctttccagctacgtgaataagaagtcccatgcccgcatccaccggaagcagaagcctggtggatgcctggttcgttccgcagcaccagggcctccaccgtgctgtggcagcaccccccatgtcggtatttctaaataaccttatttatacctgcagagatacacttcagtcccattcagaagtcttctcttaaagcagcattacagtcccagacctgcgggtttctgagggcaacttgctggctgacagactcagtcttgacctcaaggaaggcccatacggcactgccgcatccacctagaggtgtttgctcttgtccgctgtctgagtactgtgattctcagatgagtttgctgcgttttgggaggacacagacggttctgtataggctagttcagtaacaacaaaatacactgttttgtcttccctcaaagagagatcttactagaacctgtaaatagaatgtattatttattataagtcactgcagctgatgaaaacagatggaggccatgctgcaggctgatactgatgggtggagttttgtcatcaggccagcctcatcccgaggtctcctccaccattggccgtagccagcaggcttcagtgctcaccgaaagtaaaatcccctccttcagcaagaataaagcaatatacaccttaggttccactaagtaacataggcataagcagggaacgtttcccccactgtgttccagtgcagaggagacgaagcctgtcctcaccgcggctcgctgggcccaggctggctctggaaagcctgtgcggtcctgggcaggaagcccggcccgtggagcaggttttcgttctgcttcagcaataaataagggtgaccacagggactttgcttttggtttcctttcctgtgaaaaggttggttttaaagtgagatacacttttccgtagaacaagtgttctatctttaaaaacccaaattgcagcaccgtggattactggtctcagaacaactcattgcgcatcagatttgactctctgattttctgtctattggccaaattgccctttaactgcacctgaatcctttgtgtactgatgcctttgagctgggcaccttgggagagtgttgtgttgctgtttacggttcttccttgcccttgctaattacagtctctggtgcccagcaagcccctttggcttccttccgtgactggtcacgttgtctgcctgggctcagcgtggacctgccccatgctgcagaacctggcctcacctggacttttcactagaattgccagcttcctcaacttagcagatcattcactcatgcgggcacaagcaaagatcaacactttcttttttggtaagcttgagttttacaagttattttttggtgatgcgtaagacattgcagtgggaaaccattcaacttgagtttattggagtttgctgttgtagcaggttttaactcaggaacaactcttgtctgatctctccgcccctctgccgggaggcgacattaactgtcctctcggagccggtagcgttgctgtccgagtccccaggacggatctcctgcagacctgccttaatgctcagatcgaagtatttcacaagaatacttgtgtttttaacagcccttcccctggacggtgcggccatgagggcctcatgttacggcattgccttttctttctgtggatccagtatcttcctcggctttttagggagcaggaaaaatgcgtctgagagcaactctttttaaaaacctgccctgttgtatataactgtgtctgtttcaccgtgtgacctcccaagggggtgggaacttgatataaacgtttaaaggggccacgatttgcccgagggttactcctttgctctcaccttgtatggatgaggagatgaagccatttcttatcctgtagatgtgaagcactttcagttttcagcgatgttggaatgtagcatcagaagctcgttccttcacactcagtggcgtctgtgcttgtccacatgcgctgggcgtctgggaccttgaatgcctgccctggttgtgtggactccttaatgccaatcatttcttcacttctctgggacacccagggcgcctgttgacaagtgtggagaaactcctaatttaaatgtcacagacaatgtcctagtgttgactactacaatgttgatgctacactgttgtaattattaaactgattatttttcttatgtc

SEQ ID NO: 3680 - DNA, 2400 bp, Homo sapiens
cacatcctgttattctgggttttgtgacttgctgccttgccactatgaagacgtttgatgcaaatgatttgtatcaggggcagaattttaacaaggtcctcagttccttagtgactctaaataaagtaacagcagacatcgggctggggagtgactccgtgtgtgcccggccctcgtctcaccgcataaagtcttttgactcccttggatcacagtctttgcacactcggacttcaaaactgttccagggccagtatcggagtttggacatgaccgataatagcaacaatcaactggtagtaagagcaaagtttaacttccagcagaccaatgaggacgagctttccttctcaaaaggagacgtcatccatgtcacccgtgtggaagagggaggctggtgggagggcacactcaacggccggaccggctggttccccagcaactacgtgcgcgaggtcaaggccagcgagaagcctgtgtctcccaaatcaggaacactgaagagccctcccaaaggatttgatacgactgccataaacaaaagctattacaatgtggtgctacagaatattttagaaacagaaaatgaatattctaaagaacttcagactgtgctttcaacgtacctacggccattgcagaccagtgagaagttaagttcagcaaacatttcatatttaatgggaaatctagaagaaatatgttctttccagcaaatgctcgtacagtctttagaagaatgcaccaagttgcccgaagctcagcagagagtcggaggctgctttttaaacctgatgccacagatgaaaaccctgtacctcacgtattgtgccaatcacccttctgcagtgaatgtcctcacggaacacagtgaggagttgggggagttcatggagaccaaaggtgccagcagccctgggattctcgtgctgaccacgggcctgagcaaacccttcatgcgcctggataaataccctacgctgctcaaagagctcgagagacacatggaggattatcatacagatagacaagatattcaaaaatccatggctgccttcaaaaacctttcagcccaatgtcaagaagtccggaagaggaaagagcttgagctgcagatcctgacggaagccatccggaactgggagggcgatgacattaaaactctgggcaacgtcacttacatgtcccaggtcctgattcagtgtgccggaagtgaggaaaagaatgaaagatatcttctactcttcccaaatgttttgctaatgttgtctgccagtcctaggatgagtggctttatctatcagggaaagcttccaacgacaggaatgacaatcacaaagcttgaggacagtgaaaatcatagaaatgcatttgaaatatcagggagcatgattgagcggatattagtgtcgtgcaacaaccagcaggatctgcaggaatgggtggagcacctacagaagcaaacgaaggtcacgtctgtgggaaaccccaccataaagcctcattcagtgccatctcataccctcccctcccacccggtcactccgtccagcaagcacgcagacagcaagcccgcgccgctgacgcccgcctaccacacgctgccccacccctcccaccacggcaccccgcacaccaccatcaactggggacccctggagcctccgaaaacacccaagccctggagcctgagctgcctgcggcccgcgcctcccctccggccctcagctgctctctgctacaaggaggatcttagtaagagccctaagaccatgaaaaagctgctgcccaagcgcaaacctgaacggaagccttcagatgaggagttcgcgtcccggaaaagcacagctgctttggaagaagatgctcagattctgaaagtcattgaagcttactgcaccagcgccaaaacaaggcaaacactcaattcaagttcacgcaaagaatctgctccacaagttttgcttccagaagaagagaaaattatagtggaagaaactaaaagtaatggtcagacagtgatagaagaaaagagtcttgtggataccgtatatgcattaaaggatgaagttcaagaattaagacaggacaacaaaaagatgaagaaatctctagaggaagaacagagagcccgcaaagacctggagaagctggtgaggaaagtcctgaagaacatgaatgatcctgcctgggatgagaccaatctataagggatgtcctcagttctttctgttgaagaccagttctgaggtgaagctgggcacccctgacccaagtcggggtgcactcaggaccacagggcagggctgggtggggcgccaccttgctctctgtatatagaaaagctggagcttattctgcgaatggagacgatcaaaccatgactgatgaatccagaca

SEQ ID NO: 3681 - DNA, 5375 bp, Homo sapiens
gcggccgaggccggggggcggcggcgggcgcccgcaggttcccgagccgctcctgagaaggcgcctgacagcgggccggggcgcacggagaagcgggccgggccggacctgctgggccgcgccgagccaatcgccggcgccggccgctcgatgggcgaggcggcggcggcggcggcgggggccgcgggccgggccgccgctccgaggtgaaggcgcgcgcccctccccgcctgcctcccgggccgcagcgatgaattccgccgagcaaaccgttacgtggctcatcactctgggggtgctggagtcgcccaaaaaaaccatctcggacccggagggctttctgcaggcgtcgctgaaggatggggtggtcctctgcaggctgctggagcgcctgctccccgggaccatcgagaaaacgtttgatgcaaatgatttgtatcaggggcagaattttaacaaggtcctcagttccttagtgactctaaataaagtaacagcagacatcgggctggggagtgactccgtgtgtgcccggccctcgtctcaccgcataaagtcttttgactcccttggatcacagtctttgcacactcggacttcaaaactgttccagggccagtatcggagtttggacatgaccgataatagcaacaatcaactggtagtaagagcaaagtttaacttccagcagaccaatgaggacgagctttccttctcaaaaggagacgtcatccatgtcacccgtgtggaagagggaggctggtgggagggcacactcaacggccggaccggctggttccccagcaactacgtgcgcgaggtcaaggccagcgagaagcctgtgtctcccaaatcaggaacactgaagagccctcccaaaggatttgatacgactgccataaacaaaagctattacaatgtggtgctacagaatattttagaaacagaaaatgaatattctaaagaacttcagactgtgctttcaacgtacctacggccattgcagaccagtgagaagttaagttcagcaaacatttcatatttaatgggaaatctagaagaaatatgttctttccagcaaatgctcgtacagtctttagaagaatgcaccaagttgcccgaagctcagcagagagtcggaggctgctttttaaacctgatgccacagatgaaaaccctgtacctcacgtattgtgccaatcacccttctgcagtgaatgtcctcacggaacacagtgaggagttgggggagttcatggagaccaaaggtgccagcagccctgggattctcgtgctgaccacgggcctgagcaaacccttcatgcgcctggataaataccctacgctgctcaaagagctcgagagacacatggaggattatcatacagatagacaagatattcaaaaatccatggctgccttcaaaaacctttcagcccaatgtcaagaagtccggaagaggaaagagcttgagctgcagatcctgacggaagccatccggaactgggagggcgatgacattaaaactctgggcaacgtcacttacatgtcccaggtcctgattcagtgtgccggaagtgaggaaaagaatgaaagatatcttctactcttcccaaatgttttgctaatgttgtctgccagtcctaggatgagtggctttatctatcagggaaagcttccaacgacaggaatgacaatcacaaagcttgaggacagtgaaaatcatagaaatgcatttgaaatatcagggagcatgattgagcggatattagtgtcgtgcaacaaccagcaggatctgcaggaatgggtggagcacctacagaagcaaacgaaggtcacgtctgtgggaaaccccaccataaagcctcattcagtgccatctcataccctcccctcccacccggtcactccgtccagcaagcacgcagacagcaagcccgcgccgctgacgcccgcctaccacacgctgccccacccctcccaccacggcaccccgcacaccaccatcaactggggacccctggagcctccgaaaacacccaagccctggagcctgagctgcctgcggcccgcgcctcccctccggccctcagctgctctctgctacaaggaggatcttagtaagagccctaagaccatgaaaaagctgctgcccaagcgcaaacctgaacggaagccttcagatgaggagttcgcgtcccggaaaagcacagctgctttggaagaagatgctcagattctgaaagtcattgaagcttactgcaccagcgccaaaacaaggcaaacactcaattcaacatggcaaggcactgacctgatgcataatcacgtcttggctgatgatgaccaaccaagcctagactccctggggcgtcgcagtagcctttctcgtttggagccttcagacctctcggaagactctgactatgacagtatatggacagcccatagttacagaatgggttctacatctcgtaagagctgttgctcatatatctctcaccagaactaatgcacttctgagcttttcttaacaaatgcttgttgtatcgcagcctgcttttcttagatgttttcttgctgttccttgtctcttttatgtgatattttaacaacttttgagagtgttcctgatatttcccattgtactttgtggaggcttaactgccgatgcgagtatacattcgaatgactgactattggagggaggtggtgtgttcacgtgagcctacatccgagggtgctcttcgtaaggggtagttgttgttttatagctccaaatggtttttttattctcagtgtagcaactgtttgatttctttctggatacagctgtatgaacacttttctattttatactgaaatcacacaggtttgtgatctaagtgccagaaccatggaggagactctggccttatctgtagggacctaaattttttaagtgctatgaacactgatcaagtagttgtggagagatgagaagaatatatgcagcaaaggtgctgtgagcccagttccaacggctgtgttctggtaatcgtgcagaacagcatgtgggctctgggccttggcaggtgcacagacgggcgggcgtcacgtgtgttcagagcttgtctccacctcacggctctgtgctcttctgtgtgctgcgttgtggccgtgaagtgggagctctcctttccaaaggcagagcttactgtcatggctcagatgttcactcgcatcttcaccccaaacttccctgaattgcagtgatttctgttataaggcacatagcaagcctgtaccactctacagtaaaatctctacactaacagtttaaagcccgaaagctgaagcattcagcctctgcaagtgtagactactggactgtagtagaggcatttggaatacttacaaagtcaagtgctgtggcttcagttcccccggctccccacccctgacatccatacttatgttgtctggaagagccatggacacatcattattttcagcaaccagctgcagtgaaactccatttacagcaaccccatagtataaaaccacaatgcctcattgtaatgggatattgaagttcattgaagaattactaggttgccatgtggctcacttatttaaaaaaaaaaaaaaaaaactcacccgttttcctgggatttgttgtaaggagttttcactggcctcactcagaccaatttctgcttcaaaaagcactgaatgtgacctgttgcattcagttgtagcatcaaatccacacctagtcattgcttgaggggccaaattgtgttctgtcccatgcacgctctatttggtgttaaaatggaaccttacggttgtgttttaagtattcattgaaaccagcttcagaaaacaagatgccatagtaaattgagaataacattttttccttcttcagggtggctgtaattccaggtggccgtgatttctttcttccccactgcccactccttcgccaaacccacgtattcagtgttctgatcttgtttgtgcagagtgaactctgatgcagtatcagtcttgtcctgggagccgggtcctgctgctcacaagcccagagctgccagggagctcctggcagtagcacgttgtttagaaagttgggtggcttcattcagcatggaacaagctaatggcacaggagacatcagggcagctgttaattccaaatatttgttcccaagtagctactgaactgctcacaccattggaagattttgtattttcataccaattagtaaaaataagaacattgaggagcagtcagagcccagtgttaatctccggcagagatggggtttatgtatgttcagccagatagtaaatgggatttttggagaaataagataactacaaagtttctatacttactataagtggatttagaagcgattttggttttgtattacatacggtagtcctctgcgtcagggagcacttttttgtttgcctcgagactactcattagcgcactggctaagctgcctttgccttctcgtaggcgtgggttgcctgtgtcatgggctgtgtagaccacaacactcaaacacagttgctgcacttggattttcctttaataccaagtatcatttggttatcttactgggacattttcattgatattctatacaccaaagttttgacggtttaccatcattccattttgtaccagttaaaggcattttgatgatgctttttcttgatgctaagatcactgcagaagaataacctgaccttttctttgcatttgttttgaatgtctaacaccattagcttttgtgatctggttaagaagtattagtgccacaagcctgaaaagacagttctcctgtggcagtggcgatgtggcatccagagggccattgtttctacttttgtgggacttcagtcatgctgataatagaatcttctgttcatacaattctgtaatatttatttgtacagttagtattctaatgaaaggatgaagagtctgaactagaaggtaggtttaagccatcaccaggcctttgcaaatggcctaaatggtgttccctttgaaataacgcttgccacaagtatataataagctatattaattgtgttttgcataaaattgccaaaacacagtaatgtgtatatagtggtataagatcttgaaaaaaatctctataattgtgctctttatctgtgaatgggaaaagccatttttagtaggtgactaccatttgaaaaactcaattggatgtatatctgaatgttgcattgtattgtacagtatgcatattattgtttgtggttgcatatggcaatgaagtgtttgttttatattaaaaaaaacctgttatgtacagttgaaataaattttgcatttgctagcc

SEQ ID NO: 3682 - DNA, 5525 bp, Homo sapiens
gcggccgaggccggggggcggcggcgggcgcccgcaggttcccgagccgctcctgagaaggcgcctgacagcgggccggggcgcacggagaagcgggccgggccggacctgctgggccgcgccgagccaatcgccggcgccggccgctcgatgggcgaggcggcggcggcggcggcgggggccgcgggccgggccgccgctccgaggtgaaggcgcgcgcccctccccgcctgcctcccgggccgcagcgatgaattccgccgagcaaaccgttacgtggctcatcactctgggggtgctggagtcgcccaaaaaaaccatctcggacccggagggctttctgcaggcgtcgctgaaggatggggtggtcctctgcaggctgctggagcgcctgctccccgggaccatcgagaaagtctaccccgagccccggagcgagagcgagtgcctgagcaacatccgcgagttcctgcgcggctgcggggcttccctgcggctggagctcctgtttcctccttcccagcctcctcagcatctggtaaccaccattctcttgtctgcttctacgtttgatgcaaatgatttgtatcaggggcagaattttaacaaggtcctcagttccttagtgactctaaataaagtaacagcagacatcgggctggggagtgactccgtgtgtgcccggccctcgtctcaccgcataaagtcttttgactcccttggatcacagtctttgcacactcggacttcaaaactgttccagggccagtatcggagtttggacatgaccgataatagcaacaatcaactggtagtaagagcaaagtttaacttccagcagaccaatgaggacgagctttccttctcaaaaggagacgtcatccatgtcacccgtgtggaagagggaggctggtgggagggcacactcaacggccggaccggctggttccccagcaactacgtgcgcgaggtcaaggccagcgagaagcctgtgtctcccaaatcaggaacactgaagagccctcccaaaggatttgatacgactgccataaacaaaagctattacaatgtggtgctacagaatattttagaaacagaaaatgaatattctaaagaacttcagactgtgctttcaacgtacctacggccattgcagaccagtgagaagttaagttcagcaaacatttcatatttaatgggaaatctagaagaaatatgttctttccagcaaatgctcgtacagtctttagaagaatgcaccaagttgcccgaagctcagcagagagtcggaggctgctttttaaacctgatgccacagatgaaaaccctgtacctcacgtattgtgccaatcacccttctgcagtgaatgtcctcacggaacacagtgaggagttgggggagttcatggagaccaaaggtgccagcagccctgggattctcgtgctgaccacgggcctgagcaaacccttcatgcgcctggataaataccctacgctgctcaaagagctcgagagacacatggaggattatcatacagatagacaagatattcaaaaatccatggctgccttcaaaaacctttcagcccaatgtcaagaagtccggaagaggaaagagcttgagctgcagatcctgacggaagccatccggaactgggagggcgatgacattaaaactctgggcaacgtcacttacatgtcccaggtcctgattcagtgtgccggaagtgaggaaaagaatgaaagatatcttctactcttcccaaatgttttgctaatgttgtctgccagtcctaggatgagtggctttatctatcagggaaagcttccaacgacaggaatgacaatcacaaagcttgaggacagtgaaaatcatagaaatgcatttgaaatatcagggagcatgattgagcggatattagtgtcgtgcaacaaccagcaggatctgcaggaatgggtggagcacctacagaagcaaacgaaggtcacgtctgtgggaaaccccaccataaagcctcattcagtgccatctcataccctcccctcccacccggtcactccgtccagcaagcacgcagacagcaagcccgcgccgctgacgcccgcctaccacacgctgccccacccctcccaccacggcaccccgcacaccaccatcaactggggacccctggagcctccgaaaacacccaagccctggagcctgagctgcctgcggcccgcgcctcccctccggccctcagctgctctctgctacaaggaggatcttagtaagagccctaagaccatgaaaaagctgctgcccaagcgcaaacctgaacggaagccttcagatgaggagttcgcgtcccggaaaagcacagctgctttggaagaagatgctcagattctgaaagtcattgaagcttactgcaccagcgccaaaacaaggcaaacactcaattcaacatggcaaggcactgacctgatgcataatcacgtcttggctgatgatgaccaaccaagcctagactccctggggcgtcgcagtagcctttctcgtttggagccttcagacctctcggaagactctgactatgacagtatatggacagcccatagttacagaatgggttctacatctcgtaagagctgttgctcatatatctctcaccagaactaatgcacttctgagcttttcttaacaaatgcttgttgtatcgcagcctgcttttcttagatgttttcttgctgttccttgtctcttttatgtgatattttaacaacttttgagagtgttcctgatatttcccattgtactttgtggaggcttaactgccgatgcgagtatacattcgaatgactgactattggagggaggtggtgtgttcacgtgagcctacatccgagggtgctcttcgtaaggggtagttgttgttttatagctccaaatggtttttttattctcagtgtagcaactgtttgatttctttctggatacagctgtatgaacacttttctattttatactgaaatcacacaggtttgtgatctaagtgccagaaccatggaggagactctggccttatctgtagggacctaaattttttaagtgctatgaacactgatcaagtagttgtggagagatgagaagaatatatgcagcaaaggtgctgtgagcccagttccaacggctgtgttctggtaatcgtgcagaacagcatgtgggctctgggccttggcaggtgcacagacgggcgggcgtcacgtgtgttcagagcttgtctccacctcacggctctgtgctcttctgtgtgctgcgttgtggccgtgaagtgggagctctcctttccaaaggcagagcttactgtcatggctcagatgttcactcgcatcttcaccccaaacttccctgaattgcagtgatttctgttataaggcacatagcaagcctgtaccactctacagtaaaatctctacactaacagtttaaagcccgaaagctgaagcattcagcctctgcaagtgtagactactggactgtagtagaggcatttggaatacttacaaagtcaagtgctgtggcttcagttcccccggctccccacccctgacatccatacttatgttgtctggaagagccatggacacatcattattttcagcaaccagctgcagtgaaactccatttacagcaaccccatagtataaaaccacaatgcctcattgtaatgggatattgaagttcattgaagaattactaggttgccatgtggctcacttatttaaaaaaaaaaaaaaaaaactcacccgttttcctgggatttgttgtaaggagttttcactggcctcactcagaccaatttctgcttcaaaaagcactgaatgtgacctgttgcattcagttgtagcatcaaatccacacctagtcattgcttgaggggccaaattgtgttctgtcccatgcacgctctatttggtgttaaaatggaaccttacggttgtgttttaagtattcattgaaaccagcttcagaaaacaagatgccatagtaaattgagaataacattttttccttcttcagggtggctgtaattccaggtggccgtgatttctttcttccccactgcccactccttcgccaaacccacgtattcagtgttctgatcttgtttgtgcagagtgaactctgatgcagtatcagtcttgtcctgggagccgggtcctgctgctcacaagcccagagctgccagggagctcctggcagtagcacgttgtttagaaagttgggtggcttcattcagcatggaacaagctaatggcacaggagacatcagggcagctgttaattccaaatatttgttcccaagtagctactgaactgctcacaccattggaagattttgtattttcataccaattagtaaaaataagaacattgaggagcagtcagagcccagtgttaatctccggcagagatggggtttatgtatgttcagccagatagtaaatgggatttttggagaaataagataactacaaagtttctatacttactataagtggatttagaagcgattttggttttgtattacatacggtagtcctctgcgtcagggagcacttttttgtttgcctcgagactactcattagcgcactggctaagctgcctttgccttctcgtaggcgtgggttgcctgtgtcatgggctgtgtagaccacaacactcaaacacagttgctgcacttggattttcctttaataccaagtatcatttggttatcttactgggacattttcattgatattctatacaccaaagttttgacggtttaccatcattccattttgtaccagttaaaggcattttgatgatgctttttcttgatgctaagatcactgcagaagaataacctgaccttttctttgcatttgttttgaatgtctaacaccattagcttttgtgatctggttaagaagtattagtgccacaagcctgaaaagacagttctcctgtggcagtggcgatgtggcatccagagggccattgtttctacttttgtgggacttcagtcatgctgataatagaatcttctgttcatacaattctgtaatatttatttgtacagttagtattctaatgaaaggatgaagagtctgaactagaaggtaggtttaagccatcaccaggcctttgcaaatggcctaaatggtgttccctttgaaataacgcttgccacaagtatataataagctatattaattgtgttttgcataaaattgccaaaacacagtaatgtgtatatagtggtataagatcttgaaaaaaatctctataattgtgctctttatctgtgaatgggaaaagccatttttagtaggtgactaccatttgaaaaactcaattggatgtatatctgaatgttgcattgtattgtacagtatgcatattattgtttgtggttgcatatggcaatgaagtgtttgttttatattaaaaaaaacctgttatgtacagttgaaataaattttgcatttgctagcc

SEQ ID NO: 3683 - DNA, 4921 bp, Homo sapiens
gatggtggaaagtgaggagaagcaaaaagacgactacttctttccccatttcccggtctggtctttttggggtctactacgtagaggtgcatcagccagcgctaccatggaggcaggaggcattcttttgctctcgtacgtttgatgcaaatgatttgtatcaggggcagaattttaacaaggtcctcagttccttagtgactctaaataaagtaacagcagacatcgggctggggagtgactccgtgtgtgcccggccctcgtctcaccgcataaagtcttttgactcccttggatcacagtctttgcacactcggacttcaaaactgttccagggccagtatcggagtttggacatgaccgataatagcaacaatcaactggtagtaagagcaaagtttaacttccagcagaccaatgaggacgagctttccttctcaaaaggagacgtcatccatgtcacccgtgtggaagagggaggctggtgggagggcacactcaacggccggaccggctggttccccagcaactacgtgcgcgaggtcaaggccagcgagaagcctgtgtctcccaaatcaggaacactgaagagccctcccaaaggatttgatacgactgccataaacaaaagctattacaatgtggtgctacagaatattttagaaacagaaaatgaatattctaaagaacttcagactgtgctttcaacgtacctacggccattgcagaccagtgagaagttaagttcagcaaacatttcatatttaatgggaaatctagaagaaatatgttctttccagcaaatgctcgtacagtctttagaagaatgcaccaagttgcccgaagctcagcagagagtcggaggctgctttttaaacctgatgccacagatgaaaaccctgtacctcacgtattgtgccaatcacccttctgcagtgaatgtcctcacggaacacagtgaggagttgggggagttcatggagaccaaaggtgccagcagccctgggattctcgtgctgaccacgggcctgagcaaacccttcatgcgcctggataaataccctacgctgctcaaagagctcgagagacacatggaggattatcatacagatagacaagatattcaaaaatccatggctgccttcaaaaacctttcagcccaatgtcaagaagtccggaagaggaaagagcttgagctgcagatcctgacggaagccatccggaactgggagggcgatgacattaaaactctgggcaacgtcacttacatgtcccaggtcctgattcagtgtgccggaagtgaggaaaagaatgaaagatatcttctactcttcccaaatgttttgctaatgttgtctgccagtcctaggatgagtggctttatctatcagggaaagcttccaacgacaggaatgacaatcacaaagcttgaggacagtgaaaatcatagaaatgcatttgaaatatcagggagcatgattgagcggatattagtgtcgtgcaacaaccagcaggatctgcaggaatgggtggagcacctacagaagcaaacgaaggtcacgtctgtgggaaaccccaccataaagcctcattcagtgccatctcataccctcccctcccacccggtcactccgtccagcaagcacgcagacagcaagcccgcgccgctgacgcccgcctaccacacgctgccccacccctcccaccacggcaccccgcacaccaccatcaactggggacccctggagcctccgaaaacacccaagccctggagcctgagctgcctgcggcccgcgcctcccctccggccctcagctgctctctgctacaaggaggatcttagtaagagccctaagaccatgaaaaagctgctgcccaagcgcaaacctgaacggaagccttcagatgaggagttcgcgtcccggaaaagcacagctgctttggaagaagatgctcagattctgaaagtcattgaagcttactgcaccagcgccaaaacaaggcaaacactcaattcaagttcacgcaaagaatctgctccacaagttttgcttccagaagaagagaaaattatagtggaagaaactaaaagtaatggtcagacagtgatagaagaaaagagtcttgtggataccgtatatgcattaaaggatgaagttcaagaattaagacaggacaacaaaaagatgaagaaatctctagaggaagaacagagagcccgcaaagacctggagaagctggtgaggaaagtcctgaagaacatgaatgatcctgcctgggatgagaccaatctataagggatgtcctcagttctttctgttgaagaccagttctgaggtgaagctgggcacccctgacccaagtcggggtgcactcaggaccacagggcagggctgggtggggcgccaccttgctctctgtatatagaaaagctggagcttattctgcgaatggagacgatcaaaccatgactgatgaatccagacaggagggattgactctgaggacctgagctacatcaatccactctgtgaacatctcagttacctcattctgcaataagttcagtgactgactaaaagtcttgtttttccagactttgaattgaatatataaatattatatatacatgtttcttgtaaatatcccattttgaatgcatacctgtggtggttctgtccgggctaatccccatgctagaatgtcctttccagctacgtgaataagaagtcccatgcccgcatccaccggaagcagaagcctggtggatgcctggttcgttccgcagcaccagggcctccaccgtgctgtggcagcaccccccatgtcggtatttctaaataaccttatttatacctgcagagatacacttcagtcccattcagaagtcttctcttaaagcagcattacagtcccagacctgcgggtttctgagggcaacttgctggctgacagactcagtcttgacctcaaggaaggcccatacggcactgccgcatccacctagaggtgtttgctcttgtccgctgtctgagtactgtgattctcagatgagtttgctgcgttttgggaggacacagacggttctgtataggctagttcagtaacaacaaaatacactgttttgtcttccctcaaagagagatcttactagaacctgtaaatagaatgtattatttattataagtcactgcagctgatgaaaacagatggaggccatgctgcaggctgatactgatgggtggagttttgtcatcaggccagcctcatcccgaggtctcctccaccattggccgtagccagcaggcttcagtgctcaccgaaagtaaaatcccctccttcagcaagaataaagcaatatacaccttaggttccactaagtaacataggcataagcagggaacgtttcccccactgtgttccagtgcagaggagacgaagcctgtcctcaccgcggctcgctgggcccaggctggctctggaaagcctgtgcggtcctgggcaggaagcccggcccgtggagcaggttttcgttctgcttcagcaataaataagggtgaccacagggactttgcttttggtttcctttcctgtgaaaaggttggttttaaagtgagatacacttttccgtagaacaagtgttctatctttaaaaacccaaattgcagcaccgtggattactggtctcagaacaactcattgcgcatcagatttgactctctgattttctgtctattggccaaattgccctttaactgcacctgaatcctttgtgtactgatgcctttgagctgggcaccttgggagagtgttgtgttgctgtttacggttcttccttgcccttgctaattacagtctctggtgcccagcaagcccctttggcttccttccgtgactggtcacgttgtctgcctgggctcagcgtggacctgccccatgctgcagaacctggcctcacctggacttttcactagaattgccagcttcctcaacttagcagatcattcactcatgcgggcacaagcaaagatcaacactttcttttttggtaagcttgagttttacaagttattttttggtgatgcgtaagacattgcagtgggaaaccattcaacttgagtttattggagtttgctgttgtagcaggttttaactcaggaacaactcttgtctgatctctccgcccctctgccgggaggcgacattaactgtcctctcggagccggtagcgttgctgtccgagtccccaggacggatctcctgcagacctgccttaatgctcagatcgaagtatttcacaagaatacttgtgtttttaacagcccttcccctggacggtgcggccatgagggcctcatgttacggcattgccttttctttctgtggatccagtatcttcctcggctttttagggagcaggaaaaatgcgtctgagagcaactctttttaaaaacctgccctgttgtatataactgtgtctgtttcaccgtgtgacctcccaagggggtgggaacttgatataaacgtttaaaggggccacgatttgcccgagggttactcctttgctctcaccttgtatggatgaggagatgaagccatttcttatcctgtagatgtgaagcactttcagttttcagcgatgttggaatgtagcatcagaagctcgttccttcacactcagtggcgtctgtgcttgtccacatgcgctgggcgtctgggaccttgaatgcctgccctggttgtgtggactccttaatgccaatcatttcttcacttctctgggacacccagggcgcctgttgacaagtgtggagaaactcctaatttaaatgtcacagacaatgtcctagtgttgactactacaatgttgatgctacactgttgtaattattaaactgattatttttcttatgtcacagaa

SEQ ID NO: 3684 - DNA, 682 bp, Homo sapiens
tgggcgaggcggcggcggcggcggcgggggccgcgggccgggccgccgctccgaggtgaaggcgcgcgcccctccccgcctgcctcccgggccgcagcgatgaattccgccgagcaaaccgttacgtggctcatcactctgggggtgctggagtcgcccaaaaaaaccatctcggacccggagggctttctgcaggcgtcgctgaaggatggggtggtcctctgcaggctgctggagcgcctgctccccgggaccatcgagaaaacgtttgatgcaaatgatttgtatcaggggcagaattttaacaaggtcctcagttccttagtgactctaaataaagtaacagcagacatcgggctggggagtgactccgtgtgtgcccggccctcgtctcaccgcataaagtcttttgactcccttggatcacagtctttgcacactcggacttcaaaactgttccagggccagtatcggagtttggacatgaccgataatagcaacaatcaactggtagtaagagcaaagtttaacttccagcagaccaatgaggacgagctttccttctcaaaaggagacgtcatccatgtcacccgtgtggaagagggaggctggtgggagggcacactcaacggccggaccggctggttccccagcaactacgtgcgcgaggtcaaggccagcg

SEQ ID NO: 3685 - DNA, 1681 bp, Homo sapiens
gagattggtgcagccccggaggaagaaaaaagggtctaccccgagccccggagcgagagcgagtgcctgagcaacatccgcgagttcctgcgcggctgcggggcttccctgcggctggagacgtttgatgcaaatgatttgtatcaggggcagaattttaacaaggtcctcagttccttagtgactctaaataaagtaacagcagacatcgggctggggagtgactccgtgtgtgcccggccctcgtctcaccgcataaagtcttttgactcccttggatcacagtctttgcacactcggacttcaaaactgttccagggccagtatcggagtttggacatgaccgataatagcaacaatcaactggtagtaagagcaaagtttaacttccagcagaccaatgaggacgagctttccttctcaaaaggagacgtcatccatgtcacccgtgtggaagagggaggctggtgggagggcacactcaacggccggaccggctggttccccagcaactacgtgcgcgaggtcaaggccagcgagaagcctgtgtctcccaaatcaggaacactgaagagccctcccaaaggatttgatacgactgccataaacaaaagctattacaatgtggtgctacagaatattttagaaacagaaaatgaatattctaaagaacttcagactgtgctttcaacgtacctacggccattgcagaccagtgagaagttaagttcagcaaacatttcatatttaatgggaaatctagaagaaatatgttctttccagcaaatgctcgtacagtctttagaagaatgcaccaagttgcccgaagctcagcagagagtcggaggctgctttttaaacctgatgccacagatgaaaaccctgtacctcacgtattgtgccaatcacccttctgcagtgaatgtcctcacggaacacagtgaggagttgggggagttcatggagaccaaaggtgccagcagccctgggattctcgtgctgaccacgggcctgagcaaacccttcatgcgcctggataaataccctacgctgctcaaagagctcgagagacacatggaggattatcatacagatagacaagatattcaaaaatccatggctgccttcaaaaacctttcagcccaatgtcaagaagtccggaagaggaaagagcttgagctgcagatcctgacggaagccatccggaactgggagggcgatgacattaaaactctgggcaacgtcacttacatgtcccaggtcctgattcagtgtgccggaagtgaggaaaagaatgaaagatatcttctactcttcccaaatgttttgctaatgttgtctgccagtcctaggatgagtggctttatctatcagggaaagcttccaacgacaggaatgacaatcacaaagcttgaggacagtgaaaatcatagaaatgcatttgaaatatcagggagcatgattgagcggatattagtgtcgtgcaacaaccagcaggatctgcaggaatgggtggagcacctacagaagcaaacgaaggtcacgtctgtgggaaaccccaccataaagcctcattcagtgccatctcataccctcccctcccacccggtcactccgtccagcaagcacgcagacagcaagcccgcgccgctgacgcccgcctaccacacgctgccccacc

SEQ ID NO: 3686 - DNA, 691 bp, Homo sapiens
acacttcagatgggggatagtccaggctggtggtggagctcccaggggatttcgcttctgggtagaattgtcatttttttttttcctcagagactgttgtgtgggcctagtggtgcatcaggttccggttagaatccagtgcaggccgcaggcttctctttaattagagagggtcacttcacctccggttagaatccagtgcaggcagcagcttctttttaattagagaggggtctgggtgctgagcttcccatcaggaagaaggggctgtcgtgctgaagtcctgagacgtttgatgcaaatgatttgtatcaggggcagaattttaacaaggtcctcagttccttagtgactctaaataaagtaacagcagacatcgggctggggagtgactccgtgtgtgcccggccctcgtctcaccgcataaagtcttttgactcccttggatcacagtctttgcacactcggacttcaaaactgttccagggccagtatcggagtttggacatgaccgataatagcaacaatcaactggtagtaagagcaaagtttaacttccagcagaccaatgaggacgagctttccttctcaaaaggagacgtcatccatgtcacccgtgtggaagagggaggctggtgggagggcacactcaacggccggaccggctggttccccagcaactacgtgcgcg

SEQ ID NO: 3687 - DNA, 581 bp, Homo sapiens
acttccggcgccggggctcacttcctggtgcgggaaggggcagagattggtgcagccccggaggaagaaaaaagggtctaccccgagccccggagcgagagcgagtgcctgagcaacatccgcgagttcctgcgcggctgcggggcttccctgcggctggagacgtttgatgcaaatgatttgtatcaggggcagaattttaacaaggtcctcagttccttagtgactctaaataaagtaacagcagtgtcttatgaagggagatccagagaacagaactaagcctcttactgtctgtttactttgattctgtcagcaacttcatgagacatcgggctggggagtgactccgtgtgtgcccggccctcgtctcaccgcataaagtcttttgactcccttggatcacagtctttgcacactcggacttcaaaactgttccagggccagtatcggagtttggacatgaccgataatagcaacaatcaactggtagtaagagcaaagtttaacttccagcagaccaatgaggacgagctttccttctcaaaaggagacgtcatccatgtcacccgtgtggaaga

SEQ ID NO: 3688 - DNA, 1501 bp, Homo sapiens
gagattggtgcagccccggaggaagaaaaaagggtctaccccgagccccggagcgagagcgagtgcctgagcaacatccgcgagttcctgcgcggctgcggggcttccctgcggctggagacgtttgatgcaaatgatttgtatcaggggcagaattttaacaaggtcctcagttccttagtgactctaaataaagtaacagcaggacatgaccgataatagcaacaatcaactggtagtaagagcaaagtttaacttccagcagaccaatgaggacgagctttccttctcaaaaggagacgtcatccatgtcacccgtgtggaagagggaggctggtgggagggcacactcaacggccggaccggctggttccccagcaactacgtgcgcgaggtcaaggccagcgagaagcctgtgtctcccaaatcaggaacactgaagagccctcccaaaggatttgatacgactgccataaacaaaagctattacaatgtgccagtacttagccgcggagcggaaagcagtgctcatgaaggtggaggcacacccagagactgcatggaggtggaaccgggaagtccggggtctgaggtcctgcctgcagggttgaaaggcatgcctgccagcagacacatttgggagccagagtgtgctgtggtctgaatgtgtttccccagatcatctgttactacagatgatcaccaattggatggtattaaaagcacacgtgcccctgctccgggttgttgctgttgtccttcagaaactctgaggtctggagaggttgcccgaagctcagcagagagtcggaggctgctttttaaacctgatgccacagatgaaaaccctgtacctcacgtattgtgccaatcacccttctgcagtgaatgtcctcacggaacacaggattatcatacagatagacaagatattcaaaaatccatggctgccttcaaaaacctttcagcccaatgtcaagaagtccggaagaggaaagagcttgagctgcagatcctgacggaagccatccggaactgggagggcgatgacattaaaactctgggcaacgtcacttacatgtcccaggtcctgattcagtgtgccggaagtgaggaaaagaatgaaagatatcttctactcttcccaaatgttttgctaatgttgtctgccagtcctaggatgagtggctttatctatcagggagcatgattgagcggatattagtgtcgtgcaacaaccagcaggatctgcaggaatgggtggagcacctacagaagcaaacgaaggtcacgtctgtgggaaaccccaccataaagcctcattcagtgccatctcataccctcccctcccacccggtcactccgtccagcaagcacgcagacagcaagcccgcgccgctgacgcccgcctaccacacgctgccccacccctcccaccacggcaccccgcacaccaccatcaactggggacccctggagcctccgaaaacacccaagccct

SEQ ID NO: 3689 - DNA, 5020 bp, Homo sapiens
attccgccgagcaaaccgttacgtggctcatcactctgggggtgctggagtcgcccaaaaaccatctcggacccggagggctttctgcaggcgtcgctgaaggatggggtggtcctctgcaggctgctggagcgcctgctccccgggaccatcgagaaagtctaccccgagccccggagcgagagcgagtgcctgagcaacatccgcgagttcctgcgcggctgcggggcttccctgcggctggagacgtttgatgcaaatgatttgtatcaggggcagaattttaacaaggtcctcagttccttagtgactctaaataaagtaacagcagacatcgggctggggagtgactccgtgtgtgcccggccctcgtctcaccgcataaagtcttttgactcccttggatcacagtctttgcacactcggacttcaaaactgttccagggccagtatcggagtttggacatgaccgataatagcaacaatcaactggtagtaagagcaaagtttaacttccagcagaccaatgaggacgagctttccttctcaaaaggagacgtcatccatgtcacccgtgtggaagagggaggctggtgggagggcacactcaacggccggaccggctggttccccagcaactacgtgcgcgaggtcaaggccagcgagaagcctgtgtctcccaaatcaggaacactgaagagccctcccaaaggatttgatacgactgccataaacaaaagctattacaatgtggtgctacagaatattttagaaacagaaaatgaatattctaaagaacttcagactgtgctttcaacgtacctacggccattgcagaccagtgagaagttaagttcagcaaacatttcatatttaatgggaaatctagaagaaatatgttctttccagcaaatgctcgtacagtctttagaagaatgcaccaagttgcccgaagctcagcagagagtcggaggctgctttttaaacctgatgccacagatgaaaaccctgtacctcacgtattgtgccaatcacccttctgcagtgaatgtcctcacggaacacagtgaggagttgggggagttcatggagaccaaaggtgccagcagccctgggattctcgtgctgaccacgggcctgagcaaacccttcatgcgcctggataaataccctacgctgctcaaagagctcgagagacacatggaggattatcatacagatagacaagatattcaaaaatccatggctgccttcaaaaacctttcagcccaatgtcaagaagtccggaagaggaaagagcttgagctgcagatcctgacggaagccatccggaactgggagggcgatgacattaaaactctgggcaacgtcacttacatgtcccaggtcctgattcagtgtgccggaagtgaggaaaagaatgaaagatatcttctactcttcccaaatgttttgctaatgttgtctgccagtcctaggatgagtggctttatctatcagggaaagcttccaacgacaggaatgacaatcacaaagcttgaggacagtgaaaatcatagaaatgcatttgaaatatcagggagcatgattgagcggatattagtgtcgtgcaacaaccagcaggatctgcaggaatgggtggagcacctacagaagcaaacgaaggtcacgtctgtgggaaaccccaccataaagcctcattcagtgccatctcataccctcccctcccacccggtcactccgtccagcaagcacgcagacagcaagcccgcgccgctgacgcccgcctaccacacgctgccccacccctcccaccacggcaccccgcacaccaccatcaactggggacccctggagcctccgaaaacacccaagccctggagcctgagctgcctgcggcccgcgcctcccctccggccctcagctgctctctgctacaaggaggatcttagtaagagccctaagaccatgaaaaagctgctgcccaagcgcaaacctgaacggaagcctatgaggagttcgcgtcccggaaaagcacagctgctttggaagaagatgctcagattctgaaagtcattgaagcttactgcaccagcgccaaaacaaggcaaacactcaattcaagttcacgcaaagaatctgctccacaagttttgcttccagaagaagagaaaattatagtggaagaaactaaaagtaatggtcagacagtgatagaagaaaagagtcttgtggataccgtatatgcattaaaggatgaagttcaagaattaagacaggacaacaaaaagatgaagaaatctctagaggaagaacagagagcccgcaaagacctggagaagctggtgaggaaagtcctgaagaacatgaatgatcctgcctgggatgagaccaatctataagggatgtcctcagttctttctgttgaagaccagttctgaggtgaagctgggcacccctgacccaagtcggggtgcactcaggaccacagggcagggctgggtggggcgccaccttgctctctgtatatagaaaagctggagcttattctgcgaatggagacgatcaaaccatgactgatgaatccagacaggagggattgactctgaggacctgagctacatcaatccactctgtgaacatctcagttacctcattctgcaataagttcagtgactgactaaaagtcttgtttttccagactttgaattgaatatataaatattatatatacatgtttcttgtaaatatcccattttgaatgcatacctgtggtggttctgtccgggctaatccccatgctagaatgtcctttccagctacgtgaataagaagtcccatgcccgcatccaccggaagcagaagcctggtggatgcctggttcgttccgcagcaccagggcctccaccgtgctgtggcagcaccccccatgtcggtatttctaaataaccttatttatacctgcagagatacacttcagtcccattcagaagtcttctcttaaagcagcattacagtcccagacctgcgggtttctgagggcaacttgctggctgacagactcagtcttgacctcaaggaaggcccatacggcactgccgcatccacctagaggtgtttgctcttgtccgctgtctgagtactgtgattctcagatgagtttgctgcgttttgggaggacacagacggttctgtataggctagttcagtaacaacaaaatacactgttttgtcttccctcaaagagagatcttactagaacctgtaaatagaatgtattatttattataagtcactgcagctgatgaaaacagatggaggccatgctgcaggctgatactgatgggtggagttttgtcatcaggccagcctcatcccgaggtctcctccaccattggccgtagccagcaggcttcagtgctcaccgaaagtaaaatcccctccttcagcaagaataaagcaatatacaccttaggttccactaagtaacataggcataagcagggaacgtttcccccactgtgttccagtgcagaggagacgaagcctgtcctcaccgcggctcgctgggcccaggctggctctggaaagcctgtgcggtcctgggcaggaagcccggcccgtggagcaggttttcgttctgcttcagcaataaataagggtgaccacagggactttgcttttggtttcctttcctgtgaaaaggttggttttaaagtgagatacacttttccgtagaacaagtgttctatctttaaaaacccaaattgcagcaccgtggattactggtctcagaacaactcattgcgcatcagatttgactctctgattttctgtctattggccaaattgccctttaactgcacctgaatcctttgtgtactgatgcctttgagctgggcaccttgggagagtgttgtgttgctgtttacggttcttccttgcccttgctaattacagtctctggtgcccagcaagcccctttggcttccttccgtgactggtcacgttgtctgcctgggctcagcgtggacctgccccatgctgcagaacctggcctcacctggacttttcactagaattgccagcttcctcaacttagcagatcattcactcatgcgggcacaagcaaagatcaacactttcttttttggtaagcttgagttttacaagttattttttggtgatgcgtaagacattgcagtgggaaaccattcaacttgagtttattggagtttgctgttgtagcaggttttaactcaggaacaactcttgtctgatctctccgcccctctgccgggaggcgacattaactgtcctctcggagccggtagcgttgctgtccgagtccccaggacggatctcctgcagacctgccttaatgctcagatcgaagtatttcacaagaatacttgtgtttttaacagcccttcccctggacggtgcggccatgagggcctcatgttacggcattgccttttctttctgtggatccagtatcttcctcggctttttagggagcaggaaaaatgcgtctgagagcaactctttttaaaaacctgccctgttgtatataactgtgtctgtttcaccgtgtgacctcccaagggggtgggaacttgatataaacgtttaaaggggccacgatttgcccgagggttactcctttgctctcaccttgtatggatgaggagatgaagccatttcttatcctgtagatgtgaagcactttcagttttcagcgatgttggaatgtagcatcagaagctcgttccttcacactcagtggcgtctgtgcttgtccacatgcgctgggcgtctgggaccttgaatgcctgccctggttgtgtggactccttaatgccaatcatttcttcacttctctgggacacccagggcgcctgttgacaagtgtggagaaactcctaatttaaatgtcacagacaatgtcctagtgttgactactacaatgttgatgctacactgttgtaattattaaactgattatttttcttatgtc

SEQ ID NO: 3690 - DNA, 6650 bp, Homo sapiens
gctggttccccttccgagcgtccgcgccccgcatgcgcagtctgccccggcggtctccgtttgtttgaacaggaaggcggacatattagtccctctcagcccccctcgccccaccccccaggcattcgccgccgcgactcgccctttccccggctgggaccgcagcccctcccagaagctcccccatcagcagccgccgggacccaactatcgtcttcctcttcgcccgctctccagcctttcctctgctaagtctccatcgggcatcgacctcgccctgccccaccggacaccgtagcagcagccccagcagcgacgggacaaaatgggagagtgaggctgtcctgcgtggaccagctcgtggccgagactgatcggtgcgtcgggccgggccgagtagagccggggacgcggggctagaccgtctacagcgcctctgagcggagcgggcccggcccgtggcccgagcggcggccgcagctggcacagctcctcacccgccctttgctttcgcctttcctcttctccctcccttgttgcccggagggagtctccaccctgcttctctttctctacccgctcctgcccatctcgggacggggacccctccatggcgacggcggccggggcccgctagactgaagcacctcgccggagcgacgaggctggtggcgacggcgctgtcggctgtcgtgaggggctgccgggtgggatgcgactttgggcgtccgagcggctgtgggtcgctgttgcccccggcccggggtctggagagcggaggtcccctcagtgaggggaagacgggggaaccgggcgcacctggtgaccctgaggttccggctcctccgccccgcggctgcgaacccaccgcggaggaagttggttgaaattgctttccgctgctggtgctggtaagagggcattgtcacagcagcagcaacatgtcgactggggacagttttgagactcgatttgaaaaaatggacaacctgctgcgggatcccaaatcggaagtgaattcggattgtttgctggatggattggatgctttggtatatgatttggattttcctgccttaagaaaaaacaaaaatattgacaactttttaagcagatataaagacacaataaataaaatcagagatttacgaatgaaagctgaagattatgaagtagtgaaggtgattggtagaggtgcatttggagaagttcaattggtaaggcataaatccaccaggaaggtatatgctatgaagcttctcagcaaatttgaaatgataaagagatctgattctgcttttttctgggaagaaagggacatcatggcttttgccaacagtccttgggttgttcagcttttttatgcattccaagatgatcgttatctctacatggtgatggaatacatgcctggtggagatcttgtaaacttaatgagcaactatgatgtgcctgaaaaatgggcacgattctatactgcagaagtagttcttgcattggatgcaatccattccatgggttttattcacagagatgtgaagcctgataacatgctgctggataaatctggacatttgaagttagcagattttggtacttgtatgaagatgaataaggaaggcatggtacgatgtgatacagcggttggaacacctgattatatttcccctgaagtattaaaatcccaaggtggtgatggttattatggaagagaatgtgactggtggtcggttggggtatttttatacgaaatgcttgtaggtgatacacctttttatgcagattctttggttggaacttacagtaaaattatgaaccataaaaattcacttacctttcctgatgataatgacatatcaaaagaagcaaaaaaccttatttgtgccttccttactgacagggaagtgaggttagggcgaaatggtgtagaagaaatcaaacgacatctcttcttcaaaaatgaccagtgggcttgggaaacgctccgagacactgtagcaccagttgtacccgatttaagtagtgacattgatactagtaattttgatgacttggaagaagataaaggagaggaagaaacattccctattcctaaagctttcgttggcaatcaactaccttttgtaggatttacatattatagcaatcgtagatacttatcttcagcaaatcctaatgataacagaactagctccaatgcagataaaagcttgcaggaaagtttgcaaaaaacaatctataagctggaagaacagctgcataatgaaatgcagttaaaagatgaaatggagcagaagtgcagaacctcaaacataaaactagacaagataatgaaagaattggatgaagagggaaatcaaagaagaaatctagaatctacagtgtctcagattgagaaggagaaaatgttgctacagcatagaattaatgagtaccaaagaaaagctgaacaggaaaatgagaagagaagaaatgtagaaaatgaagtttctacattaaaggatcagttggaagacttaaagaaagtcagtcagaattcacagcttgctaatgagaagctgtcccagttacaaaagcagctagaagaagccaatgacttacttaggacagaatcggacacagctgtaagattgaggaagagtcacacagagatgagcaagtcaattagtcagttagagtccctgaacagagagttgcaagagagaaatcgaattttagagaattctaagtcacaaacagacaaagattattaccagctgcaagctatattagaagctgaacgaagagacagaggtcatgattctgagatgattggagaccttcaagctcgaattacatctttacaagaggaggtgaagcatctcaaacataatctcgaaaaagtggaaggagaaagaaaagaggctcaagacatgcttaatcactcagaaaaggaaaagaataatttagagatagatttaaactacaaacttaaatcattacaacaacggttagaacaagaggtaaatgaacacaaagtaaccaaagctcgtttaactgacaaacatcaatctattgaagaggcaaagtctgtggcaatgtgtgagatggaaaaaaagctgaaagaagaaagagaagctcgagagaaggctgaaaatcgggttgttcagattgagaaacagtgttccatgctagacgttgatctgaagcaatctcagcagaaactagaacatttgactggaaataaagaaaggatggaggatgaagttaagaatctaaccctgcaactggagcaggaatcaaataagcggctgttgttacaaaatgaattgaagactcaagcatttgaggcagacaatttaaaaggtttagaaaagcagatgaaacaggaaataaatactttattggaagcaaagagattattagaatttgagttagctcagcttacgaaacagtatagaggaaatgaaggacagatgcgggagctacaagatcagcttgaagctgagcaatatttctcgacactttataaaacccaggtaaaggaacttaaagaagaaattgaagaaaaaaacagagaaaatttaaagaaaatacaggaactacaaaatgaaaaagaaactcttgctactcagttggatctagcagaaacaaaagctgagtctgagcagttggcgcgaggccttctggaagaacagtattttgaattgacgcaagaaagcaagaaagctgcttcaagaaatagacaagagattacagataaagatcacactgttagtcggcttgaagaagcaaacagcatgctaaccaaagatattgaaatattaagaagagagaatgaagagctaacagagaaaatgaagaaggcagaggaagaatataaactggagaaggaggaggagatcagtaatcttaaggctgcctttgaaaagaatatcaacactgaacgaacccttaaaacacaggctgttaacaaattggcagaaataatgaatcgaaaagattttaaaattgatagaaagaaagctaatacacaagatttgagaaagaaagaaaaggaaaatcgaaagctgcaactggaactcaaccaagaaagagagaaattcaaccagatggtagtgaaacatcagaaggaactgaatgacatgcaagcgcaattggtagaagaatgtgcacataggaatgagcttcagatgcagttggccagcaaagagagtgatattgagcaattgcgtgctaaacttttggacctctcggattctacaagtgttgctagttttcctagtgctgatgaaactgatggtaacctcccagagtcaagaattgaaggttggctttcagtaccaaatagaggaaatatcaaacgatatggctggaagaaacagtatgttgtggtaagcagcaaaaaaattttgttctataatgacgaacaagataaggagcaatccaatccatctatggtattggacatagataaactgtttcacgttagacctgtaacccaaggagatgtgtatagagctgaaactgaagaaattcctaaaatattccagatactatatgcaaatgaaggtgaatgtagaaaagatgtagagatggaaccagtacaacaagctgaaaaaactaatttccaaaatcacaaaggccatgagtttattcctacactctaccactttcctgccaattgtgatgcctgtgccaaacctctctggcatgtttttaagccaccccctgccctagagtgtcgaagatgccatgttaagtgccacagagatcacttagataagaaagaggacttaatttgtccatgtaaagtaagttatgatgtaacatcagcaagagatatgctgctgttagcatgttctcaggatgaacaaaaaaaatgggtaactcatttagtaaagaaaatccctaagaatccaccatctggttttgttcgtgcttcccctcgaacgctttctacaagatccactgcaaatcagtctttccggaaagtggtcaaaaatacatctggaaaaactagttaaccatgtgactgagtgccctgtggaatcgtgtgggatgctacctgataaaccaggcttctttaaccatgcagagcagacaggctgtttctttgacacaaatatcacaggcttcagggttaagattgctgtttttctgtccttgctttggcacaacacactgagggttttttttattgcgggtttgcctacaggtagattagattaattattactatgtaatgcaagtacagttgggggaaagcttaggtagatatattttttttaaaaggtgctgcctttttggatttataagaaaatgcctgtcagtcgtgatagaacagagttttcctcatatgagtaagaggaagggactttcactttcaagtggaacagccatcactatcaagatcagctcatggaaggagtaaagaaaatatctcaaaatgagacaaactgaagttttgttttttttttaatgacttaagtttttgtgctcttgcaagactatacaaaactattttaagaaagcagtgatatcacttgaacttcagtgccctcactgtagaatttaaaagccttactgttgattgcccatgttggacttgatggagaaattaaatatctttcattatgctttacaaaatactgtatatgtttcagcaagtttggggaatgggagaggacaaaaaaaagttacatttaatctatgcatttttgccaagccatattgagttattttactactagagacattaggaaactaactgtacaaaagaaccaagtttaaaagcattttgtggggtacatcatttctataattgtataatgtatttctttgtggttttaaatgataaagacattaagttaacaaacatataagaaatgtatgcactgtttgaaatgtaaattattcttagaacactttcaatgggggttgcattgtccttttagtgccttaatttgagataattattttactgccatgagtaagtatagaaatttcaaaaaatgtattttcaaaaaattatgtgtgtcagtgagtttttcattgataattggtttaatttaaaatatttagaggtttgttggactttcataaattgagtacaatctttgcatcaaactacctgctacaataatgactttataaaactgcaaaaaatgtagaaggttgcaccaacataaaaaggaaatatggcaatacatccatgatgttttccagttaacataggaattaccagataaatactgttaaactcttgtccagtaacaagagttgattcatatggacagtatgatttattgtttatttttttaaccaaatacctcctcagtaatttataatggctttgcagtaatgtgtatcagataagaagcactggaaaaccgatcgtctctaggatgatatgcatgtttcaagtggtattgaaagccgcactgatggatatgtaataataaacatatctgttattaatatactaatgactctgtgctcatttaatgagaaataaaagtaatttatggatgggtatctttaatttttactgcaatgtgttttctcatggctgaaatgaatggaaaacatacttcaaattagtctctgattgtatataaatgtttgtgaaattccatggttagattaaagtgtatttttaaaagataaaa

SEQ ID NO: 3691 - DNA, 1498 bp, Homo sapiens
gtatttgggacatgtaagtggagaggcatgaacctgattcatttcctgatccagtgatgctcccagcccacccccaaacagacacagcgtagcccgggccagctcttaaggagttcaggagtgagaagaggccctcagagatctgacagcctaggagtgcgtggacaccacctcagcccactgagcaggagtcacagcacgaagaccaagcgcaaagcgacccctgccctccatcctgactgctcctcctaagagagatggcaccggccagagcaggattctgcccccttctgctgcttctgctgctggggctgtgggtggcagagatcccagtcagtgccaagcccaagggcatgacctcatcacagtggtttaaaattcagcacatgcagcccagccctcaagcatgcaactcagccatgaaaaacattaacaagcacacaaaacggtgcaaagacctcaacaccttcctgcacgagcctttctccagtgtggccgccacctgccagacccccaaaatagcctgcaagaatggcgataaaaactgccaccagagccacggggccgtgtccctgaccatgtgtaagctcacctcagggaagcatccgaactgcaggtacaaagagaagcgacagaacaagtcttacgtagtggcctgtaagcctccccagaaaaaggactctcagcaattccacctggttcctgtacacttggacagagtcctttaggtttccagactggcttgctctttggctgaccttcaattccctctccaggactccgcaccactcccctacacccagagcattctcttcccctcatctcttggggctgttcctggttcagcctctgctgggaggctgaagctgacactctggtgagctgagctctagagggatggcttttcatctttttgttgctgttttcccagatgcttatccccaagaaacagcaagctcaggtctgtgggttccctggtctatgccattgcacatgtctcccctgccccctggcattagggcagcatgacaaggagaggaaataaatggaaagggggcatatgggatttgtggacacagctgtttctgttcctgaactagaagtcttccccagctctgacgtggcagtgaggtgacctgaaggaaagaaaaatataaataaataccacttcatatttgtatagaatcctctaatcccttgtgacatagacttgacagggattgtatgccttctttatggatgaggaaattaaggttttagaaagcttaatgaattaaagagcttgtctaattagttagtagcagaacctggacttgaacctaggtctccttgctctaaatacagtgtaccttctactctaccagttgcgcaagaaagaagtcactgttacagaggcaagcggtgaactaggtaagagttcactcatgaagaaacgagtgctctgaagagccagttaccctgtgttggctgcaataaaggtcattacctctctagccaa

SEQ ID NO: 3692 - DNA, 922 bp, Homo sapiens
agcccgggccagctcttaaggagttcaggagtgagaagaggccctcagagatctgacagcctaggagtgcgtggacaccacctcagcccactgagcaggagtcacagcacgaagaccaagcgcaaagcgacccctgccctccatcctgactgctcctcctaagagagatggcaccggccagagcaggattctgcccccttctgctgcttctgctgctggggctgtgggtggcagagatcccagtcagtgccaagcccaagggcatgacctcatcacagtggtttaaaattcagcacatgcagcccagccctcaagcatgcaactcagccatgaaaaacattaacaagcacacaaaacggtgcaaagacctcaacaccttcctgcacgagcctttctccagtgtggccgccacctgccagacccccaaaatagcctgcaagaatggcgataaaaactgccaccagagccacggggccgtgtccctgaccatgtgtaagctcacctcagggaagcatccgaactgcaggtacaaagagaagcgacagaacaagtcttacgtagtggcctgtaagcctccccagaaaaaggactctcagcaattccacctggttcctgtacacttggacagagtcctttaggtttccagactggcttgctctttggctgaccttcaattccctctccaggactccgcaccactcccctacacccagagcattctcttcccctcatctcttggggctgttcctggttcagcctctgctgggaggctgaagctgacactctgttgcgcaagaaagaagtcactgttacagaggcaagcggtgaactaggtaagagttcactcatgaagaaacgagtgctctgaagagccagttaccctgtgttggctgcaataaaggtcattacctctctagccaag

SEQ ID NO: 3693 - DNA, 5375 bp, Homo sapiens
ggctgcggcgggtccgggcccatgaggcgacgaaggaggcgggacggcttttacccagccccggacttccgagacagggaagctgaggacatggcaggagtgtttgacatagacctggaccagccagaggacgcgggctctgaggatgagctggaggaggggggtcagttaaatgaaagcatggaccatgggggagttggaccatatgaacttggcatggaacattgtgagaaatttgaaatctcagaaactagtgtgaacagagggccagaaaaaatcagaccagaatgttttgagctacttcgggtacttggtaaagggggctatggaaaggtttttcaagtacgaaaagtaacaggagcaaatactgggaaaatatttgccatgaaggtgcttaaaaaggcaatgatagtaagaaatgctaaagatacagctcatacaaaagcagaacggaatattctggaggaagtaaagcatcccttcatcgtggatttaatttatgcctttcagactggtggaaaactctacctcatccttgagtatctcagtggaggagaactatttatgcagttagaaagagagggaatatttatggaagacactgcctgcttttacttggcagaaatctccatggctttggggcatttacatcaaaaggggatcatctacagagacctgaagccggagaatatcatgcttaatcaccaaggtcatgtgaaactaacagactttggactatgcaaagaatctattcatgatggaacagtcacacacacattttgtggaacaatagaatacatggcccctgaaatcttgatgagaagtggccacaatcgtgctgtggattggtggagtttgggagcattaatgtatgacatgctgactggagcacccccattcactggggagaatagaaagaaaacaattgacaaaatcctcaaatgtaaactcaatttgcctccctacctcacacaagaagccagagatctgcttaaaaagctgctgaaaagaaatgctgcttctcgtctgggagctggtcctggggacgctggagaagttcaagctcatccattctttagacacattaactgggaagaacttctggctcgaaaggtggagcccccctttaaacctctgttgcaatctgaagaggatgtaagtcagtttgattccaagtttacacgtcagacacctgtcgacagcccagatgactcaactctcagtgaaagtgccaatcaggtctttctgggttttacatatgtggctccatctgtacttgaaagtgtgaaagaaaagttttcctttgaaccaaaaatccgatcacctcgaagatttattggcagcccacgaacacctgtcagcccagtcaaattttctcctggggatttctggggaagaggtgcttcggccagcacagcaaatcctcagacacctgtggaatacccaatggaaacaagtggcatagagcagatggatgtgacaatgagtggggaagcatcggcaccacttccaatacgacagccgaactctgggccatacaaaaaacaagcttttcccatgatctccaaacggccagagcacctgcgtatgaatctatgacagagcaatgcttttaatgaatttaaggcaaaaaaggtggagagggagatgtgtgagcatcctgcaaggtgaaacgactcaaaatgacagtttcagagagtcaatgtcattacatagaacacttcagacacaggaaaaataaacgtggattttaaaaaatcaatcaatggtgcaaaaaaaaacttaaagcaaaatagtattgctgaactcttaggcacatcaattaattgattcctcgcgacatcttctcaaccttatcaaggattttcatgttgatgactcgaaactgacagtattaagggtaggatgttgcttctgaatcactgttgagttctgattgtgttgaagaagggttatcctttcattaggcaaagtacaaaattgcctataatacttgcaactaaggacaaattagcatgcaagcttggtcaaactttttccagcaaaatggaagcaaagacaaaagaaacttaccaattgatgttttacgtgcaaacaacctgaatcttttttttatataaatatatatttttcaaatagatttttgattcagctcattatgaaaaacatcccaaactttaaaatgcgaaattattggttggtgtgaagaaagccagacaacttctgtttcttctcttggtgaaataataaaatgcaaatgaatcattgttaaccacagctgtggctcgtttgagggattggggtggacctggggtttattttcagtaacccagctgcaatacctgtctgtaatatgagaaaaaaaaaatgaatctatttaatcatttctacttgcagtactgctatgtgctaagcttaactggaagccttggaatgggcataagttgtatgtcctacatttcatcattgtcccgggcctgcattgcactggaaaaaaaaatcgccacctgttcttacaccagtatttggttcaagacaccaaatgtcttcagcccatggctgaagaacaacagaagagagtcaggataaaaaatacatactgtggtcggcaaggtgagggagatagggatatccaggggaagagggtgttgctgtggcccactctctgtctaatctctttacagcaaattggtaagattttcagttttacttctttctactgtttctgctgtctaccttccttatatttttttcctcaacagttttaaaaagaaaaaaaggtctatttttttttctcctatacttgggctacattttttgattgtaaaaatatttgatggccttttgatgaatgtcttccacagtaaagaaaacttagtggcttaatttaggaaacatgttaacaggacactatgtttttgaaattgtaacaaaatctacataaatgatttacaggttaaaagaataaaaataaaggtaactttacctttcttaaatatttcctgccttaaagagagcatttccatgactttagctggtgaaagggtttaatatctgcagagctttataaaaatatatttcagtgcatactggtataatagatgatcatgcagttgcagttgagttgtatcaccttttttgtttgtcttttataatgtcttcagtctgagtgtgcaaagtcaatttgtaatattttgcaaccctaggatttttttaaatagatgctgcttgctatgttttcaaacctttttgagccataggatccaagccataaaattctttatgcatgttgaattcagtcagaaaagagcaaggctttgctttttgaaattgcaactcaaatgagatgggatgaaatcctatgacagtaagcaaaaacagaaccatgaaaaatgattggacatacaccttttcaattgtggcaataattgaaagaatcgataaaagttcatctttggacagaaagcctttaaaaaaaaaatcactccctcttccccctcctcccttattgcagcagcctactgagaactttgactgttgctggtaaattagaagctacaataataattaagggcagaaattatacttaaaaagtgcagatccttgttctttgacaatttgtgatgtctgaaaaaacagaacccgaaaagctatggtgatatgtacaggcattatttcagactgtaaatggcttgtgatactcttgatacttgttttcaaatatgtttactaactgtagtgttgactgcctgaccaaattccagtgaaacttatacaccaaaatattcttcctaggtcctatttgctagtaacatgagcactgtgattggctggctataaccaccccagttaaaccattttcataattagtagtgccagcaatagtggcaaacactgcaacttttctgcataaaaagcattaattgcacagctaccatccacacaaatacatagtttttctgacttcacatttattaagtgaaatttatttcccatgctgtggaaagtttattgagaacttgtttcataaatggatatccctactatgactgtgaaaacatgtcaagtgtcacattagtgtcacagacagaaagcacacacctatgcaatatggcttatctatatttatttgtaaaaatccaagcatagtttaaaatatgatgtcgatattactagtcttgagtttctaagagggttctttatgttataccaggtaagtgtataaaagagattaagtgcttttttttcatcacttgattattttctttaaaatcagctattacaggatatttttttattttatacatgctgttttttaattaaaatataatcactgaagtttactaatttgattttataaggtttgtagcattacagaataactaaactgggatttataaaccagctgtgattaacaatgtaaagtattaattattgaactttgaaccagatttttaggaaaattatgttctttttccccctttatggtcttaactaatttgaatccttcaagaaggatttttccatactattttttaagatagaagataatttgtgggcaggggtggaggatgcatgtatgatactccataaattcaacattctttactataggtaatgaatgattataaacaagatgcatcttagatagtattaatatactgagccttggattatatatttaatataggacctattttgaatattcagttaatcatatggttcctagcttacaagggctagatctaagattattcccatgagaaatgttgaatttatgaagaatagattttaaggctttgaaaatggttaatttctcaaaaacatcaatgtccaaacatctaccttttttcataggagtagacactagcaagctggacaaactatcacaaaagtatttgtcacacataacctgtggtctgttgctgattaatacagtactttttcttgtgtgattcttaacattatagcacaagtattatctcagtggattatccggaataacatctgaaagatgggttcatctatgtttgtgtttgctctttaaactattgtttctcctatcccaagttcgctttgcatctatcagtaaataaaattcttcagctgccttattaggagtgctatgagggtaacacctgttctgcttttcatcttgtatttagttgactgtattatttgatttcggattgaatgaatgtaaatagaaattaaatgcaaatttgaatgaacataaatagaagtgatttatttttttattatcttaaagataggaaggaattagtatacgtatcaggtgtataaatggtttaaatttattttaacatgtcagatgtgttcaagttgtcatataaataaactatgtatgtaaggaa

SEQ ID NO: 3694 - DNA, 2046 bp, Homo sapiens
agggaagctgaggacatggcaggagtgtttgacatagacctggaccagccagaggacgcgggctctgaggatgagctggaggagggggaagcgctcagctgttagaagtgacagctgaaaacttctgtcgggagtagcactgccgctgctgttacagccaccaggagttttatttcgggagcaagggggctctgctgcatcttccaatcttccaggggtcagttaaatgaaagcatggaccatgggggagttggaccatatgaacttggcatggaacattgtgagaaatttgaaatctcagaaactagtgtgaacagagggccagaaaaaatcagaccagaatgttttgagctacttcgggtacttggtaaagggggctatggaaaggtttttcaagtacgaaaagtaacaggagcaaatactgggaaaatatttgccatgaaggtgcttaaaaaggcaatgatagtaagaaatgctaaagatacagctcatacaaaagcagaacggaatattctggaggaagtaaagcatcccttcatcgtggatttaatttatgcctttcagactggtggaaaactctacctcatccttgagtatctcagtggaggagaactatttatgcagttagaaagagagggaatatttatggaagacactgcctgcttttacttggcagaaatctccatggctttggggcatttacatcaaaaggggatcatctacagagacctgaagccggagaatatcatgcttaatcaccaaggtcatgtgaaactaacagactttggactatgcaaagaatctattcatgatggaacagtcacacacacattttgtggaacaatagaatacatggcccctgaaatcttgatgagaagtggccacaatcgtgctgtggattggtggagtttgggagcattaatgtatgacatgctgactggagcacccccattcactggggagaatagaaagaaaacaattgacaaaatcctcaaatgtaaactcaatttgcctccctacctcacacaagaagccagagatctgcttaaaaagctgctgaaaagaaatgctgcttctcgtctgggagctggtcctggggacgctggagaagttcaagctcatccattctttagacacattaactgggaagaacttctggctcgaaaggtggagcccccctttaaacctctgttgcaatctgaagaggatgtaagtcagtttgattccaagtttacacgtcagacacctgtcgacagcccagatgactcaactctcagtgaaagtgccaatcaggtctttctgggttttacatatgtggctccatctgtacttgaaagtgtgaaagaaaagttttcctttgaaccaaaaatccgatcacctcgaagatttattggcagcccacgaacacctgtcagcccagtcaaattttctcctggggatttctggggaagaggtgcttcggccagcacagcaaatcctcagacacctgtggaatacccaatggaaacaagtggcatagagcagatggatgtgacaatgagtggggaagcatcggcaccacttccaatacgacagccgaactctgggccatacaaaaaacaagcttttcccatgatctccaaacggccagagcacctgcgtatgaatctatgacagagcaatgcttttaatgaatttaaggcaaaaaaggtggagagggagatgtgtgagcatcctgcaaggtgaaacgactcaaaatgacagtttcagagagtcaatgtcattacatagaacacttcagacacaggaaaaataaacgtggattttaaaaaatcaatcaatggtgcaaaaaaaaacttaaagcaaaatagtattgctgaactcttaggcacatcaattaattgattcctcgcgacatcttctcaaccttatcaaggattttcatgttgatgactcgaaactgacagtattaagggtaggatgttgcttctgaatcactgttgagttctgattgtgttgaagaagggttatcctttcattaggcaaagtacaaaattgcctataata

SEQ ID NO: 3695 - DNA, 1982 bp, Homo sapiens
tggcggcagcggctgtggtggctgcggcgggtccgggcccatgaggcgacgaaggaggcgggacggcttttacccagccccggacttccgagacagggaagctgaggacatggcaggagtgtttgacatagacctggaccagccagaggacgcgggctctgaggatgagctggaggaggggggtcagttaaatgaaagcatggaccatgggggagttggaccatatgaacttggcatggaacattgtgagaaatttgaaatctcagaaactagtgtgaacagagggccagaaaaaatcagaccagaatgttttgagctacttcgggtacttggtaaagggggctatggaaaggtttttcaagtacgaaaagtaacaggagcaaatactgggaaaatatttgccatgaaggtgcttaaaaaggcaatgatagtaagaaatgctaaagatacagctcatacaaaagcagaacggaatattctggaggaagtaaagcatcccttcatcgtggatttaatttatgcctttcagactggtggaaaactctacctcatccttgagtatctcagtggaggagaactatttatgcagttagaaagagagggaatatttatggaagacactgcctgcttttacttggcagaaatctccatggctttggggcatttacatcaaaaggggatcatctacagagacctgaagccggagaatatcatgcttaatcaccaaggtcatgtgaaactaacagactttggactatgcaaagaatctattcatgatggaacagtcacacacacattttgtggaacaatagaatacatggcccctgaaatcttgatgagaagtggccacaatcgtgctgtggattggtggagtttgggagcattaatgtatgacatgctgactggagcacccccattcactggggagaatagaaagaaaacaattgacaaaatcctcaaatgtaaactcaatttgcctccctacctcacacaagaagccagagatctgcttaaaaagctgctgaaaagaaatgctgcttctcgtctgggagctggtcctggggacgctggagaagttcaagctcatccattctttagacacattaactgggaagaacttctggctcgaaaggtggagcccccctttaaacctctgttgcaatctgaagaggatgtaagtcagtttgattccaagtttacacgtcagacacctgtcgacagcccagatgactcaactctcagtgaaagtgccaatcaggtctttctgggttttacatatgtggctccatctgtacttgaaagtgtgaaagaaaagttttcctttgaaccaaaaatccgatcacctcgaagatttattggcagcccacgaacacctgtcagtactgctatgtgctaagcttaactggaagccttggaatgggcataagttgtatgtcctacatttcatcattgtcccgggcctgcattgcactggaaaaaaaaatcgccacctgttcttacaccagtatttggttcaagacaccaaatgtcttcagcccatggctgaagaacaacagaagagagtcaggataaaaaatacatactgtggtcggcaaggtgagggagatagggatatccaggggaagagggtgttgctgtggcccactctctgtctaatctctttacagcaaattggtaagattttcagttttacttctttctactgtttctgctgtctaccttccttatatttttttcctcaacagttttaaaaagaaaaaaaggtctatttttttttctcctatacttgggctacattttttgattgtaaaaatatttgatggccttttgatgaatgtcttccacagtaaagaaaacttagtggcttaatttaggaaacatgttaacaggacactatgtttttgaaattgtaacaaaatctacataaatgatttacaggttaaaagaataaaaataaaggtaactttacctttcttaaatat

SEQ ID NO: 3696 - DNA, 1913 bp, Homo sapiens
ctaagcagccggtgatggcggcagcggctgtggtggctgcggcgggtccgggcccatgaggcgacgaaggaggcgggacggcttttacccagccccggacttccgagacagggaagctgaggacatggcaggagtgtttgacatagacctggaccagccagaggacgcgggctctgaggatgagctggaggaggggggtcagttaaatgaaagcatggaccatgggggagttggaccatatgaacttggcatggaacattgtgagaaatttgaaatctcagaaactagtgtgaacagagggccagaaaaaatcagaccagaatgttttgagctacttcgggtacttggtaaagggggctatggaaaggcaatgatagtaagaaatgctaaagatacagctcatacaaaagcagaacggaatattctggaggaagtaaagcatcccttcatcgtggatttaatttatgcctttcagactggtggaaaactctacctcatccttgagtatctcagtggaggagaactatttatgcagttagaaagagagggaatatttatggaagacactgcctgcttttacttggcagaaatctccatggctttggggcatttacatcaaaaggggatcatctacagagacctgaagccggagaatatcatgcttaatcaccaaggtcatgtgaaactaacagactttggactatgcaaagaatctattcatgatggaacagtcacacacacattttgtggaacaatagaatacatggcccctgaaatcttgatgagaagtggccacaatcgtgctgtggattggtggagtttgggagcattaatgtatgacatgctgactggagcacccccattcactggggagaatagaaagaaaacaattgacaaaatcctcaaatgtaaactcaatttgcctccctacctcacacaagaagccagagatctgcttaaaaagctgctgaaaagaaatgctgcttctcgtctgggagctggtcctggggacgctggagaagttcaagctcatccattctttagacacattaactgggaagaacttctggctcgaaaggtggagcccccctttaaacctctgttgcaatctgaagaggatgtaagtcagtttgattccaagtttacacgtcagacacctgtcgacagcccagatgactcaactctcagtgaaagtgccaatcaggtctttctgggttttacatatgtggctccatctgtacttgaaagtgtgaaagaaaagttttcctttgaaccaaaaatccgatcacctcgaagatttattggcagcccacgaacacctgtcagcccagtcaaattttctcctggggatttctggggaagaggtgcttcggccagcacagcaaatcctcagacacctgtggaatacccaatggaaacaagtggcatagagcagatggatgtgacaatgagtggggaagcatcggcaccacttccaatacgacagccgaactctgggccatacaaaaaacaagcttttcccatgatctccaaacggccagagcacctgcgtatgaatctatgacagagcaatgcttttaatgaatttaaggcaaaaaaggtggagagggagatgtgtgagcatcctgcaaggtgaaacgactcaaaatgacagtttcagagagtcaatgtcattacatagaacacttcagacacaggaaaaataaacgtggattttaaaaaatcaatcaatggtgcaaaaaaaaacttaaagcaaaatagtattgctgaactcttaggcacatcaattaattgattcctcgcgacatcttctcaaccttatcaaggattttcatgttgatgactcgaaactgacagtattaagggtaggatgttgcttctgaatcactgttgagttctgattgtgttgaaga

SEQ ID NO: 3697 - DNA, 2369 bp, Homo sapiens
ctgtactgccaccccgctactaggaccggggcgcaaggtcctgggggtggtgctcagaggtggattcctttgcccaggcacgcccctgggaccaggcctccaaaggagaagaatggacagacctcaggggaagaagctggacttcagccgtccaaggtcttcctggtgcggaaagtcacccggcctgacagtgggcacctgtatgctatgaaggtgctgaagaaggcaacgctgaaagtacgtgaccgcgtccggaccaagatggagagagacatcctggctgatgtaaatcacccattcgtggtgaagctgcactatgccttccagaccgagggcaagctctatctcattctggacttcctgcgtggtggggacctcttcacccggctctcaaaagaggtgatgttcacggaggaggatgtgaagttttacctggctgagctggctctgggcctggatcacctgcacagcctgggtatcatttacagagacctcaagcctgagaacatccttctggatgaggagggccacatcaaactcactgactttggcctgagcaaagaggccattgaccacgagaagaaggcctattctttctgcgggacagtggagtacatggcccctgaggtcgtcaaccgccagggccactcccatagtgcggactggtggtcctatggggtgttgatgtttgagatgctgacgggctccctgcccttccaggggaaggaccggaaggagaccatgacactgattctgaaggcgaagctaggcatgccccagtttctgagcactgaagcccagagcctcttgcgggccctgttcaagcggaatcctgccaaccggctcggctccggccctgatggggcagaggaaatcaagcggcatgtcttctactccaccattgactggaataagctataccgtcgtgagatcaagccacccttcaagccagcagtggctcagcctgatgacaccttctactttgacaccgagttcacgtcccgcacacccaaggattccccaggcatcccccccagcgctggggcccatcagctgttccggggcttcagcttcgtggccaccggcctgatggaagacgacggcaagcctcgtgccccgcaggcacccctgcactcggtggtacagcaactccatgggaagaacctggtttttagtgacggctacgtggtaaaggagacaattggtgtgggctcctactctgagtgcaagcgctgtgtccacaaggccaccaacatggagtatgctgtcaaggtcattgataagagcaagcgggatccttcagaagagattgagattcttctgcggtatggccagcaccccaacatcatcactctgaaagatgtgtatgatgatggcaaacacgtgtacctggtgacagagctgatgcggggtggggagctgctggacaagatcctgcggcagaagttcttctcagagcgggaggccagctttgtcctgcacaccattggcaaaactgtggagtatctgcactcacagggggttgtgcacagggacctgaagcccagcaacatcctgtatgtggacgagtccgggaatcccgagtgcctgcgcatctgtgactttggttttgccaaacagctgcgggctgagaatgggctcctcatgacaccttgctacacagccaactttgtggcgcctgaggtgctgaagcgccagggctacgatgaaggctgcgacatctggagcctgggcattctgctgtacaccatgctggcaggatatactccatttgccaacggtcccagtgacacaccagaggaaatcctaacccggatcggcagtgggaagtttaccctcagtgggggaaattggaacacagtttcagagacagccaaggacctggtgtccaagatgctacacgtggatccccaccagcgcctcacagctaagcaggttctgcagcatccatgggtcacccagaaagacaagcttccccaaagccagctgtcccaccaggacctacagcttgtgaagggagccatggctgccacgtactccgcactcaacagctccaagcccaccccccagctgaagcccatcgagtcatccatcctggcccagcggcgagtgaggaagttgccatccaccaccctgtgaggcaccagggcattcgggccacagggcggtgctagcttgacacagtcagcatgcttcccagagggagcaggccggaaccacagggccagagggagctggaacccgaggggccggggaagctgccagcccagaacacccctaatgagggtgtgagaagtgccttctccttccccaggatggactcttctcggctcaggctctgctggtggaaagcgattcactgtataaac

SEQ ID NO: 3698 - DNA, 1963 bp, Homo sapiens
atgcagaccccagcagatttccccagggttgagagagacttggttccctgtcccagaaaggatgagggcgtcctcaaggagatctccatcacgcaccacgtcaaggctggctctgagaaggctgatccatcccatttcgagctcctcaaggttctgggccagggatcctttggcaaagtcttcctggtgcggaaagtcacccggcctgacagtgggcacctgtatgctatgaaggtgctgaagaaggcaacgctgaaagtacgtgaccgcgtccggaccaagatggagagagacatcctggctgatgtaaatcacccattcgtggtgaagctgcactatgccttccagaccgagggcaagctctatctcattctggacttcctgcgtggtggggacctcttcacccggctctcaaaagaggtgatgttcacggaggaggatgtgaagttttacctggctgagctggctctgggcctggatcacctgcacagcctgggtatcatttacagagacctcaagcctgagaacatccttctggatgaggagggccacatcaaactcactgactttggcctgagcaaagaggccattgaccacgagaagaaggcctattctttctgcgggacagtggagtacatggcccctgaggtcgtcaaccgccagggccactcccatagtgcggactggtggtcctatggggtgttgatgtttgagatgctgacgggctccctgcccttccaggggaaggaccggaaggagaccatgacactgattctgaaggcgaagctaggcatgccccagtttctgagcactgaagcccagagcctcttgcgggccctgttcaagcggaatcctgccaaccggctcggctccggccctgatggggcagaggaaatcaagcggcatgtcttctactccaccattgactggaataagctataccgtcgtgagatcaagccacccttcaagccagcagtggctcagcctgatgacaccttctactttgacaccgagttcacgtcccgcacacccaaggattccccaggcatcccccccagcgctggggcccatcagctgttccggggcttcagcttcgtggccaccggcctgatggaagacgacggcaagcctcgtgccccgcaggcacccctgcactcggtggtacaggtcattgataagagcaagcgggatccttcagaagagattgagattcttctgcggtatggccagcaccccaacatcatcactctgaaagatgtgtatgatgatggcaaacacgtgtacctggtgacagagctgatgcggggtggggagctgctggacaagatcctgcggcagaagttcttctcagagcgggaggccagctttgtcctgcacaccattggcaaaactgtggagtatctgcactcacagggggttgtgcacagggacctgaagcccagcaacatcctgtatgtggacgagtccgggaatcccgagtgcctgcgcatctgtgactttggttttgccaaacagctgcgggctgagaatgggctcctcatgacaccttgctacacagccaactttgtggcgcctgaggtgctgaagcgccagggctacgatgaaggctgcgacatctggagcctgggcattctgctgtacaccatgctggcagggtgagtgcccctggcctggacccttccccactcctgcagccctagcacttgggctgagtggtgcttgtctgataggaatggctcagccagccccgccccaggatggtctggaaatagggacatgctcctgcctccaggagctctaccttgggagtaccccatctgagggggagacacagtctcccaccgcagccccagccccagtatggaggccagagtctgtacccagaccgtgcgggcttttctgcagatatactccatttgccaacggtcccagtgacacaccagaggaaatcctaacccggatc

SEQ ID NO: 3699 - DNA, 3186 bp, Homo sapiens
ctagtgccgcggcggcggcggcggacggcccagccggagcgcgaggggctcgggggggcgcggcggttcgggtcgcagagccagggaccccaggacccgggaggcggcgcagccggggccgccggaggagcgcgggtgacctggcggcggcgagatgccgctcgcccagctcaaggagccctggccgctcatggagctagtgcctctggacccggagaatggacagacctcaggggaagaagctggacttcagccgtccaaggatgagggcgtcctcaaggagatctccatcacgcaccacgtcaaggctggctctgagaaggctgatccatcccatttcgagctcctcaaggttctgggccagggatcctttggcaaagtcttcctggtgcggaaagtcacccggcctgacagtgggcacctgtatgctatgaaggtgctgaagaaggcaacgctgaaagtacgtgaccgcgtccggaccaagatggagagagacatcctggctgatgtaaatcacccattcgtggtgaagctgcactatgccttccagaccgagggcaagctctatctcattctggacttcctgcgtggtggggacctcttcacccggctctcaaaagaggtgatgttcacggaggaggatgtgaagttttacctggctgagctggctctgggcctggatcacctgcacagcctgggtatcatttacagagacctcaagcctgagaacatccttctggatgaggagggccacatcaaactcactgactttggcctgagcaaagaggccattgaccacgagaagaaggcctattctttctgcgggacagtggagtacatggcccctgaggtcgtcaaccgccagggccactcccatagtgcggactggtggtcctatggggtgttgatgtttgagatgctgacgggctccctgcccttccaggggaaggaccggaaggagaccatgacactgattctgaaggcgaagctaggcatgccccagtttctgagcactgaagcccagagcctcttgcgggccctgttcaagcggaatcctgccaaccggctcggctccggccctgatggggcagaggaaatcaagcggcatgtcttctactccaccattgactggaataagctataccgtcgtgagatcaagccacccttcaagccagcagtggctcagcctgatgacaccttctactttgacaccgagttcacgtcccgcacacccaaggattccccaggcatcccccccagcgctggggcccatcagctgttccggggcttcagcttcgtggccaccggcctgatggaagacgacggcaagcctcgtgccccgcaggcacccctgcactcggtggtacagcaactccatgggaagaacctggtttttagtgacggctacgtggtaaaggagacaattggtgtgggctcctactctgagtgcaagcgctgtgtccacaaggccaccaacatggagtatgctgtcaaggtcattgataagagcaagcgggatccttcagaagagattgagattcttctgcggtatggccagcaccccaacatcatcactctgaaagatgtgtatgatgatggcaaacacgtgtacctggtgacagagctgatgcggggtggggagctgctggacaagatcctgcggcagaagttcttctcagagcgggaggccagctttgtcctgcacaccattggcaaaactgtggagtatctgcactcacagggggttgtgcacagggacctgaagcccagcaacatcctgtatgtggacgagtccgggaatcccgagtgcctgcgcatctgtgactttggttttgccaaacagctgcgggctgagaatgggctcctcatgacaccttgctacacagccaactttgtggcgcctgaggtgctgaagcgccagggctacgatgaaggctgcgacatctggagcctgggcattctgctgtacaccatgctggcaggatatactccatttgccaacggtcccagtgacacaccagaggaaatcctaacccggatcggcagtgggaagtttaccctcagtgggggaaattggaacacagtttcagagacagccaaggacctggtgtccaagatgctacacgtggatccccaccagcgcctcacagctaagcaggttctgcagcatccatgggtcacccagaaagacaagcttccccaaagccagctgtcccaccaggacctacagcttgtgaagggagccatggctgccacgtactccgcactcaacagctccaagcccaccccccagctgaagcccatcgagtcatccatcctggcccagcggcgagtgaggaagttgccatccaccaccctgtgaggcaccagggcattcgggccacagggcggtgctagcttgacacagtcagcatgcttcccagagggagcaggccggaaccacagggccagagggagctggaacccgaggggccggggaagctgccagcccagaacacccctaatgagggtgtgagaagtgccttctccttccccaggatggactcttctcggctcaggctctgctggtggaaagcgattcactgtataaacttttttttatgaaaaaaatggcatcaaccaccatggatttttacaagatccatttgcctttctgggagcagaaacagccattgcggccccaggaggggaactgagtcacgctggggctctctgagactctttagagcagctttgggatcccaccctggggacccccacgattggccacctgtagccatctgcacacacctccgagacagtccagtgtcacctctctcagagcatctggctgtttagcagaactcattctatccccaatcagctccttttccgttctgttctgctgggagttctagaaccacttcctgctacaggaggggtctcatgtcctgctggcttccagcttcaggcaccagcatccaccttggctctgccagtggatcccctgcggtcaggctgggcagccccagagagaggatgtggaaagcactttttggctgacttcatctggggttggcaacaggacagagttcacaggaggccagtgggcgggccatgagggacagggtcttttttcatttcttcctcagctggttactcagggttcatctgtccatggcctttctaataaactgttgagttgaa

SEQ ID NO: 3700 - DNA, 498 bp, Homo sapiens
gctcagcctgatgacaccttctactttgacaccgagttcacgtcccgcacacccaaggattccccaggcatcccccccagcgctggggcccatcagctgttccggggcttcagcttcgtggccaccggcctgatggaagacgacggcaagcctcgtgccccgcaggcacccctgcactcggtggtacaggtcattgataagagcaagcgggatccttcagaagagattgagattcttctgcggtatggccagcaccccaacatcatcactctgaaagatgtgtatgatgatggcaaacacgtgtacctggtgacagagctgatgcggggtggggagctgctggacaagatcctgcggcagaagttcttctcagagcgggaggccagctttgtcctgcacaccattggcaaaactgtggagtatctgcactcacagggggttgtgcacagggacctgaagcccagcaacatcctgtatgtggacgagtccgggaatccc

SEQ ID NO: 3701 - DNA, 3023 bp, Homo sapiens
agaagtaggaagagtaacggggccctctggtcaccggcttgagccccaccatgcagaccccagcagatttccccagggttgagagagacttggttccctgtcccagaaaggatgagggcgtcctcaaggagatctccatcacgcaccacgtcaaggctggctctgagaaggctgatccatcccatttcgagctcctcaaggttctgggccagggatcctttggcaaagtcttcctggtgcggaaagtcacccggcctgacagtgggcacctgtatgctatgaaggtgctgaagaaggcaacgctgaaagtacgtgaccgcgtccggaccaagatggagagagacatcctggctgatgtaaatcacccattcgtggtgaagctgcactatgccttccagaccgagggcaagctctatctcattctggacttcctgcgtggtggggacctcttcacccggctctcaaaagaggtgatgttcacggaggaggatgtgaagttttacctggctgagctggctctgggcctggatcacctgcacagcctgggtatcatttacagagacctcaagcctgagaacatccttctggatgaggagggccacatcaaactcactgactttggcctgagcaaagaggccattgaccacgagaagaaggcctattctttctgcgggacagtggagtacatggcccctgaggtcgtcaaccgccagggccactcccatagtgcggactggtggtcctatggggtgttgatgtttgagatgctgacgggctccctgcccttccaggggaaggaccggaaggagaccatgacactgattctgaaggcgaagctaggcatgccccagtttctgagcactgaagcccagagcctcttgcgggccctgttcaagcggaatcctgccaaccggctcggctccggccctgatggggcagaggaaatcaagcggcatgtcttctactccaccattgactggaataagctataccgtcgtgagatcaagccacccttcaagccagcagtggctcagcctgatgacaccttctactttgacaccgagttcacgtcccgcacacccaaggattccccaggcatcccccccagcgctggggcccatcagctgttccggggcttcagcttcgtggccaccggcctgatggaagacgacggcaagcctcgtgccccgcaggcacccctgcactcggtggtacagcaactccatgggaagaacctggtttttagtgacggctacgtggtaaaggagacaattggtgtgggctcctactctgagtgcaagcgctgtgtccacaaggccaccaacatggagtatgctgtcaaggtcattgataagagcaagcgggatccttcagaagagattgagattcttctgcggtatggccagcaccccaacatcatcactctgaaagatgtgtatgatgatggcaaacacgtgtacctggtgacagagctgatgcggggtggggagctgctggacaagatcctgcggcagaagttcttctcagagcgggaggccagctttgtcctgcacaccattggcaaaactgtggagtatctgcactcacagggggttgtgcacagggacctgaagcccagcaacatcctgtatgtggacgagtccgggaatcccgagtgcctgcgcatctgtgactttggttttgccaaacagctgcgggctgagaatgggctcctcatgacaccttgctacacagccaactttgtggcgcctgaggtgctgaagcgccagggctacgatgaaggctgcgacatctggagcctgggcattctgctgtacaccatgctggcaggatatactccatttgccaacggtcccagtgacacaccagaggaaatcctaacccggatcggcagtgggaagtttaccctcagtgggggaaattggaacacagtttcagagacagccaaggacctggtgtccaagatgctacacgtggatccccaccagcgcctcacagctaagcaggttctgcagcatccatgggtcacccagaaagacaagcttccccaaagccagctgtcccaccaggacctacagcttgtgaagggagccatggctgccacgtactccgcactcaacagctccaagcccaccccccagctgaagcccatcgagtcatccatcctggcccagcggcgagtgaggaagttgccatccaccaccctgtgaggcaccagggcattcgggccacagggcggtgctagcttgacacagtcagcatgcttcccagagggagcaggccggaaccacagggccagagggagctggaacccgaggggccggggaagctgccagcccagaacacccctaatgagggtgtgagaagtgccttctccttccccaggatggactcttctcggctcaggctctgctggtggaaagcgattcactgtataaacttttttttatgaaaaaaatggcatcaaccaccatggatttttacaagatccatttgcctttctgggagcagaaacagccattgcggccccaggaggggaactgagtcacgctggggctctctgagactctttagagcagctttgggatcccaccctggggacccccacgattggccacctgtagccatctgcacacacctccgagacagtccagtgtcacctctctcagagcatctggctgtttagcagaactcattctatccccaatcagctccttttccgttctgttctgctgggagttctagaaccacttcctgctacaggaggggtctcatgtcctgctggcttccagcttcaggcaccagcatccaccttggctctgccagtggatcccctgcggtcaggctgggcagccccagagagaggatgtggaaagcactttttggctgacttcatctggggttggcaacaggacagagttcacaggaggccagtgggcgggccatgagggacagggtcttttttcatttcttcctcagctggttactcagggttcatctgtccatggcctttctaataaact

SEQ ID NO: 3702 - DNA, 2359 bp, Homo sapiens
ccccggactctgcctgctcctgccatggtgccgtggccctgctgggcggatggagcaggatcccaagccgccccgtctgcggctctgggccctgatcccctggcttcccaggaagcagcggcccaggatcagccagacctctctgcctgtccctggccctggctctggcccccagcgggactcggatgagggcgtcctcaaggagatctccatcacgcaccacgtcaaggctggctctgagaaggctgatccatcccatttcgagctcctcaaggttctgggccagggatcctttggcaaagtcttcctggtgcggaaagtcacccggcctgacagtgggcacctgtatgctatgaaggtgctgaagaaggcaacgctgaaagtacgtgaccgcgtccggaccaagatggagagagacatcctggctgatgtaaatcacccattcgtggtgaagctgcactatgccttccagaccgagggcaagctctatctcattctggacttcctgcgtggtggggacctcttcacccggctctcaaaagaggtgatgttcacggaggaggatgtgaagttttacctggctgagctggctctgggcctggatcacctgcacagcctgggtatcatttacagagacctcaagcctgagaacatccttctggatgaggagggccacatcaaactcactgactttggcctgagcaaagaggccattgaccacgagaagaaggcctattctttctgcgggacagtggagtacatggcccctgaggtcgtcaaccgccagggccactcccatagtgcggactggtggtcctatggggtgttgatgtttgagatgctgacgggctccctgcccttccaggggaaggaccggaaggagaccatgacactgattctgaaggcgaagctaggcatgccccagtttctgagcactgaagcccagagcctcttgcgggccctgttcaagcggaatcctgccaaccggctcggctccggccctgatggggcagaggaaatcaagcggcatgtcttctactccaccattgactggaataagctataccgtcgtgagatcaagccacccttcaagccagcagtggctcagcctgatgacaccttctactttgacaccgagttcacgtcccgcacacccaaggattccccaggcatcccccccagcgctggggcccatcagctgttccggggcttcagcttcgtggccaccggcctgatggaagacgacggcaagcctcgtgccccgcaggcacccctgcactcggtggtacagcaactccatgggaagaacctggtttttagtgacggctacgtggtaaaggagacaattggtgtgggctcctactctgagtgcaagcgctgtgtccacaaggccaccaacatggagtatgctgtcaaggtcattgataagagcaagcgggatccttcagaagagattgagattcttctgcggtatggccagcaccccaacatcatcactctgaaagatgtgtatgatgatggcaaacacgtgtacctggtgacagagctgatgcggggtggggagctgctggacaagatcctgcggcagaagttcttctcagagcgggaggccagctttgtcctgcacaccattggcaaaactgtggagtatctgcactcacagggggttgtgcacagggacctgaagcccagcaacatcctgtatgtggacgagtccgggaatcccgagtgcctgcgcatctgtgactttggttttgccaaacagctgcgggctgagaatgggctcctcatgacaccttgctacacagccaactttgtggcgcctgaggtgctgaagcgccagggctacgatgaaggctgcgacatctggagcctgggcattctgctgtacaccatgctggcaggatatactccatttgccaacggtcccagtgacacaccagaggaaatcctaacccggatcggcagtgggaagtttaccctcagtgggggaaattggaacacagtttcagagacagccaaggacctggtgtccaagatgctacacgtggatccccaccagcgcctcacagctaagcaggttctgcagcatccatgggtcacccagaaagacaagcttccccaaagccagctgtcccaccaggacctacagcttgtgaagggagccatggctgccacgtactccgcactcaacagctccaagcccaccccccagctgaagcccatcgagtcatccatcctggcccagcggcgagtgaggaagttgccatccaccaccctgtgaggcaccagggcattcgggccacagggcggtgctagcttgacacagtcagcatgcttcccagagggagcaggccgg

SEQ ID NO: 3703 - DNA, 5824 bp, Homo sapiens
gggaggcggagaaggaggcggagggagcgattgtggccccggccgcggtggccggcgcggcctgccctttgtgaccgcagctcgcgccccacgccccgcgcccatggccgccgtgccgggctccctggccacgcgtgcccgcccgcggacctgagccccgcgcctgggatgccggggatgcgcgtcccccggccctgcggctgctccgggctgggcgcggggcgatggacctgagcatgaagaagttcgccgtgcgcaggttcttctctgtgtacctgcgcaggaagtcgcgctccaagagctccagcctgagccggctcgaggaagaaggcgtcgtgaaggagatagacatcagccatcatgtgaaggagggctttgagaaggcagatccttcccagtttgagctgctgaaggttttaggacaaggatcctatggaaaggtgttcctggtgaggaaggtgaaggggtccgacgctgggcagctctacgccatgaaggtccttaagaaagccaccctaaaagttcgggaccgagtgagatcgaagatggagagagacatcttggcagaagtgaatcaccccttcattgtgaagcttcattatgcctttcagacggaaggaaagctctacctgatcctggacttcctgcggggaggggacctcttcacccggctctccaaagaggtcatgttcacggaggaggatgtcaagttctacctggctgagctggccttggctttagaccatctccacagcctggggatcatctacagagatctgaagcctgagaacatcctcctggatgaagaggggcacattaagatcacagatttcggcctgagtaaggaggccattgaccacgacaagagagcgtactccttctgcgggacgatcgagtacatggcgcccgaggtggtgaaccggcgaggacacacgcagagtgccgactggtggtccttcggcgtgctcatgtttgagatgctcacggggtccctgccgttccaggggaaggacaggaaggagaccatggctctcatcctcaaagccaagctggggatgccgcagttcctcagtggggaggcacagagtttgctgcgagctctcttcaaacggaacccctgcaaccggctgggtgctggcattgacggagtggaggaaattaagcgccatcccttctttgtgaccatagactggaacacgctgtaccggaaggagatcaagccaccgttcaaaccagcagtgggcaggcctgaggacaccttccactttgaccccgagttcacagcgcggacgcccacagactctcctggcgtccccccgagtgcaaacgctcatcacctgtttagaggattcagctttgtggcctcaagcctgatccaggagccctcacagcaagatctgcacaaagtcccagttcacccaatcgtgcagcagttacacgggaacaacatccacttcaccgatggctacgagatcaaggaggacatcggggtgggctcctactcagtgtgcaagcgatgtgtgcataaagccacagacaccgagtatgccgtgaagatcattgataagagcaagagagacccctcggaagagattgagatcctcctgcggtacggccagcacccgaacatcatcaccctcaaggatgtctatgatgatggcaagtttgtgtacctggtaatggagctgatgcgtggtggggagctcctggaccgcatcctccggcagagatacttctcggagcgcgaagccagtgacgtcctgtgcaccatcaccaagaccatggactacctccattcccagggggttgttcatcgagacctgaagccgagtaacatcctgtacagggatgagtcggggagcccagaatccatccgagtctgcgacttcggctttgccaagcagctgcgcgcggggaacgggctgctcatgacaccctgctacacggccaatttcgtggccccggaggtcctgaagcgtcaaggctatgatgcggcgtgtgacatctggagtttggggatcctgttgtacaccatgctggcaggatttaccccttttgcaaatgggccagacgatacccctgaggagattctggcgcggatcggcagtgggaagtatgccctttctgggggaaactgggactcgatatctgacgcagctaaagacgtcgtgtccaagatgctccacgtggaccctcatcagcgcctgacggcgatgcaagtgctcaaacacccgtgggtggtcaacagagagtacctgtccccaaaccagctcagccgacaggacgtgcacctggtgaagggcgcgatggccgccacctactttgctctaaacagaacacctcaggccccgcggctggagcccgtgctgtcatccaacctggctcagcgcagaggcatgaagagactcacgtccacgcggctgtagcgggtgggaccctggccccagcgtcccctgccagcatcctcgtgggctcacagaccccggcctcggagcccgtctggcacccagagtgaccacaagtccagcagggaggcggcgcccgccctcgccgtgtccgtgttttctttttcagccccggagagggtcctgacctgggggcttctccaagcctcactgcgccagcctccccgcccgctctcttttctcccaagcgaaaccaaatgcgccccttcacctcgcgtgcccgtgcgaggccgggggcttctttcagagcccgcgggtcctctcatacatggcttctgtttctgccgagagatctgttttccaattatgaagccggtcggtttggtcagactcccgacacccacgtcccaggtacccggtgggaaagtggcagtgcgagggcgcagccattggtggttgcagggccccagagggctggggtgacctggcatcccggggctccccacgggctggatgacggggttggcactgtggcgtccaggaggagatgcctggttctgcccaaaataatccaaagagccgtttcctcctcgcccttcagtttttgcctgaggtgctgggtagcccatcctttcctctgtcccagattcaaatgaggagtaagagcccagacgagaggaaggcaggctggatctttgccttgagagctccgtgtcaccaggatggaagggggtgcctctcggaggagcctgtgtccacctccagtctcggctttccccggggggccaagcgcactgggctgccgtctgtccccagctcccgtggccacacagctatctggaggctttgcagggagtcgtgggttctcgcacctgctcagccctgtgtcggcttcctgtgtgctcacctaaagctgtggttttgctgtgttcacttcgatttttctggtctgtggagaaactgtgaattggagaaatggagctctgtggcttcccacccaaaccttctcagtccagctggaggctggagggagacacaggccccacccagcagactgaggggcagaggcacaggtgggagggcagcggagatcagcgtggacaggagcgatgcactttgtagatgctgtggctttgtgttgcgttttgtgtctctgttgcacagatctgttttttcacactgatccgtattcccctgggtgtgcacacagggcgggtgtggggcatttaggccatgctgtgctctacttcattgagtaaaatcgagtgagaggttccgggcagcaggatcgacgcccagtccagccggcagagggaacacacgggtccttcattgtcctgtaagggtgttgaagatgctccctggcggcccccaagcagactagatgggaggaggcgccgctcagcccctcaccctgcatcactgaagagcggcgcctctgcagcaagcagggcttcaggaggtgcccgctggccacagccaggttttccctaagaagatgttattttgttgggttttgttccccctccatctcgattctcgtacccaactaaaaaaaaaaaaataaagaaaaaatgtgctgcgttctgaaaaataactccttagcttggtctgattgttttcagaccttaaaatataaacttgtttcacaagctttaatccatgtggattttttttttcttagagaaccacaaaacataaaaggagcaagtcggactgaatacctgtttccatagtgcccacagggtattcctcacattttctccatagaagatgctttttcccaaggctagaacgacttccaccatgatgaatttgctttttaggtcttaattatttcacttctttttagaaacttaggaagaagtggataatcctgaggtcacacaatctgtcctcccagaaatgaacaaaagtcatcaccttttctgcttgctacacaggcaacgattcccccatcagctgcccggaccctttggcctggcttggtgtgcaggcctgtctgtttgcttaaagtcagtgggttctggtgcagggagtgagaagtgggggaagtgaaagggaaagcatccgtgagaaagcggccacggttttccctccttgtgtgcccatggggcaccagctcatggtctttttcagtcatcccagtttgtacagacttagcttctgaactctaagaatgccaaagggaccgacgagactccccatcacagcgagctctgtccttacatgtatttgatgtgcatcagcggaggagaacactggcttggccctgctccgctgagtgtctgtgaaatacctctactttccctcccatatccagaacaaaatgatacttgacatccttccacaaaagtcagcctaaagaagttatggtatcatatgttaaactaagctttcaaaaaccttagtgaaatagcaagtgactgctttcaagcagcagtcgacatgtaaatgaaggtgttcttagaattcgcattttgccagctcagcgcacctccacaacgaatgaaatgctccgtatgatttgcacaaatgacatagacctccccaaaagttaactggctctccttcctcacacagttcatcataacccaaccccccacccccgggtcatgaaaatcacagaacttataaacacattgaaccctagatctcaggcttcctgacctaccgccagtggccccttgctggccaccctatagggtcctccttccctggcagccccccatgtgggagaaatacctgattctcccaatctgcagtgggagagctttgctgaattccatcccaaagtcaaacatgggcaagaggtgaggatttcacttttaccctcaagtccgatttgtctgtgattttaaactaactgtgtatgtattgatgtttggaagattgtttgaattttaaagtgataatagtacttaatgttatccagtattgttcattaaatggtgttatcctaaagctgcacttgggatttttacctaacgctttactgattctctcaagcacatggcaaagtttgatttgcactccgttcatttctgacacgttttgctgcctcctacctttctaagcgtcatgcaaattcgagaatggagaaggacgctgccggtccctgagcggtgtggagagggcggaaggtggactccagcgcagcttgaggggctgaggacggaggctgcagcatctgtgtcgttctactgagcacgcttctctgcctcgctcctgactcagcactttgttcactggctcagcagttatgtttacacatcatttttatgttcctgctttgtaattcatgtttgagatgggtggccactgtacagatatttattacgctttccagactttctgaatagatttttttgaataaacatggttttatgaagtgtaatctttttctagcctaacaataa

SEQ ID NO: 3704 - DNA, 1181 bp, Homo sapiens
cggagaaggaggcggagggagcgattgtggccccggccgcggtggccggcgcggcctgccctttgtgaccgcagctcgcgccccacgccccgcgcccatggccgccgtgccgggctccctggccacgcgtgcccgcccgcggacctgagccccgcgcctgggatgccggggatgcgcgtcccccggccctgcggctgctccgggctgggcgcggggcgatggacctgagcatgaagaagttcgccgtgcgcaggttcttctctgtgtacctgcgcaggaagtcgcgctccaagagctccagcctgagccggctcgaggaagaaggcgtcgtgaaggagatagacatcagccatcatgtgaaggagggctttgagaaggcagatccttcccagtttgagctgctgaaggttttaggacaaggatcctatggaaaggtgttcctggtgaggaaggtgaaggggtccgacgctgggcagctctacgccatgaaggtccttaagaaagccaccctaaaagttcgggaccgagtgagatcgaagatggagagagacatcttggcagaagtgaatcaccccttcattgtgaagcttcattatgcctttcagacggaaggaaagctctacctgatcctggacttcctgcggggaggggacctcttcacccggctctccaaagaggtcatgttcacggaggaggatgtcaagttctacctggctgagctggccttggctttagaccatctccacagcctggggatcatctacagagatctgaagcctgagaacatcctcctggatgaagaggggcacattaagatcacagatttcggcctgagtaaggaggccattgaccacgacaagagagcgtactccttctgcgggacgatcgagtacatggcgcccgaggtggtgaaccggcgaggacacacgcagagtgccgactggtggtccttcggcgtgctcatgtttgagatgctcacggggtccctgccgttccaggggaaggacaggaaggagaccatggctctcatcctcaaagccaagctggggatgccgcagttcctcagtggggaggcacagagtttgctgcgagctctcttcaaacggaacccctgcaaccggctgggtgagaaaacggccctctgcccccgtgtgagttgctccaggctcctaggcttctga

SEQ ID NO: 3705 - DNA, 2282 bp, Homo sapiens
actgtttacagtagctgtgctggaaaccacatgctcctgccatggatgcagccgattcaggaacagacttgatcttcctaaggcattgcatgcaaatcctcatcaagctctagataaaattacctgcttcataaaacagaaaaggcacatatttcaaaatgaaatgaagaaggcgtcgtgaaggagatagacatcagccatcatgtgaaggagggctttgagaaggcagatccttcccagtttgagctgctgaaggttttaggacaaggatcctatggaaaggtgttcctggtgaggaaggtgaaggggtccgacgctgggcagctctacgccatgaaggtccttaagaaagccaccctaaaagttcgggaccgagtgagatcgaagatggagagagacatcttggcagaagtgaatcaccccttcattgtgaagcttcattatgcctttcagacggaaggaaagctctacctgatcctggacttcctgcggggaggggacctcttcacccggctctccaaagaggtcatgttcacggaggaggatgtcaagttctacctggctgagctggccttggctttagaccatctccacagcctggggatcatctacagagatctgaagcctgagaacatcctcctggatgaagaggggcacattaagatcacagatttcggcctgagtaaggaggccattgaccacgacaagagagcgtactccttctgcgggacgatcgagtacatggcgcccgaggtggtgaaccggcgaggacacacgcagagtgccgactggtggtccttcggcgtgctcatgtttgagatgctcacggggtccctgccgttccaggggaaggacaggaaggagaccatggctctcatcctcaaagccaagctggggatgccgcagttcctcagtggggaggcacagagtttgctgcgagctctcttcaaacggaacccctgcaaccggctgggtgctggcattgacggagtggaggaaattaagcgccatcccttctttgtgaccatagactggaacacgctgtaccggaaggagatcaagccaccgttcaaaccagcagtgggcaggcctgaggacaccttccactttgaccccgagttcacagcgcggacgcccacagactctcctggcgtccccccgagtgcaaacgctcatcacctgtttagaggattcagctttgtggcctcaagcctgatccaggagccctcacagcaagatctgcacaaagtcccagttcacccaatcgtgcagcagttacacgggaacaacatccacttcaccgatggctacgagatcaaggaggacatcggggtgggctcctactcagtgtgcaagcgatgtgtgcataaagccacagacaccgagtatgccgtgaagatcattgataagagcaagagagacccctcggaagagattgagatcctcctgcggtacggccagcacccgaacatcatcaccctcaaggatgtctatgatgatggcaagtttgtgtacctggtaatggagctgatgcgtggtggggagctcctggaccgcatcctccggcagagatacttctcggagcgcgaagccagtgacgtcctgtgcaccatcaccaagaccatggactacctccattcccagggggttgttcatcgagacctgaagccgagtaacatcctgtacagggatgagtcggggagcccagaatccatccgagtctgcgacttcggctttgccaagcagctgcgcgcggggaacgggctgctcatgacaccctgctacacggccaatttcgtggccccggaggtcctgaagcgtcaaggctatgatgcggcgtgtgacatctggagtttggggatcctgttgtacaccatgctggcaggatttaccccttttgcaaatgggccagacgatacccctgaggagattctggcgcggatcggcagtgggaagtatgccctttctgggggaaactgggactcgatatctgacgcagctaaagacgtcgtgtccaagatgctccacgtggaccctcatcagcgcctgacggcgatgcaagtgctcaaacacccgtgggtggtcaacagagagtacctgtccccaaaccagctcagccgacaggacgtgcacctggtgaagggcgcgatggccgccacctactttgctctaaacagaacacctcaggccccgcggctggagcccgtgctgtcatccaacctggctcagcgcagaggcatgaagagactcacgtccacgcggctgtagcgggtgggaccctg

SEQ ID NO: 3706 - DNA, 2297 bp, Homo sapiens
aaacgtcctaggccctggttggaatggaagcagctttgccaggagcatgggtcctgggcctcagatgatctgaattctcgtcccttgaatagaagaaggcgtcgtgaaggagatagacatcagccatcatgtgaaggagggctttgagaaggcagatccttcccagtttgagctgctgaaggttttaggacaaggatcctatggaaaggtgttcctggtgaggaaggtgaaggggtccgacgctgggcagctctacgccatgaaggtccttaagaaagccaccctaaaagttcgggaccgagtgagatcgaagatggagagagacatcttggcagaagtgaatcaccccttcattgtgaagcttcattatgcctttcagacggaaggaaagctctacctgatcctggacttcctgcggggaggggacctcttcacccggctctccaaagaggtcatgttcacggaggaggatgtcaagttctacctggctgagctggccttggctttagaccatctccacagcctggggatcatctacagagatctgaagcctgagaacatcctcctggatgaagaggggcacattaagatcacagatttcggcctgagtaaggaggccattgaccacgacaagagagcgtactccttctgcgggacgatcgagtacatggcgcccgaggtggtgaaccggcgaggacacacgcagagtgccgactggtggtccttcggcgtgctcatgtttgagatgctcacggggtccctgccgttccaggggaaggacaggaaggagaccatggctctcatcctcaaagccaagctggggatgccgcagttcctcagtggggaggcacagagtttgctgcgagctctcttcaaacggaacccctgcaaccggctgggtgctggcattgacggagtggaggaaattaagcgccatcccttctttgtgaccatagactggaacacgctgtaccggaaggagatcaagccaccgttcaaaccagcagtgggcaggcctgaggacaccttccactttgaccccgagttcacagcgcggacgcccacagactctcctggcgtccccccgagtgcaaacgctcatcacctgtttagaggattcagctttgtggcctcaagcctgatccaggagccctcacagcaagatctgcacaaagtcccagttcacccaatcgtgcagcagttacacgggaacaacatccacttcaccgatggctacgagatcaaggaggacatcggggtgggctcctactcagtgtgcaagcgatgtgtgcataaagccacagacaccgagtatgccgtgaagatcattgataagagcaagagagacccctcggaagagattgagatcctcctgcggtacggccagcacccgaacatcatcaccctcaaggatgtctatgatgatggcaagtttgtgtacctggtaatggagctgatgcgtggtggggagctcctggaccgcatcctccggcagagatacttctcggagcgcgaagccagtgacgtcctgtgcaccatcaccaagaccatggactacctccattcccagggggttgttcatcgagacctgaagccgagtaacatcctgtacagggatgagtcggggagcccagaatccatccgagtctgcgacttcggctttgccaagcagctgcgcgcggggaacgggctgctcatgacaccctgctacacggccaatttcgtggccccggaggtcctgaagcgtcaaggctatgatgcggcgtgtgacatctggagtttggggatcctgttgtacaccatgctggcaggatttaccccttttgcaaatgggccagacgatacccctgaggagattctggcgcggatcggcagtgggaagtatgccctttctgggggaaactgggactcgatatctgacgcagctaaagacgtcgtgtccaagatgctccacgtggaccctcatcagcgcctgacggcgatgcaagtgctcaaacacccgtgggtggtcaacagagagtacctgtccccaaaccagctcagccgacaggacgtgcacctggtgaagggcgcgatggccgccacctactttgctctaaacagaacacctcaggccccgcggctggagcccgtgctgtcatccaacctggctcagcgcagaggcatgaagagactcacgtccacgcggctgtagcgggtgggaccctggccccagcgtcccctgccagcatcctcgtgggctcacagaccccggcctcggagcccgtctggcacccagagtgaccacaagtccagca

SEQ ID NO: 3707 - DNA, 4137 bp, Homo sapiens
aattcgaagctgcaagtgcagcgtttactctgccaaagtcgcagtacagattccgaagccgcagcgccgtcccctcctttcctcgccccagcccgagcgggaagcggcagcagctccccagagccctggcttggcagggaggggacggcgcccgagcagccatattgcagccccccgggtccctcctccggccggcgcaggccccgcgctcacgacctcctctgggagccggatctgtcctctccatcgccgccacccgccggcctctgcgtcccttggcttccgacatcccgtctggccgtccccctgtgccggtccgagcctctgtttatttcctttcctactatcaatactcgaccagcagaaaaggaaagtttaaaaatgccaatcgcacagttgctggaactatggaaaaagatcgaggtggagcctatggaaatagagaccacagaggaggatctcaacctggatgtggagcccaccacagaagacactgcagaagaagaagaaggcgtcgtgaaggagatagacatcagccatcatgtgaaggagggctttgagaaggcagatccttcccagtttgagctgctgaaggttttaggacaaggatcctatggaaaggtgttcctggtgaggaaggtgaaggggtccgacgctgggcagctctacgccatgaaggtccttaagaaagccaccctaaaagttcgggaccgagtgagatcgaagatggagagagacatcttggcagaagtgaatcaccccttcattgtgaagcttcattatgcctttcagacggaaggaaagctctacctgatcctggacttcctgcggggaggggacctcttcacccggctctccaaagaggtcatgttcacggaggaggatgtcaagttctacctggctgagctggccttggctttagaccatctccacagcctggggatcatctacagagatctgaagcctgagaacatcctcctggatgaagaggggcacattaagatcacagatttcggcctgagtaaggaggccattgaccacgacaagagagcgtactccttctgcgggacgatcgagtacatggcgcccgaggtggtgaaccggcgaggacacacgcagagtgccgactggtggtccttcggcgtgctcatgtttgagatgctcacggggtccctgccgttccaggggaaggacaggaaggagaccatggctctcatcctcaaagccaagctggggatgccgcagttcctcagtggggaggcacagagtttgctgcgagctctcttcaaacggaacccctgcaaccggctgggtgctggcattgacggagtggaggaaattaagcgccatcccttctttgtgaccatagactggaacacgctgtaccggaaggagatcaagccaccgttcaaaccagcagtgggcaggcctgaggacaccttccactttgaccccgagttcacagcgcggacgcccacagactctcctggcgtccccccgagtgcaaacgctcatcacctgtttagaggattcagctttgtggcctcaagcctgatccaggagccctcacagcaagatctgcacaaagtcccagttcacccaatcgtgcagcagttacacgggaacaacatccacttcaccgatggctacgagatcaaggaggacatcggggtgggctcctactcagtgtgcaagcgatgtgtgcataaagccacagacaccgagtatgccgtgaagatcattgataagagcaagagagacccctcggaagagattgagatcctcctgcggtacggccagcacccgaacatcatcaccctcaaggatgtctatgatgatggcaagtttgtgtacctggtaatggagctgatgcgtggtggggagctcctggaccgcatcctccggcagagatacttctcggagcgcgaagccagtgacgtcctgtgcaccatcaccaagaccatggactacctccattcccagggggttgttcatcgagacctgaagccgagtaacatcctgtacagggatgagtcggggagcccagaatccatccgagtctgcgacttcggctttgccaagcagctgcgcgcggggaacgggctgctcatgacaccctgctacacggccaatttcgtggccccggaggtcctgaagcgtcaaggctatgatgcggcgtgtgacatctggagtttggggatcctgttgtacaccatgctggcaggatttaccccttttgcaaatgggccagacgatacccctgaggagattctggcgcggatcggcagtgggaagtatgccctttctgggggaaactgggactcgatatctgacgcagctaaagacgtcgtgtccaagatgctccacgtggaccctcatcagcgcctgacggcgatgcaagtgctcaaacacccgtgggtggtcaacagagagtacctgtccccaaaccagctcagccgacaggacgtgcacctggtgaagggcgcgatggccgccacctactttgctctaaacagaacacctcaggccccgcggctggagcccgtgctgtcatccaacctggctcagcgcagaggcatgaagagactcacgtccacgcggctgtagcgggtgggaccctggccccagcgtcccctgccagcatcctcgtgggctcacagaccccggcctcggagcccgtctggcacccagagtgaccacaagtccagcagggaggcggcgcccgccctcgccgtgtccgtgttttctttttcagccccggagagggtcctgacctgggggcttctccaagcctcactgcgccagcctccccgcccgctctcttttctcccaagcgaaaccaaatgcgccccttcacctcgcgtgcccgtgcgaggccgggggcttctttcagagcccgcgggtcctctcatacatggcttctgtttctgccgagagatctgttttccaattatgaagccggtcggtttggtcagactcccgacacccacgtcccaggtacccggtgggaaagtggcagtgcgagggcgcagccattggtggttgcagggccccagagggctggggtgacctggcatcccggggctccccacgggctggatgacggggttggcactgtggcgtccaggaggagatgcctggttctgcccaaaataatccaaagagccgtttcctcctcgcccttcagtttttgcctgaggtgctgggtagcccatcctttcctctgtcccagattcaaatgaggagtaagagcccagacgagaggaaggcaggctggatctttgccttgagagctccgtgtcaccaggatggaagggggtgcctctcggaggagcctgtgtccacctccagtctcggctttccccggggggccaagcgcactgggctgccgtctgtccccagctcccgtggccacacagctatctggaggctttgcagggagtcgtgggttctcgcacctgctcagccctgtgtcggcttcctgtgtgctcacctaaagctgtggttttgctgtgttcacttcgatttttctggtctgtggagaaactgtgaattggagaaatggagctctgtggcttcccacccaaaccttctcagtccagctggaggctggagggagacacaggccccacccagcagactgaggggcagaggcacaggtgggagggcagcggagatcagcgtggacaggagcgatgcactttgtagatgctgtggctttgtgttgcgttttgtgtctctgttgcacagatctgttttttcacactgatccgtattcccctgggtgtgcacacagggcgggtgtggggcatttaggccatgctgtgctctacttcattgagtaaaatcgagtgagaggttccgggcagcaggatcgacgcccagtccagccggcagagggaacacacgggtccttcattgtcctgtaagggtgttgaagatgctccctggcggcccccaagcagactagatgggaggaggcgccgctcagcccctcaccctgcatcactgaagagcggcgcctctgcagcaagcagggcttcaggaggtgcccgctggccacagccaggttttccctaagaagatgttattttgttgggttttgttccccctccatctcgattctcgtacccaact

SEQ ID NO: 3708 - DNA, 587 bp, Homo sapiens
atggcagcggcatcctcagactcaactttcaccctcgtttagagccaattaagcagaaaaggaaagtttaaaaatgccaatcgcacagttgctggaactatggaaaaagatcgaggtggagcctatggaaatagagaccacagaggaggatctcaacctggatgtggagcccaccacagaagacactgcagaagaaggcaaaagtgactcagctgcctgcaagacaaaggtagctggatccgtagaggaagaaggcgtcgtgaaggagatagacatcagccatcatgtgaaggagggctttgagaaggcagatccttcccagtttgagctgctgaaggttttaggacaaggatcctatggaaaggtgttcctggtgaggaaggtgaaggggtccgacgctgggcagctctacgccatgaaggtccttaagaaagccaccctaaaagttcgggaccgagtgagatcgaagatggagagagacatcttggcagaagtgaatcaccccttcattgtgaagcttcattatgcctttcagacggaaggaaagctctacctgatcctggacttcctgcggggaggggacctct

SEQ ID NO: 3709 - DNA, 5992 bp, Homo sapiens
gcagtacagattccgaagccgcagcgccgtcccctcctttcctcgccccagcccgagcgggaagcggcagcagctccccagagccctggcttggcagggaggggacggcgcccgagcagccatattgcagccccccgggtccctcctccggccggcgcaggccccgcgctcacgacctcctctgggagccggatctgtcctctccatcgccgccacccgccggcctctgcgtcccttggcttccgacatcccgtctggccgtccccctgtgccggtccgagcctctgtttatttcctttcctactatcaatactcgaccagcagaaaaggaaagtttaaaaatgccaatcgcacagttgctggaactatggaaaaagatcgaggtggagcctatggaaatagagaccacagaggaggatctcaacctggatgtggagcccaccacagaagacactgcagaagaaggcaaaagtgactcagctgcctgcaagacaaaggtagctggatccgtagaggaagaaggcgtcgtgaaggagatagacatcagccatcatgtgaaggagggctttgagaaggcagatccttcccagtttgagctgctgaaggttttaggacaaggatcctatggaaaggtgttcctggtgaggaaggtgaaggggtccgacgctgggcagctctacgccatgaaggtccttaagaaagccaccctaaaagttcgggaccgagtgagatcgaagatggagagagacatcttggcagaagtgaatcaccccttcattgtgaagcttcattatgcctttcagacggaaggaaagctctacctgatcctggacttcctgcggggaggggacctcttcacccggctctccaaagaggtcatgttcacggaggaggatgtcaagttctacctggctgagctggccttggctttagaccatctccacagcctggggatcatctacagagatctgaagcctgagaacatcctcctggatgaagaggggcacattaagatcacagatttcggcctgagtaaggaggccattgaccacgacaagagagcgtactccttctgcgggacgatcgagtacatggcgcccgaggtggtgaaccggcgaggacacacgcagagtgccgactggtggtccttcggcgtgctcatgtttgagatgctcacggggtccctgccgttccaggggaaggacaggaaggagaccatggctctcatcctcaaagccaagctggggatgccgcagttcctcagtggggaggcacagagtttgctgcgagctctcttcaaacggaacccctgcaaccggctgggtgctggcattgacggagtggaggaaattaagcgccatcccttctttgtgaccatagactggaacacgctgtaccggaaggagatcaagccaccgttcaaaccagcagtgggcaggcctgaggacaccttccactttgaccccgagttcacagcgcggacgcccacagactctcctggcgtccccccgagtgcaaacgctcatcacctgtttagaggattcagctttgtggcctcaagcctgatccaggagccctcacagcaagatctgcacaaagtcccagttcacccaatcgtgcagcagttacacgggaacaacatccacttcaccgatggctacgagatcaaggaggacatcggggtgggctcctactcagtgtgcaagcgatgtgtgcataaagccacagacaccgagtatgccgtgaagatcattgataagagcaagagagacccctcggaagagattgagatcctcctgcggtacggccagcacccgaacatcatcaccctcaaggatgtctatgatgatggcaagtttgtgtacctggtaatggagctgatgcgtggtggggagctcctggaccgcatcctccggcagagatacttctcggagcgcgaagccagtgacgtcctgtgcaccatcaccaagaccatggactacctccattcccagggggttgttcatcgagacctgaagccgagtaacatcctgtacagggatgagtcggggagcccagaatccatccgagtctgcgacttcggctttgccaagcagctgcgcgcggggaacgggctgctcatgacaccctgctacacggccaatttcgtggccccggaggtcctgaagcgtcaaggctatgatgcggcgtgtgacatctggagtttggggatcctgttgtacaccatgctggcaggatttaccccttttgcaaatgggccagacgatacccctgaggagattctggcgcggatcggcagtgggaagtatgccctttctgggggaaactgggactcgatatctgacgcagctaaagacgtcgtgtccaagatgctccacgtggaccctcatcagcgcctgacggcgatgcaagtgctcaaacacccgtgggtggtcaacagagagtacctgtccccaaaccagctcagccgacaggacgtgcacctggtgaagggcgcgatggccgccacctactttgctctaaacagaacacctcaggccccgcggctggagcccgtgctgtcatccaacctggctcagcgcagaggcatgaagagactcacgtccacgcggctgtagcgggtgggaccctggccccagcgtcccctgccagcatcctcgtgggctcacagaccccggcctcggagcccgtctggcacccagagtgaccacaagtccagcagggaggcggcgcccgccctcgccgtgtccgtgttttctttttcagccccggagagggtcctgacctgggggcttctccaagcctcactgcgccagcctccccgcccgctctcttttctcccaagcgaaaccaaatgcgccccttcacctcgcgtgcccgtgcgaggccgggggcttctttcagagcccgcgggtcctctcatacatggcttctgtttctgccgagagatctgttttccaattatgaagccggtcggtttggtcagactcccgacacccacgtcccaggtacccggtgggaaagtggcagtgcgagggcgcagccattggtggttgcagggccccagagggctggggtgacctggcatcccggggctccccacgggctggatgacggggttggcactgtggcgtccaggaggagatgcctggttctgcccaaaataatccaaagagccgtttcctcctcgcccttcagtttttgcctgaggtgctgggtagcccatcctttcctctgtcccagattcaaatgaggagtaagagcccagacgagaggaaggcaggctggatctttgccttgagagctccgtgtcaccaggatggaagggggtgcctctcggaggagcctgtgtccacctccagtctcggctttccccggggggccaagcgcactgggctgccgtctgtccccagctcccgtggccacacagctatctggaggctttgcagggagtcgtgggttctcgcacctgctcagccctgtgtcggcttcctgtgtgctcacctaaagctgtggttttgctgtgttcacttcgatttttctggtctgtggagaaactgtgaattggagaaatggagctctgtggcttcccacccaaaccttctcagtccagctggaggctggagggagacacaggccccacccagcagactgaggggcagaggcacaggtgggagggcagcggagatcagcgtggacaggagcgatgcactttgtagatgctgtggctttgtgttgcgttttgtgtctctgttgcacagatctgttttttcacactgatccgtattcccctgggtgtgcacacagggcgggtgtggggcatttaggccatgctgtgctctacttcattgagtaaaatcgagtgagaggttccgggcagcaggatcgacgcccagtccagccggcagagggaacacacgggtccttcattgtcctgtaagggtgttgaagatgctccctggcggcccccaagcagactagatgggaggaggcgccgctcagcccctcaccctgcatcactgaagagcggcgcctctgcagcaagcagggcttcaggaggtgcccgctggccacagccaggttttccctaagaagatgttattttgttgggttttgttccccctccatctcgattctcgtacccaactaaaaaaaaaaaaataaagaaaaaatgtgctgcgttctgaaaaataactccttagcttggtctgattgttttcagaccttaaaatataaacttgtttcacaagctttaatccatgtggattttttttttcttagagaaccacaaaacataaaaggagcaagtcggactgaatacctgtttccatagtgcccacagggtattcctcacattttctccatagaagatgctttttcccaaggctagaacgacttccaccatgatgaatttgctttttaggtcttaattatttcacttctttttagaaacttaggaagaagtggataatcctgaggtcacacaatctgtcctcccagaaatgaacaaaagtcatcaccttttctgcttgctacacaggcaacgattcccccatcagctgcccggaccctttggcctggcttggtgtgcaggcctgtctgtttgcttaaagtcagtgggttctggtgcagggagtgagaagtgggggaagtgaaagggaaagcatccgtgagaaagcggccacggttttccctccttgtgtgcccatggggcaccagctcatggtctttttcagtcatcccagtttgtacagacttagcttctgaactctaagaatgccaaagggaccgacgagactccccatcacagcgagctctgtccttacatgtatttgatgtgcatcagcggaggagaacactggcttggccctgctccgctgagtgtctgtgaaatacctctactttccctcccatatccagaacaaaatgatacttgacatccttccacaaaagtcagcctaaagaagttatggtatcatatgttaaactaagctttcaaaaaccttagtgaaatagcaagtgactgctttcaagcagcagtcgacatgtaaatgaaggtgttcttagaattcgcattttgccagctcagcgcacctccacaacgaatgaaatgctccgtatgatttgcacaaatgacatagacctccccaaaagttaactggctctccttcctcacacagttcatcataacccaaccccccacccccgggtcatgaaaatcacagaacttataaacacattgaaccctagatctcaggcttcctgacctaccgccagtggccccttgctggccaccctatagggtcctccttccctggcagccccccatgtgggagaaatacctgattctcccaatctgcagtgggagagctttgctgaattccatcccaaagtcaaacatgggcaagaggtgaggatttcacttttaccctcaagtccgatttgtctgtgattttaaactaactgtgtatgtattgatgtttggaagattgtttgaattttaaagtgataatagtacttaatgttatccagtattgttcattaaatggtgttatcctaaagctgcacttgggatttttacctaacgctttactgattctctcaagcacatggcaaagtttgatttgcactccgttcatttctgacacgttttgctgcctcctacctttctaagcgtcatgcaaattcgagaatggagaaggacgctgccggtccctgagcggtgtggagagggcggaaggtggactccagcgcagcttgaggggctgaggacggaggctgcagcatctgtgtcgttctactgagcacgcttctctgcctcgctcctgactcagcactttgttcactggctcagcagttatgtttacacatcatttttatgttcctgctttgtaattcatgtttgagatgggtggccactgtacagatatttattacgctttccagactttctgaatagatttttttgaataaacatggttttatgaagtgt

SEQ ID NO: 3710 - DNA, 1067 bp, Homo sapiens
gtacataaggacgtcatttcctgccgcctgtcttttccgtgctacctgcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttctaaaa

SEQ ID NO: 3711 - DNA, 874 bp, Homo sapiens
cctgcagaggggtccatacggcgttgttctgggttgctctcttatttcagattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctac

SEQ ID NO: 3712 - DNA, 5631 bp, Homo sapiens
cttgcgcaggcgtagtgctcctgcttcctggccgagggcgggcgagcggagcctgctttcgcagcgatcgcgagcgtgtggcgattgcttctgtctgttatttagatatggaagctgaggggatgcacagaggcagccagaacctaggtcagggtctcgctcggtgctgaccgcccccggggtcgagtaggcgatgggggagcccggcttcttcgtcacaggagaccgcgccggtggccggagctggtgcctgcggcgggtggggatgagcgccgggtggctgctgctggaagatgggtgcgaggtgactgtaggacgaggatttggtgtcacataccaactggtatcaaaaatctgccccctgatgatttctcgaaaccactgtgttttgaagcagaatcctgagggccaatggacaattatggacaacaagagtctaaatggtgtttggctgaacagagcgcgtctggaacctttaagggtctattccattcatcagggagactacatccaacttggagtgcctctggaaaataaggagaatgcggagtatgaatatgaagttactgaagaagactgggagacaatatatccttgtctttccccaaagaatgaccaaatgatagaaaaaaataaggaattgagaactaaaaggaaattcagtttggatgaattagcaggtcctggagctgaaggcccctcaaatttgaaatccaaaataaataaagtgtcttgtgaatctggtcagccagtgaaatcacaggggaaaggtgaagtggccagtacaccctctgacaatttggatcctaagttgactgcccttgagccaagtaagaccacaggggctcccatttaccctggcttccccaaagtcacagaggttcatcatgagcagaaagcctcaaactcttcagcatctcagagaagcttacagatgtttaaggtgaccatgtccaggattctgaggctcaaaatacagatgcaggaaaaacatgaagccgttatgaatgtgaaaaagcagacccaaaaggggaactcaaagaaagttgtgcaaatggagcaggaacttcaggacttacagtcccagctgtgtgcagagcaggctcagcagcaggcaagagtggagcaactagagaagactttccaggaagaggaacagcatcttcagggtttggagatagcccaaggagaaaaggacctgaagcaacagctggcccaggctctgcaggagcattgggctctaatggaagagctaaatcgcagcaagaaggactttgaagcaatcattcaagccaagaacaaagaattagagcagaccaaggaagagaaggagaagatgcaagcacagaaggaagaagttcttagccacatgaatgatgtgctagagaatgagctccaatgtattatttgttcagaatacttcattgaggctgtcaccttgaactgtgcccacagtttctgctcctactgtatcaatgaatggatgaagcggaagatagaatgccccatttgtcggaaggacattaagtccaaaacgtactctttggttctggacaattgcattaataagatggtaaataatctgagctcagaagtgaaagaacgacgaattgttctcattagggaacgaaaagcaaagagattgttctgaagaccgtgctctaagggcatttgaaagactgccaggtagtgcgagcctgagatggtctggaggattctctctagccgtgactccgctgctctgaaggtcaactgagaagtcttgtgggacagagacttgagttaggaagccctcagtcacttgccttccacggtggccagccctgctgccatcattggctgaagcaccaccaggattcacggcacccaactgcttcagggtacttcgtagactctgcctcactacatgtcgaaagagttatttgagttctcttctgtttttttttaatttgttgttgttgttactgttttgatacctcggaaacacctccgttgacagttgttttggataggttgggtgtaccccatggctgcctctgaaggcagtgtctattttgagaggatggcttacctcttctttgtgaaaatactatctcatttcctggaaataaaatgtaaaacctgtcagttgctcagctgggctttggtgtatttaccttccttcccttcctgctcccagacagtctcacaagtaaacaccagcagctcatagattacaaccaagaaagtgactgtatcagatgatagacttcaagtgaatgtcagcctaagaggccaagctgcagatcgtggcaacagatgagctctgttaacctcctgactgtcgtgtttcctttttattacagaggtgggtcactgtttaccttgtttcaggggtgggagaaactcctttccttcagctggcatttgaatgtttccaaatctattttatctgacgtcatgaacacacaggcaatgattttatgacaacttgatgtgcttttttctttatttttcttttacattagaagttttctctcttttctccacctctcctttatttttaattttaattttaatttttgaaacaagatctgactctgttgcccaagctggagtacagtagtgcaatctcagctcactgcaacctccacctcccagactcaagccatcctcccacctcaacctcccaagtagctgggactacaggcatatgccatcacacccagctaatttttgtttttctgtagagacagggtttcaccatgttggccaggctggtctcaaattcctgaccttaagtgatccacctgcctaggcctctaaaatgctgggattacaggcgtgagccaccacgcccagcctataccccatgtattttcataaagggttggaaactattgattgccaactttttaaggatggtagggattttttctttgttgaatatactgtgaattttgggattctggagtccttagtcttcatttccattcttctgcccatgattactgatcaaaatactggtagagtcatggaggaagtaagttaaatgtggaaaaaatgctttaaaagtacttactataaccacatcataagaattctggaaaaatagagaacaaaaggaaaagattgttaccaccttgatttaataacttcttgtttccccatacatgtgttttgtttatagattgcatgggtatatgtcaatttttatatgttctgtgtttagtttacatattgtaattcatttttaagagagtacagacatacactttttgagtaggcaatatgttcacatagtttgaaattaaaggtacaaaatggcgtagaatgaaatgcctctcaccctttccccacagcgactacttcccactcagaggcaacaagtattacagttgcttgtatattcttccagagatctctgtctatacaagcaaaaacacatgtggtctttttccttgctttgcacaaatggtaaactgtacgctattctgaaccttgcttttttcagatatatgttggcaacagttccatgtcagtacatagtttcctttctttattacagctgcctgttttttcattgtgtatttgcaccatcatttacttttctggcttacttttgatagaaatctaggttggttcaaacctttttactcttaaaacaatgctgcagttaacacccttgtacatatatctttagagagaagatattttaaaaagaaatacctttttaaaaattattttattattttttaatagagactatgttgcctaggctggtcttgaaattctgggctaaagcaatcctaccaccttggcctcccaaagtgctgagattacaggcatgagccattgcacctggccaagaagagacatcttgacttgagcctgaagactatgtacagagactgacctcacagactgaccattccatcccacagctgctggacatagagtgatttgcagcccctcctttcagagtaccacatccctctcaagtgttccacaacatctaggaaagtgagctcttaaagacagactaaaaagagtaataaatcaatacaacaacattaaaagccagactagcggagtttgaatcttggccctgctgttagtaactgtgtgagccttgggcaagttactcagcctccttgtgtcttggttttggtttcttcatctctaagtaattatatctgtcattattgccctgatcacaaacaaaagcctgaatgtactatgtttaaaagacaaaccaaaaattaacccaaacttgcattatttgtctgagctacagaatgttctttccttggagagatatctgatattaaacatcatctgcattttacttgcctagaaaatacacggtaacttttctgccttgcagcatcaaactatagtacagctgagccccagtgctgtgcagtctgactctaattaaaggcaccttctttacagcagggctctggggaactggaaaagggggtttgtttcattatctggttttattaagcagatgaatgcagccagctatatgaagcactttgcagtgaatggcaggtgtcccatatctggttatgttaacctagaaagggctcactctacctctaggcatgtttcatcccaacaatcagactgtgccaaagcaggggactttgtcctttgtggattgcatagctggatacccatcatctgtttctctgattggaagctgctgttgtacagaaagacctgcatttcccccttgtctccagttctctcactactttttcctcctctgtgagtgaccatccaggcagtcaccataactgctggagtgtctgggattggtagctctctccaactgcctgcttgctctttacagcctctctctgtgactggaatctctccacctcatcgtatctaaggataacccagaaacatggggtgtcctaggtatgtttatctcgacactgaaccccctaggcttctgatgaatccagtgattagctaaatttgacatagaaagtaagaaggaatgtctactttgtattgtggtcctaatctaagatcaggagaatcctggaattgttatctgtctcttgctctgagatacagacttgttcataggtgtggggcctgattggaacaggatctgccattggtcacaataggtcaagggcttgttctgaaccctagttagcttcattcagagaaagaaacttcctacctggtcagctttttcagcttctccaacaaatgggagttgaggcagtaggagtgtggggttcttgggaagacgatggggccttgtattaaggagaaataatgaactatcttcttgattcttccattgagaaaagcatatgaatcctaggaaagggctcagcctgtgataggcattcaataaatactccaatgctgtcattcctttgtctacagcatccccaaacaatgtaccagtgatgggctacctgagctcatctagtcgccaagcagtatctcctgcttgctgctgctttactacattccagatgcccacctcatccaatttccagagccactatctctgctgtccactttccttcaggctctgtgaatacttcaacctgctgtgatttggggccgtttgtactctgcatgtattcaataaattcaattcagcaatagtta

SEQ ID NO: 3713 - DNA, 419 bp, Homo sapiens
gagcgtgtggcgattgcttctgtctgttatttagatatggaagctgaggggatgcacagaggcagccagaacctaggtcagggtctcgctcggtgctgaccgcccccggggtcgagtaggcgatgggggagcccggcttcttcgtcacaggagaccgcgccggtggccggagctggtgcctgcggcgggtggggatgagcgccgggtggctgctgctggaagatgggtgcgaggtgactgtaggacgaggatttggtgtcacataccaactggtatcaaaaatctgccccctgatgatttctcgaaaccactgtgttttgaagcagaatcctgagggccaatggacaattatggacaacaagagttttccttctgaaaaggcagaagattttacagcagcaggagagagattcctttaa

SEQ ID NO: 3714 - DNA, 1800 bp, Homo sapiens
gggatgcacagaggcagccagaacctaggtcagggtctcgctcggtgctgaccgcccccggggtcgagtaggcgatgggggagcccggcttcttcgtcacaggagaccgcgccggtggccggagctggtgcctgcggcgggtggggatgagcgccgggtggctgctgctggaagatgggtgcgaggtgactgtaggacgaggatttggtgtcacataccaactggtatcaaaaatctgccccctgatgatttctcgaaaccactgtgttttgaagcagaatcctgagggccaatggacaattatggacaacaagagtctaaatggtgtttggctgaacagagcgcgtctggaacctttaagggtctattccattcatcagggagactacatccaacttggagtgcctctggaaaataaggagaatgcggagtatgaatatgaagttactgaagaagactgggagacaatatatccttgtctttccccaaagaatgaccaaatgatagaaaaaaataaggaattgagaactaaaaggaaattcagtttggatgaattagcaggtcctggagctgaaggcccctcaaatttgaaatccaaaataaataaagtgtcttgtgaatctggtcagccagtgaaatcacaggggaaaggtgaagtggccagtacaccctctgacaatttggatcctaagttgactgcccttgagccaagtaagaccacaggggctcccatttaccctggcttccccaaagtcacagaggttcatcatgagcagaaagcctcaaactcttcagcatctcagagaagcttacagatgtttaaggtgaccatgtccaggattctgaggctcaaaatacagatgcaggaaaaacatgaagccgttatgaatgtgaaaaagcagacccaaaaggggaactcaaagaaagttgtgcaaatggagcaggaacttcaggacttacagtcccagctgtgtgcagagcaggctcagcagcaggcaagagtggagcaactagagaagactttccaggaagaggaacagcatcttcagggtttggagatagcccaaggagaaaaggacctgaagcaacagctggcccaggctctgcaggagcattgggctctaatggaagagctaaatcgcagcaagaaggactttgaagcaatcattcaagccaagaacaaagaattagagcagaccaaggaagagaaggagaagatgcaagcacagaaggaagaagttcttagccacatgaatgatgtgctagagaatgagctccaatgtattatttgttcagaatacttcattgagcaaagagattgttctgaagaccgtgctctaagggcatttgaaagactgccaggtagtgcgagcctgagatggtctggaggattctctctagccgtgactccgctgctctgaaggtcaactgagaagtcttgtgggacagagacttgagttaggaagccctcagtcacttgccttccacggtggccagccctgctgccatcattggctgaagcaccaccaggattcacggcacccaactgcttcagggtacttcgtagactctgcctcactacatgtcgaaagagttatttgagttctcttctgtttttttttaatttgttgttgttgttactgttttgatacctcggaaacacctccgttgacagttgttttggataggttgggtgtaccccatggctgcctctgaaggcagtgtctattttgagaggatggcttacctcttctttgtgaaaatactatctcatttcctggaaataaaatgtaaaacctg

SEQ ID NO: 3715 - DNA, 2488 bp, Homo sapiens
ggccggaacaggcgtttagagaaaatggcagacgatattgatattgaagcaatgcttgaggctccttacaagaaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagaattctcttttgttatagatttgcaaacaagactttcccagcagactgaagcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgctgctgtcaatgcattgcatggcaggtggtttgctggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacaggaatgcagtgtgctcattctccctaaatagtaaatcccactgtatacaaaactgttctcttgttctgccttttaaaatgttcatgtagaaaattaatgaactataggaatagctctaggagaacaaatgtgctttctgtaaaaaggcagaccagggatgtaatgtttttaatgtttcagaagcctaactttttacacagtggttacatttcacatttcactaatgttgatatttggctgatggttgagcagtttctgaaatacacatttagtgtatggaaatacaagacagctaaagggctgtttggttagcatctcatcttgcattctgatcaattggcaagaaagggagatttcaaaattatatttcttgatggtatcttttcaattaatgtatctgtaaaagtttctttgtaaatactatgtgttctggtgtgtcttaaaattccaaacaaaatgatccctgcatttcctgaagatgtttaaacgtgagagtctggtaggcaaagcagtctgagaaagaaataggaaatgcagaaataggttttgtctggttgcatataatctttgctctttttaagctctgtgagctctgaaatatatttttgggttacttcagtgtgtttgacaagacagcttgatatttctatcaaacaaatgactttcatattgcaacaatctttgtaagaaccactcaaataaaagtctcttaaaaaggcc

SEQ ID NO: 3716 - DNA, 2792 bp, Homo sapiens
gccatttcagggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagatttgcaaacaagactttcccagcagactgaagctttgtttgttattatgttttggaatgaaatttggtcagataatatgattacgcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgctgctgtcaatgcattgcatggcaggtggtttgctggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacaggaatgcagtgtgctcattctccctaaatagtaaatcccactgtatacaaaactgttctcttgttctgccttttaaaatgttcatgtagaaaattaatgaactataggaatagctctaggagaacaaatgtgctttctgtaaaaaggcagaccagggatgtaatgtttttaatgtttcagaagcctaactttttacacagtggttacatttcacatttcactaatgttgatatttggctgatggttgagcagtttctgaaatacacatttagtgtatggaaatacaagacagctaaagggctgtttggttagcatctcatcttgcattctgatcaattggcaagaaagggagatttcaaaattatatttcttgatggtatcttttcaattaatgtatctgtaaaagtttctttgtaaatactatgtgttctggtgtgtcttaaaattccaaacaaaatgatccctgcatttcctgaagatgtttaaacgtgagagtctggtaggcaaagcagtctgagaaagaaataggaaatgcagaaataggttttgtctggttgcatataatctttgctctttttaagctctgtgagctctgaaatatatttttgggttacttcagtgtgtttgacaagacagcttgatatttctatcaaacaaatgactttcatattgcaacaatctttgtaagaaccactcaaataaaagtctcttaaaaaggc

SEQ ID NO: 3717 - DNA, 2831 bp, Homo sapiens
gcgagagcccgtgctgagggctctgtgaggccccgtgtgtttgtgtgtgtgtatgtgtgctggtgaatgtgagtacagggaagcagcggccgccatttcagggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagatttgcaaacaagactttcccagcagactgaagcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgctgctgtcaatgcattgcatggcaggtggtttgctggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacaggaatgcagtgtgctcattctccctaaatagtaaatcccactgtatacaaaactgttctcttgttctgccttttaaaatgttcatgtagaaaattaatgaactataggaatagctctaggagaacaaatgtgctttctgtaaaaaggcagaccagggatgtaatgtttttaatgtttcagaagcctaactttttacacagtggttacatttcacatttcactaatgttgatatttggctgatggttgagcagtttctgaaatacacatttagtgtatggaaatacaagacagctaaagggctgtttggttagcatctcatcttgcattctgatcaattggcaagaaagggagatttcaaaattatatttcttgatggtatcttttcaattaatgtatctgtaaaagtttctttgtaaatactatgtgttctggtgtgtcttaaaattccaaacaaaatgatccctgcatttcctgaagatgtttaaacgtgagagtctggtaggcaaagcagtctgagaaagaaataggaaatgcagaaataggttttgtctggttgcatataatctttgctctttttaagctctgtgagctctgaaatatatttttgggttacttcagtgtgtttgacaagacagcttgatatttctatcaaacaaatgactttcatattgcaacaatctttgtaagaaccactcaaataaaagtctcttaaaaaggcc

SEQ ID NO: 3718 - DNA, 1026 bp, Homo sapiens
gtgtgctggtgaatgtgagtacagggaagcagcggccgccatttcagggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaa

SEQ ID NO: 3719 - DNA, 2147 bp, Homo sapiens
gtgctggtgaatgtgagtacagggaagcagcggccgccatttcagggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaaggatgagaacaagttgagcagtgccaacggccatgaagaacgtagcaaaaaacaaactttctgcctccttggaaagctctacatctccttgtgattggagtgtgggtttcaagattccagaaggaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagaattctcttttgttatagatttgcaaacaagactttcccagcagactgaagcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgctgctgtcaatgcattgcatggcaggtggtttgctggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacagg

SEQ ID NO: 3720 - DNA, 716 bp, Homo sapiens
ggcagcgcgggtttttgcccggaaagaggcgctctcgttcgggtctcccagtttctgtttttggagttgacagcagagttttaaatattggatattgaagtcttcattttcgtgtgtttcgtgcgtttagagaaaatggcagacgatattgatattgaagcaatgcttgaggctccttacaagaaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaa

SEQ ID NO: 3721 - DNA, 1008 bp, Homo sapiens
aagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagaattctcttttgttatagatttgcaaacaagactttcccagcagactgaagcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgc

SEQ ID NO: 3722 - DNA, 2109 bp, Homo sapiens
cctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttacagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagaattctcttttgttatagatttgcaaacaagactttcccagcagactgaagcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgctgctgtcaatgcattgcatggcaggtggtttgctggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacaggaatgcagtgtgctcattctccctaaatagtaaatcccactgtatacaaaactgttctcttgttctgccttttaaaatgttcatgtagaaaattaatgaactataggaatagctctaggagaacaaatgtgctttctgtaaaaaggcagaccagggatgtaatgtttttaatgtttcagaagcctaactttttacacagtggttacatttcacatttcactaatgttgatatttggctgatggttgagcagtttc

SEQ ID NO: 3723 - DNA, 2012 bp, Homo sapiens
ctcgttgcgcagtagtgctagcggcttcgcggttcggtcctcgcacccggcagccgccactggtgctgagctgctaggaagcccctatcgccgagctcgttggagcttgaacccattgtcacccctccgactcaccggcccaaaaaaaaaaaaacatggttgaagcagatcgcccaggaaagctcttcattggtgggcttaatacggaaacaaatgagaaagctcttgaagcagtatttggcaaatatggacgaatagtggaagtactcttgatgaaagaccgtgaaaccaacaaatcaagaggatttgcttttgtcacctttgaaagcccagcagacgctaaggatgcagccagagacatgaatggaaagtcattagatggaaaagccatcaaggtggaacaagccaccaaaccatcatttgaaagtggtagacgtggaccgcctccacctccaagaagtagaggccctccaagaggtcttagaggtggaagaggaggaagtggaggaaccaggggacctccctcacggggaggacacatggatgacggtggatattccatgaattttaacatgagttcttccaggggaccactcccagtaaaaagaggaccaccaccaagaagtgggggtcctcctcctaagagatctgcaccttcaggaccagttcgcagtagcagtggaatgggaggaagagctcctgtatcacgtggaagagatagttatggaggtccacctcgaagggaaccgctgccctctcgtagagatgtttatttgtccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagatcatccaagtggaggttcctacagagattcatatgagagttatggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaaggactactaaaaggaaaaattgtgttactttttttaaattccctgttaagttcccctccataatttttatgttcttgtgaggaaaaaagtaaaacatgtttaattttatttgactttcgcattgcttttcaacaagcaaatgttaaatgtgttaagacttgtactagtgttgtaactttccaagtaaaagtatcccctaaaggccacttcctatctgatttttcccagcaaatgaggcaggcaattctaagatcttccacaaaacatctagccatctaaaatggagagatgaatcattctacctatacaaacaagctagctattagagggtggttggggtatgctactcataagatttcagggtgtcttccaactgaaatctcaatgttctcagtacgaaaaacctgaaatcacatgcctatgtaaggaaagtgctattcacccagtaaacccaaaaaagcaaatggataatgctggccattttgcctttctgacatttccttgggaatctgcaagaacctcccctttcccttcccccaataagaccatttaagtgtgtgttaaacaactacagaatactaaataaaaagtttggccaaaaccaa

SEQ ID NO: 3724 - DNA, 671 bp, Homo sapiens
gatgtttatttgtccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagatcatccaagtggaggttcctacagagattcatatgagagttatggttggtgattttgctcattatggtcgtggagtgctgattgattcacagtagataaagctggcagtaagaaatgctaagagttgttgaagcagaaggcggctgattgtcaataagtcactacagttgcataagcagtgctgtcagaattggtttggtgcaggcaatagattttgccttcaggggttcctgtggatctgaggaaggcatcagtgttgattaacactcataactagggagtgactggtagttacttaaagcaagtaattgaccaaatggaaaaggggaagtaattaaggaaattggtaagtggaggtagtcaggaagttcttgtggttcttcacatagattttacagctttggctttcattttgtttagctaaagtcatggggacaactcttcaatttagaacttaag

SEQ ID NO: 3725 - DNA, 2052 bp, Homo sapiens
ggtccttcagcctcgttcccgggcagtataaagtttgctgtctcctttgttcgccctcgttgcgcagtagtgctagcggcttcgcggttcggtcctcgcacccggcagccgccactggtgctgagctgctaggaagcccctatcgccgagctcgttggagcttgaacccattgtcacccctccgactcaccggcccaaaaaaaaaaaaacatggttgaagcagatcgcccaggaaagctcttcattggtgggcttaatacggaaacaaatgagaaagctcttgaagcagtatttggcaaatatggacgaatagtggaagtactcttgatgaaagaccgtgaaaccaacaaatcaagaggatttgcttttgtcacctttgaaagcccagcagacgctaaggatgcagccagagacatgaatggaaagctcctgtatcacgtggaagagatagttatggaggtccacctcgaagggaaccgctgccctctcgtagagatgtttatttgtccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagatcatccaagtggaggttcctacagagattcatatgagagttatggttggtgattttgctcattatggtcgtggagtgctgattgattcacagtagataaagctggcagtaagaaatgctaagagttgttgaagcagaaggcggctgattgtcaataagtcactacagttgcataagcagtgctgtcagaattggtttggtgcaggcaatagattttgccttcaggggttcctgtggatctgaggaaggcatcagtgttgattaacactcataactagggagtgactggtagttacttaaagcaagtaattgaccaaatggaaaaggggaagtaattaaggaaattggtaagtggaggtagtcaggaagttcttgtggttcttcacatagattttacagctttggctttcattttgtttagctaaagtcatggggacaactcttcaatttagaacttaagttgaattataaaaatgatggatataagtggtagctgtatctagtgaagtgtctgtcagtaagtgaaacattttttggtggtggcttatccacaaacagtttagttgtagaataaaacttatgagtgacatctggaaagtaaccatgctaagatggcaagcacactggaaacaattaggccacttggctttcttttgctgtattgttttataagcctactttacctcccagtcttggaaacaagttttagttttttattggtttggagactagagccaatagtataatgttctcaaaggaaacagacttgagttgttggattagaggaactaacccaacttatatgattttttttttgtttttgtcgtgtagttatggcactgtcttatttggaacatttgcaactagggataatacaacatttttaactctcatttgacaacctactactaatcacagaccacaagggtaatgaccaaatttatgtggtttttgcactccatagttgtcttagcccaatctttctatactcttacgattacttgggttaacgcttctgtgaggaccttctggctcttgagataccctaaatatttaagatatttagatatcttgaagatagtataggatatagagattgtaccaaataggaatataaggagtatgttaaaatgaccagatacctgtttgatagtttactgacctagcagatgtgtggaaaaggaatcagatcttgattcttctgggtttatactggttgtaaaacagaatgatacagaaaatgttttccttgtttaactggtagttgaacatagaacttgggtattatagatcacttttcactttttggaatgttttgtattgaaacttaataaaactttaacatgg

SEQ ID NO: 3726 - DNA, 1948 bp, Homo sapiens
ctcgttgcgcagtagtgctagcggcttcgcggttcggtcctcgcacccggcagccgccactggtgctgagctgctaggaagcccctatcgccgagctcgttggagcttgaacccattgtcacccctccgactcaccggcccaaaaaaaaaaaaacatggttgaagcagatcgcccaggaaagctcttcattggtgggcttaatacggaaacaaatgagaaagctcttgaagcagtatttggcaaatatggacgaatagtggaagtactcttgatgaaagaccgtgaaagcccagcagacgctaaggatgcagccagagacatgaatggaaagtcattagatggaaaagccatcaaggtggaacaagccaccaaaccatcatttgaaagtggtagacgtggaccgcctccacctccaagaagtagaggccctccaagaggtcttagaggtggaagaggaggaagtggaggaaccaggggacctccctcacggggaggacacatggatgacggtggatattccatgaattttaacatgagttcttccaggggaccactcccagtaaaaagaggaccaccaccaagaagtgggggtcctcctcctaagagatctgcaccttcaggaccagttcgcagtagcagtggaatgggaggaagagctcctgtatcacgtggaagagatagttatggaggtccacctcgaagggaaccgctgccctctcgtagagatgtttatttgtccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagatcatccaagtggaggttcctacagagattcatatgagagttatggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaaggactactaaaaggaaaaattgtgttactttttttaaattccctgttaagttcccctccataatttttatgttcttgtgaggaaaaaagtaaaacatgtttaattttatttgactttcgcattgcttttcaacaagcaaatgttaaatgtgttaagacttgtactagtgttgtaactttccaagtaaaagtatcccctaaaggccacttcctatctgatttttcccagcaaatgaggcaggcaattctaagatcttccacaaaacatctagccatctaaaatggagagatgaatcattctacctatacaaacaagctagctattagagggtggttggggtatgctactcataagatttcagggtgtcttccaactgaaatctcaatgttctcagtacgaaaaacctgaaatcacatgcctatgtaaggaaagtgctattcacccagtaaacccaaaaaagcaaatggataatgctggccattttgcctttctgacatttccttgggaatctgcaagaacctcccctttcccttcccccaataagaccatttaagtgtgtgttaaacaactacagaatact

SEQ ID NO: 3727 - DNA, 6222 bp, Homo sapiens
ggaaaggggaacagttaaatttgtaatttgggttgtgtgaaaacttctttgggcctcataaacaaccacagaaccacaagttgggtagcctggcagtgtcagaagtctgaacccagcatagtggtcagcaggcaggacgaatcacactgaatgcaaaccacagggtttcgcagcgtggtgagcatcaccaacccacagccaaggcggcgctggctttttttttttttttaatctttaacaatttgaatatttgtttttacaaaggtgcattttttaatagggcttggggagtcccagaggtatccagcagaggggagaagaaagagagatgtagggctagaggggtgaggctgaaacagtgacctgtcttggttttcgctccgaaggtaaaagaaatcattgagtcccccgccttcagaagagggtgcattttcaggaggaagcgatggcttcagacagcatatttgagtcatttccttcgtacccacagtgcttcatgagagaatgcatacttggaatgaatccttctagagacgtccacgatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaagacatcggcagaaactagatgatcagaccaagcccgggagcttgtccttttccgagcggctcagtgaactggagcagctgcggcgcacagccatgagggtcagcccacaccacccagcccccacgcccaaccctcgtgcctccctgaaccactccactgcctttaaccctcagcctcagagtcagatgcaggatacaaggcagatccaaccatccccaccgtggtcctacgatcagtcctaccaatacctgggatccattgcctctccttctgtgcacccagcaacgcccatttcacctggacgtgccagcggcatgacaaccctctctgcagaactttccagtcgactctcaacggcacccgacctgacagcgttcagcgacccgcgccagttccccgcgctgccctccatctccgacccccgcatgcactatccaggcgccttcacctactccccgacgccggtcacctcgggcatcggcatcggcatgtcggccatgggctcggccacgcgctaccacacctacctgccgccgccctaccccggctcgtcgcaagcgcagggaggcccgttccaagccagctcgccctcctaccacctgtactacggcgcctcggccggctcctaccagttctccatggtgggcggcgagcgctcgccgccgcgcatcctgccgccctgcaccaacgcctccaccggctccgcgctgctcaaccccagcctcccgaaccagagcgacgtggtggaggccgagggcagccacagcaactcccccaccaacatggcgccctccgcgcgcctggaggaggccgtgtggaggccctactgaggcgccaggcctggcccggctgggccccgcgggccgccgccttcgcctccgggcgcgcgggcctcctgttcgcgacaagcccgccgggatcccgggccctgggcccggccaccgtcctggggccgagggcgcccgacggccaggatctcgctgtaggtcaggcccgcgcagcctcctgcgcccagaagcccacgccgccgccgtctgctggcgccccggccctcgcggaggtgtccgaggcgacgcacctcgagggtgtccgccggccccagcacccaggggacgcgctggaaagcaaacaggaagattcccggagggaaactgtgaatgcttctgatttagcaatgctgtgaataaaaagaaagattttatacccttgacttaactttttaaccaagttgtttattccaaagagtgtggaattttggttggggtggggggagaggagggatgcaactcgccctgtttggcatctaattcttatttttaatttttccgcaccttatcaattgcaaaatgcgtatttgcatttgggtggtttttatttttatatacgtttatataaatatatataaattgagcttgcttctttcttgctttgaccatggaaagaaatatgattcccttttctttaagttttatttaacttttcttttggacttttgggtagttgtttttttttgttttgttttgtttttttgagaaacagctacagctttgggtcatttttaactactgtattcccacaaggaatccccagatatttatgtatcttgatgttcagacatttatgtgttgataattttttaattatttaaatgtacttatattaagaaaaatatcaagtactacattttcttttgttcttgatagtagccaaagttaaatgtatcacattgaagaaggctagaaaaaaagaatgagtaatgtgatcgcttggttatccagaagtattgtttacattaaactccctttcatgttaatcaaacaagtgagtagctcacgcagcaacgtttttaataggatttttagacactgagggtcactccaaggatcagaagtatggaattttctgccaggctcaacaagggtctcatatctaacttcctccttaaaacagagaaggtcaatctagttccagagggttgaggcaggtgccaataattacatctttggagaggatttgatttctgcccagggatttgctcaccccaaggtcatctgataatttcacagatgctgtgtaacagaacacagccaaagtaaactgtgtaggggagccacatttacataggaaccaaatcaatgaatttaggggttacgattatagcaatttaagggcccaccagaagcaggcctcgaggagtcaatttgcctctgtgtgcctcagtggagacaagtgggaaaacatggtcccacctgtgcgagaccccctgtcctgtgctgctcactcaacaacatctttgtgttgctttcaccaggctgagaccctaccctatggggtatatgggcttttacctgtgcaccagtgtgacaggaaagattcatgtcactactgtccgtggctacaattcaaaggtatccaatgtcgctgtaaattttatggcactatttttattggaggatttggtcagaatgcagttgttgtacaactcataaatactaactgctgattttgacacatgtgtgctccaaatgatctggtggttatttaacgtacctcttaaaattcgttgaaacgatttcaggtcaactctgaagagtatttgaaagcaggacttcagaacagtgtttgatttttattttataaatttaagcattcaaattaggcaaatctttggctgcaggcagcaaaaacagctggacttatttaaaacaacttgtttttgagttttcttatatatatattgattatttgttttacacacatgcagtagcactttggtaagagttaaagagtaaagcagcttatgttgtcaggtcgttcttatctagagaagagctatagcagatctcggacaaactcagaatatattcactttcatttttgacaggattccctccacaactcagtttcatatattattccgtattacatttttgcagctaaattaccataaaatgtcagcaaatgtaaaaatttaatttctgaaaagcaccattagcccatttcccccaaattaaacgtaaatgttttttttcagcacatgttaccatgtctgacctgcaaaaatgctggagaaaaatgaaggaaaaaattatgtttttcagtttaattctgttaactgaagatattccaactcaaaaccagcctcatgctctgattagataatcttttacattgaacctttactctcaaagccatgtgtggagggggcttgtcactattgtaggctcactggattggtcatttagagtttcacagactcttaccagcatatatagtatttaattgtttcaaaaaaaatcaaactgtagttgttttggcgataggtctcacgcaacacatttttgtatgtgtgtgtgtgtgcgtgtgtgtgtgtgtgtgtgaaaaattgcattcattgacttcaggtagattaaggtatctttttattcattgccctcaggaaagttaaggtatcaatgagacccttaagccaatcatgtaataactgcatgtgtctggtccaggagaagtattgaataagccatttctactgcttactcatgtccctatttatgatttcaacatggatacatatttcagttctttctttttctcactatctgaaaatacatttccctccctctcttccccccaatatctccctttttttctctcttcctctatcttccaaaccccactttctccctcctccttttcctgtgttctcttaagcagatagcacatacccccacccagtaccaaatttcagaacacaagaaggtccagttcttcccccttcacataaaggaacatggtttgtcagcctttctcctgtttatgggtttcttccagcagaacagagacattgccaaccatattggatctgcttgctgtccaaaccagcaaactttcctgggcaaatcacaatcagtgagtaaatagacagcctttctgctgccttgggtttctgtgcagataaacagaaatgctctgattagaaaggaaatgaatggttccactcaaatgtcctgcaatttaggattgcagatttctgccttgaaatacctgtttctttgggacattccgtcctgatgatttttatttttgttggtttttatttttggggggaatgacatgtttgggtcttttatacatgaaaatttgtttgacaataatctcacaaaacatattttacatctgaacaaaatgcctttttgtttaccgtagcgtatacatttgttttgggatttttgtgtgtttgttgggaattttgtttttagccaggtcagtattgatgaggctgatcatttggctctttttttccttccagaagagttgcatcaacaaagttaattgtatttatgtatgtaaatagattttaagcttcattataaaatattgttaatgcctataactttttttcaatttttttgtgtgtgtttctaaggactttttcttaggtttgctaaatactgtagggaaaaaaatgcttctttctactttgtttattttagactttaaaatgagctacttcttattcacttttgtaaacagctaatagcatggttccaattttttttaagttcactttttttgttctaggggaaatgaatgtgcaaaaaaagaaaaagaactgttggttatttgtgttattctggatgtataaaaatcaatggaaaaaaataaactttcaaattgaaatgacggtataacacatctactgaaaaagcaacgggaaatgtggtcctatttaagccagcccccacctagggtctatttgtgtggcagttattgggtttggtcacaaaacatcctgaaaattcgtgcgtgggcttctttctccctggtacaaacgtatggaatgcttcttaaaggggaactgtcaagctggtgtcttcagccagatgacatgagagaatatcccagaaccctctctccaaggtgtttctagatagcacaggagagcaggcactgcactgtccacagtccacggtacacagtcgggtgggccgcctcccctctcctgggagcattcgtcgtgcccagcctgagcagggcagctggactgctgctgttcaggagccaccagagccttcctctctttgtaccacagtttcttctgtaaatccagtgttacaatcagtgtgaatggcaaataaacagtttgacaagtacatacaccata

SEQ ID NO: 3728 - DNA, 5741 bp, Homo sapiens
atgcccgcagcaccgcggggaccggcgcagggggaagcggccgcccgcacgcgaagccgggatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaagacatcggcagaaactagatgatcagaccaagcccgggagcttgtccttttccgagcggctcagtgaactggagcagctgcggcgcacagccatgagggtcagcccacaccacccagcccccacgcccaaccctcgtgcctccctgaaccactccactgcctttaaccctcagcctcagagtcagatgcaggatacaaggcagatccaaccatccccaccgtggtcctacgatcagtcctaccaatacctgggatccattgcctctccttctgtgcacccagcaacgcccatttcacctggacgtgccagcggcatgacaaccctctctgcagaactttccagtcgactctcaacggcacccgacctgacagcgttcagcgacccgcgccagttccccgcgctgccctccatctccgacccccgcatgcactatccaggcgccttcacctactccccgacgccggtcacctcgggcatcggcatcggcatgtcggccatgggctcggccacgcgctaccacacctacctgccgccgccctaccccggctcgtcgcaagcgcagggaggcccgttccaagccagctcgccctcctaccacctgtactacggcgcctcggccggctcctaccagttctccatggtgggcggcgagcgctcgccgccgcgcatcctgccgccctgcaccaacgcctccaccggctccgcgctgctcaaccccagcctcccgaaccagagcgacgtggtggaggccgagggcagccacagcaactcccccaccaacatggcgccctccgcgcgcctggaggaggccgtgtggaggccctactgaggcgccaggcctggcccggctgggccccgcgggccgccgccttcgcctccgggcgcgcgggcctcctgttcgcgacaagcccgccgggatcccgggccctgggcccggccaccgtcctggggccgagggcgcccgacggccaggatctcgctgtaggtcaggcccgcgcagcctcctgcgcccagaagcccacgccgccgccgtctgctggcgccccggccctcgcggaggtgtccgaggcgacgcacctcgagggtgtccgccggccccagcacccaggggacgcgctggaaagcaaacaggaagattcccggagggaaactgtgaatgcttctgatttagcaatgctgtgaataaaaagaaagattttatacccttgacttaactttttaaccaagttgtttattccaaagagtgtggaattttggttggggtggggggagaggagggatgcaactcgccctgtttggcatctaattcttatttttaatttttccgcaccttatcaattgcaaaatgcgtatttgcatttgggtggtttttatttttatatacgtttatataaatatatataaattgagcttgcttctttcttgctttgaccatggaaagaaatatgattcccttttctttaagttttatttaacttttcttttggacttttgggtagttgtttttttttgttttgttttgtttttttgagaaacagctacagctttgggtcatttttaactactgtattcccacaaggaatccccagatatttatgtatcttgatgttcagacatttatgtgttgataattttttaattatttaaatgtacttatattaagaaaaatatcaagtactacattttcttttgttcttgatagtagccaaagttaaatgtatcacattgaagaaggctagaaaaaaagaatgagtaatgtgatcgcttggttatccagaagtattgtttacattaaactccctttcatgttaatcaaacaagtgagtagctcacgcagcaacgtttttaataggatttttagacactgagggtcactccaaggatcagaagtatggaattttctgccaggctcaacaagggtctcatatctaacttcctccttaaaacagagaaggtcaatctagttccagagggttgaggcaggtgccaataattacatctttggagaggatttgatttctgcccagggatttgctcaccccaaggtcatctgataatttcacagatgctgtgtaacagaacacagccaaagtaaactgtgtaggggagccacatttacataggaaccaaatcaatgaatttaggggttacgattatagcaatttaagggcccaccagaagcaggcctcgaggagtcaatttgcctctgtgtgcctcagtggagacaagtgggaaaacatggtcccacctgtgcgagaccccctgtcctgtgctgctcactcaacaacatctttgtgttgctttcaccaggctgagaccctaccctatggggtatatgggcttttacctgtgcaccagtgtgacaggaaagattcatgtcactactgtccgtggctacaattcaaaggtatccaatgtcgctgtaaattttatggcactatttttattggaggatttggtcagaatgcagttgttgtacaactcataaatactaactgctgattttgacacatgtgtgctccaaatgatctggtggttatttaacgtacctcttaaaattcgttgaaacgatttcaggtcaactctgaagagtatttgaaagcaggacttcagaacagtgtttgatttttattttataaatttaagcattcaaattaggcaaatctttggctgcaggcagcaaaaacagctggacttatttaaaacaacttgtttttgagttttcttatatatatattgattatttgttttacacacatgcagtagcactttggtaagagttaaagagtaaagcagcttatgttgtcaggtcgttcttatctagagaagagctatagcagatctcggacaaactcagaatatattcactttcatttttgacaggattccctccacaactcagtttcatatattattccgtattacatttttgcagctaaattaccataaaatgtcagcaaatgtaaaaatttaatttctgaaaagcaccattagcccatttcccccaaattaaacgtaaatgttttttttcagcacatgttaccatgtctgacctgcaaaaatgctggagaaaaatgaaggaaaaaattatgtttttcagtttaattctgttaactgaagatattccaactcaaaaccagcctcatgctctgattagataatcttttacattgaacctttactctcaaagccatgtgtggagggggcttgtcactattgtaggctcactggattggtcatttagagtttcacagactcttaccagcatatatagtatttaattgtttcaaaaaaaatcaaactgtagttgttttggcgataggtctcacgcaacacatttttgtatgtgtgtgtgtgtgcgtgtgtgtgtgtgtgtgtgaaaaattgcattcattgacttcaggtagattaaggtatctttttattcattgccctcaggaaagttaaggtatcaatgagacccttaagccaatcatgtaataactgcatgtgtctggtccaggagaagtattgaataagccatttctactgcttactcatgtccctatttatgatttcaacatggatacatatttcagttctttctttttctcactatctgaaaatacatttccctccctctcttccccccaatatctccctttttttctctcttcctctatcttccaaaccccactttctccctcctccttttcctgtgttctcttaagcagatagcacatacccccacccagtaccaaatttcagaacacaagaaggtccagttcttcccccttcacataaaggaacatggtttgtcagcctttctcctgtttatgggtttcttccagcagaacagagacattgccaaccatattggatctgcttgctgtccaaaccagcaaactttcctgggcaaatcacaatcagtgagtaaatagacagcctttctgctgccttgggtttctgtgcagataaacagaaatgctctgattagaaaggaaatgaatggttccactcaaatgtcctgcaatttaggattgcagatttctgccttgaaatacctgtttctttgggacattccgtcctgatgatttttatttttgttggtttttatttttggggggaatgacatgtttgggtcttttatacatgaaaatttgtttgacaataatctcacaaaacatattttacatctgaacaaaatgcctttttgtttaccgtagcgtatacatttgttttgggatttttgtgtgtttgttgggaattttgtttttagccaggtcagtattgatgaggctgatcatttggctctttttttccttccagaagagttgcatcaacaaagttaattgtatttatgtatgtaaatagattttaagcttcattataaaatattgttaatgcctataactttttttcaatttttttgtgtgtgtttctaaggactttttcttaggtttgctaaatactgtagggaaaaaaatgcttctttctactttgtttattttagactttaaaatgagctacttcttattcacttttgtaaacagctaatagcatggttccaattttttttaagttcactttttttgttctaggggaaatgaatgtgcaaaaaaagaaaaagaactgttggttatttgtgttattctggatgtataaaaatcaatggaaaaaaataaactttcaaattgaaatgacggtataacacatctactgaaaaagcaacgggaaatgtggtcctatttaagccagcccccacctagggtctatttgtgtggcagttattgggtttggtcacaaaacatcctgaaaattcgtgcgtgggcttctttctccctggtacaaacgtatggaatgcttcttaaaggggaactgtcaagctggtgtcttcagccagatgacatgagagaatatcccagaaccctctctccaaggtgtttctagatagcacaggagagcaggcactgcactgtccacagtccacggtacacagtcgggtgggccgcctcccctctcctgggagcattcgtcgtgcccagcctgagcagggcagctggactgctgctgttcaggagccaccagagccttcctctctttgtaccacagtttcttctgtaaatccagtgttacaatcagtgtgaatggcaaataaacagtttgacaagtacatacaccata

SEQ ID NO: 3729 - DNA, 7274 bp, Homo sapiens
catagagccagcgggcgcgggcgggacgggcgccccgcggccggacccagccagggcaccacgctgcccggccctgcgccgccaggcacttctttccggggctcctagggacgccagaaggaagtcaacctctgctgcttctccttggcctgcgttggaccttcctttttttgttgtttttttttgtttttcccctttcttccttttgaattaactggcttcttggctggatgttttcaacttctttcctggctgcgaacttttccccaattgttttccttttacaacagggggagaaagtgctctgtggtccgaggcgagccgtgaagttgcgtgtgcgtggcagtgtgcgtggcaggatgtgcgtgcgtgtgtaacccgagccgcccgatctgtttcgatctgcgccgcggagccctccctcaaggcccgctccacctgctgcggttacgcggcgctcgtgggtgttcgtgcctcggagcagctaaccggcgggtgctgggcgacggtggaggagtatcgtctcgctgctgcccgagtcagggctgagtcacccagctgatgtagacagtggctgccttccgaagagtgcgtgtttgcatgtgtgtgactctgcggctgctcaactcccaacaaaccagaggaccagccacaaacttaaccaacatccccaaacccgagttcacagatgtgggagagctgtagaaccctgagtgtcatcgactgggccttcttatgattgttgttttaagattagctgaagatctctgaaacgctgaattttctgcactgagcgttttgacagaattcattgagagaacagagaacatgacaagtacttctagctcagcactgctccaactactgaagctgattttcaaggctacttaaaaaaatctgcagcgtacattaatggatttctgttgtgtttaaattctccacagattgtattgtaaatattttatgaagtagagcatatgtatatatttatatatacgtgcacatacattagtagcactacctttggaagtctcagctcttgcttttcgggactgaagccagttttgcatgataaaagtggccttgttacgggagataattgtgttctgttgggactttagacaaaactcacctgcaaaaaactgacaggcattaactactggaacttccaaataatgtgtttgctgatcgttttactcttcgcataaatattttaggaagtgtatgagaattttgccttcaggaacttttctaacagccaaagacagaacttaacctctgcaagcaagattcgtggaagatagtctccactttttaatgcactaagcaatcggttgctaggagcccatcctgggtcagaggccgatccgcagaaccagaacgttttcccctcctggactgttagtaacttagtctccctcctcccctaaccacccccgcccccccccaccccccgcagtaataaaggcccctgaacgtgtatgttggtctcccgggagctgcttgctgaagatccgcgcccctgtcgccgtctggtaggagctgtttgcagggtcctaactcaatcggcttgttgtgatgcgtatccccgtagatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaagacatcggcagaaactagatgatcagaccaagcccgggagcttgtccttttccgagcggctcagtgaactggagcagctgcggcgcacagccatgagggtcagcccacaccacccagcccccacgcccaaccctcgtgcctccctgaaccactccactgcctttaaccctcagcctcagagtcagatgcaggatacaaggcagatccaaccatccccaccgtggtcctacgatcagtcctaccaatacctgggatccattgcctctccttctgtgcacccagcaacgcccatttcacctggacgtgccagcggcatgacaaccctctctgcagaactttccagtcgactctcaacggcacccgacctgacagcgttcagcgacccgcgccagttccccgcgctgccctccatctccgacccccgcatgcactatccaggcgccttcacctactccccgacgccggtcacctcgggcatcggcatcggcatgtcggccatgggctcggccacgcgctaccacacctacctgccgccgccctaccccggctcgtcgcaagcgcagggaggcccgttccaagccagctcgccctcctaccacctgtactacggcgcctcggccggctcctaccagttctccatggtgggcggcgagcgctcgccgccgcgcatcctgccgccctgcaccaacgcctccaccggctccgcgctgctcaaccccagcctcccgaaccagagcgacgtggtggaggccgagggcagccacagcaactcccccaccaacatggcgccctccgcgcgcctggaggaggccgtgtggaggccctactgaggcgccaggcctggcccggctgggccccgcgggccgccgccttcgcctccgggcgcgcgggcctcctgttcgcgacaagcccgccgggatcccgggccctgggcccggccaccgtcctggggccgagggcgcccgacggccaggatctcgctgtaggtcaggcccgcgcagcctcctgcgcccagaagcccacgccgccgccgtctgctggcgccccggccctcgcggaggtgtccgaggcgacgcacctcgagggtgtccgccggccccagcacccaggggacgcgctggaaagcaaacaggaagattcccggagggaaactgtgaatgcttctgatttagcaatgctgtgaataaaaagaaagattttatacccttgacttaactttttaaccaagttgtttattccaaagagtgtggaattttggttggggtggggggagaggagggatgcaactcgccctgtttggcatctaattcttatttttaatttttccgcaccttatcaattgcaaaatgcgtatttgcatttgggtggtttttatttttatatacgtttatataaatatatataaattgagcttgcttctttcttgctttgaccatggaaagaaatatgattcccttttctttaagttttatttaacttttcttttggacttttgggtagttgtttttttttgttttgttttgtttttttgagaaacagctacagctttgggtcatttttaactactgtattcccacaaggaatccccagatatttatgtatcttgatgttcagacatttatgtgttgataattttttaattatttaaatgtacttatattaagaaaaatatcaagtactacattttcttttgttcttgatagtagccaaagttaaatgtatcacattgaagaaggctagaaaaaaagaatgagtaatgtgatcgcttggttatccagaagtattgtttacattaaactccctttcatgttaatcaaacaagtgagtagctcacgcagcaacgtttttaataggatttttagacactgagggtcactccaaggatcagaagtatggaattttctgccaggctcaacaagggtctcatatctaacttcctccttaaaacagagaaggtcaatctagttccagagggttgaggcaggtgccaataattacatctttggagaggatttgatttctgcccagggatttgctcaccccaaggtcatctgataatttcacagatgctgtgtaacagaacacagccaaagtaaactgtgtaggggagccacatttacataggaaccaaatcaatgaatttaggggttacgattatagcaatttaagggcccaccagaagcaggcctcgaggagtcaatttgcctctgtgtgcctcagtggagacaagtgggaaaacatggtcccacctgtgcgagaccccctgtcctgtgctgctcactcaacaacatctttgtgttgctttcaccaggctgagaccctaccctatggggtatatgggcttttacctgtgcaccagtgtgacaggaaagattcatgtcactactgtccgtggctacaattcaaaggtatccaatgtcgctgtaaattttatggcactatttttattggaggatttggtcagaatgcagttgttgtacaactcataaatactaactgctgattttgacacatgtgtgctccaaatgatctggtggttatttaacgtacctcttaaaattcgttgaaacgatttcaggtcaactctgaagagtatttgaaagcaggacttcagaacagtgtttgatttttattttataaatttaagcattcaaattaggcaaatctttggctgcaggcagcaaaaacagctggacttatttaaaacaacttgtttttgagttttcttatatatatattgattatttgttttacacacatgcagtagcactttggtaagagttaaagagtaaagcagcttatgttgtcaggtcgttcttatctagagaagagctatagcagatctcggacaaactcagaatatattcactttcatttttgacaggattccctccacaactcagtttcatatattattccgtattacatttttgcagctaaattaccataaaatgtcagcaaatgtaaaaatttaatttctgaaaagcaccattagcccatttcccccaaattaaacgtaaatgttttttttcagcacatgttaccatgtctgacctgcaaaaatgctggagaaaaatgaaggaaaaaattatgtttttcagtttaattctgttaactgaagatattccaactcaaaaccagcctcatgctctgattagataatcttttacattgaacctttactctcaaagccatgtgtggagggggcttgtcactattgtaggctcactggattggtcatttagagtttcacagactcttaccagcatatatagtatttaattgtttcaaaaaaaatcaaactgtagttgttttggcgataggtctcacgcaacacatttttgtatgtgtgtgtgtgtgcgtgtgtgtgtgtgtgtgtgaaaaattgcattcattgacttcaggtagattaaggtatctttttattcattgccctcaggaaagttaaggtatcaatgagacccttaagccaatcatgtaataactgcatgtgtctggtccaggagaagtattgaataagccatttctactgcttactcatgtccctatttatgatttcaacatggatacatatttcagttctttctttttctcactatctgaaaatacatttccctccctctcttccccccaatatctccctttttttctctcttcctctatcttccaaaccccactttctccctcctccttttcctgtgttctcttaagcagatagcacatacccccacccagtaccaaatttcagaacacaagaaggtccagttcttcccccttcacataaaggaacatggtttgtcagcctttctcctgtttatgggtttcttccagcagaacagagacattgccaaccatattggatctgcttgctgtccaaaccagcaaactttcctgggcaaatcacaatcagtgagtaaatagacagcctttctgctgccttgggtttctgtgcagataaacagaaatgctctgattagaaaggaaatgaatggttccactcaaatgtcctgcaatttaggattgcagatttctgccttgaaatacctgtttctttgggacattccgtcctgatgatttttatttttgttggtttttatttttggggggaatgacatgtttgggtcttttatacatgaaaatttgtttgacaataatctcacaaaacatattttacatctgaacaaaatgcctttttgtttaccgtagcgtatacatttgttttgggatttttgtgtgtttgttgggaattttgtttttagccaggtcagtattgatgaggctgatcatttggctctttttttccttccagaagagttgcatcaacaaagttaattgtatttatgtatgtaaatagattttaagcttcattataaaatattgttaatgcctataactttttttcaatttttttgtgtgtgtttctaaggactttttcttaggtttgctaaatactgtagggaaaaaaatgcttctttctactttgtttattttagactttaaaatgagctacttcttattcacttttgtaaacagctaatagcatggttccaattttttttaagttcactttttttgttctaggggaaatgaatgtgcaaaaaaagaaaaagaactgttggttatttgtgttattctggatgtataaaaatcaatggaaaaaaataaactttcaaattgaaatgacggtataacacatctactgaaaaagcaacgggaaatgtggtcctatttaagccagcccccacctagggtctatttgtgtggcagttattgggtttggtcacaaaacatcctgaaaattcgtgcgtgggcttctttctccctggtacaaacgtatggaatgcttcttaaaggggaactgtcaagctggtgtcttcagccagatgacatgagagaatatcccagaaccctctctccaaggtgtttctagatagcacaggagagcaggcactgcactgtccacagtccacggtacacagtcgggtgggccgcctcccctctcctgggagcattcgtcgtgcccagcctgagcagggcagctggactgctgctgttcaggagccaccagagccttcctctctttgtaccacagtttcttctgtaaatccagtgttacaatcagtgtgaatggcaaataaacagtttgacaagtacatacaccata

SEQ ID NO: 3730 - DNA, 1690 bp, Homo sapiens
ctttgggcctcataaacaaccacagaaccacaagttgggtagcctggcagtgtcagaagtctgaacccagcatagtggtcagcaggcaggacgaatcacactgaatgcaaaccacagggtttcgcagcgtggtaaaagaaatcattgagtcccccgccttcagaagagggtgcattttcaggaggaagcgatggcttcagacagcatatttgagtcatttccttcgtacccacagtgcttcatgagagaatgcatacttggaatgaatccttctagagacgtccacgatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaagacatcggcagaaactagatgatcagaccaagcccgggagcttgtccttttccgagcggctcagtgaactggagcagctgcggcgcacagccatgagggtcagcccacaccacccagcccccacgcccaaccctcgtgcctccctgaaccactccactgcctttaaccctcagcctcagagtcagatgcaggatacaaggcagatccaaccatccccaccgtggtcctacgatcagtcctaccaatacctgggatccattgcctctccttctgtgcacccagcaacgcccatttcacctggacgtgccagcggcatgacaaccctctctgcagaactttccagtcgactctcaacggcacccgacctgacagcgttcagcgacccgcgccagttccccgcgctgccctccatctccgacccccgcatgcactatccaggcgccttcacctactccccgacgccggtcacctcgggcatcggcatcggcatgtcggccatgggctcggccacgcgctaccacacctacctgccgccgccctaccccggctcgtcgcaagcgcagggaggcccgttccaagccagctcgccctcctaccacctgtactacggcgcctcggccggctcctaccagttctccatggtgggcggcgagcgctcgccgccgcgcatcctgccgccctgcaccaacgcctccaccggctccgcgctgctcaaccccagcctcccgaaccagagcgacgtggtggaggccgagggcagccacagcaactcccccaccaacatggcgcgggcctcctgttcgcgacaagcccgccgggatcccgggccctgggcccggccaccgtcctggggccgagggcgcccgacggccaggatctcgctgtag

SEQ ID NO: 3731 - DNA, 346 bp, Homo sapiens
cacaagttgggtagcctggcagtgtcagaagtctgaacccagcatagtggtcagcaggcaggacgaatcacactgaatgcaaaccacagggtttcgcagcgtggtgagcatcaccaacccacagccaaggcggcgctggctttttttttttttttaatctttaacaatttgaatatttgtttttacaaaggtaaaagaaatcattgagtcccccgccttcagaagagggtgcattttcaggaggaagcgatggcttcagacagcatatttgagtcatttccttcgtacccacagtgcttcatgagagaatgcatacttggaatgaatccttctagagacgtccacg

SEQ ID NO: 3732 - DNA, 1901 bp, Homo sapiens
gagcatcaccaacccacagccaaggcggcgctggctttttttttttttttaatctttaacaatttgaatatttgtttttacaaaggtaaaagaaatcattgagtcccccgccttcagaagagggtgcattttcaggaggaagcgatggcttcagacagcatatttgagtcatttccttcgtacccacagtgcttcatgagagaatgcatacttggaatgaatccttctagagacgtccacgatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaagacatcggcagaaactagatgatcagaccaagcccgggagcttgtccttttccgagcggctcagtgaactggagcagctgcggcgcacagccatgagggtcagcccacaccacccagcccccacgcccaaccctcgtgcctccctgaaccactccactgcctttaaccctcagcctcagagtcagatgcaggatacaaggcagatccaaccatccccaccgtggtcctacgatcagtcctaccaatacctgggatccattgcctctccttctgtgcacccagcaacgcccatttcacctggacgtgccagcggcatgacaaccctctctgcagaactttccagtcgactctcaacggcacccgacctgacagcgttcagcgacccgcgccagttccccgcgctgccctccatctccgacccccgcatgcactatccaggcgccttcacctactccccgacgccggtcacctcgggcatcggcatcggcatgtcggccatgggctcggccacgcgctaccacacctacctgccgccgccctaccccggctcgtcgcaagcgcagggaggcccgttccaagccagctcgccctcctaccacctgtactacggcgcctcggccggctcctaccagttctccatggtgggcggcgagcgctcgccgccgcgcatcctgccgccctgcaccaacgcctccaccggctccgcgctgctcaaccccagcctcccgaaccagagcgacgtggtggaggccgagggcagccacagcaactcccccaccaacatggcgccctccgcgcgcctggaggaggccgtgtggaggccctactgaggcgccaggcctggcccggctgggccccgcgggccgccgccttcgcctccgggcgcgcgggcctcctgttcgcgacaagcccgccgggatcccgggccctgggcccggccaccgtcctggggccgagggcgcccgacggccaggatctcgctgtaggtcaggcccgcgcagcctcctgcgcccagaagcccacgccgccgccgtctgctggcgccccggccctcgcggaggtgtccgaggcgacgcacctcgagggtgtccgccggccccagcacccaggggacgcgctggaaagcaaacaggaagattcccgg

SEQ ID NO: 3733 - DNA, 5967 bp, Homo sapiens
ctttgggcctcataaacaaccacagaaccacaagttgggtagcctggcagtgtcagaagtctgaacccagcatagtggtcagcaggcaggacgaatcacactgaatgcaaaccacagggtttcgcagcgtggtaaaagaaatcattgagtcccccgccttcagaagagggtgcattttcaggaggaagcgatggcttcagacagcatatttgagtcatttccttcgtacccacagtgcttcatgagagaatgcatacttggaatgaatccttctagagacgtccacgatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaagacatcggcagaaactagatgatcagaccaagcccgggagcttgtccttttccgagcggctcagtgaactggagcagctgcggcgcacagccatgagggtcagcccacaccacccagcccccacgcccaaccctcgtgcctccctgaaccactccactgcctttaaccctcagcctcagagtcagatgcaggatacaaggcagatccaaccatccccaccgtggtcctacgatcagtcctaccaatacctgggatccattgcctctccttctgtgcacccagcaacgcccatttcacctggacgtgccagcggcatgacaaccctctctgcagaactttccagtcgactctcaacggcacccgacctgacagcgttcagcgacccgcgccagttccccgcgctgccctccatctccgacccccgcatgcactatccaggcgccttcacctactccccgacgccggtcacctcgggcatcggcatcggcatgtcggccatgggctcggccacgcgctaccacacctacctgccgccgccctaccccggctcgtcgcaagcgcagggaggcccgttccaagccagctcgccctcctaccacctgtactacggcgcctcggccggctcctaccagttctccatggtgggcggcgagcgctcgccgccgcgcatcctgccgccctgcaccaacgcctccaccggctccgcgctgctcaaccccagcctcccgaaccagagcgacgtggtggaggccgagggcagccacagcaactcccccaccaacatggcgccctccgcgcgcctggaggaggccgtgtggaggccctactgaggcgccaggcctggcccggctgggccccgcgggccgccgccttcgcctccgggcgcgcgggcctcctgttcgcgacaagcccgccgggatcccgggccctgggcccggccaccgtcctggggccgagggcgcccgacggccaggatctcgctgtaggtcaggcccgcgcagcctcctgcgcccagaagcccacgccgccgccgtctgctggcgccccggccctcgcggaggtgtccgaggcgacgcacctcgagggtgtccgccggccccagcacccaggggacgcgctggaaagcaaacaggaagattcccggagggaaactgtgaatgcttctgatttagcaatgctgtgaataaaaagaaagattttatacccttgacttaactttttaaccaagttgtttattccaaagagtgtggaattttggttggggtggggggagaggagggatgcaactcgccctgtttggcatctaattcttatttttaatttttccgcaccttatcaattgcaaaatgcgtatttgcatttgggtggtttttatttttatatacgtttatataaatatatataaattgagcttgcttctttcttgctttgaccatggaaagaaatatgattcccttttctttaagttttatttaacttttcttttggacttttgggtagttgtttttttttgttttgttttgtttttttgagaaacagctacagctttgggtcatttttaactactgtattcccacaaggaatccccagatatttatgtatcttgatgttcagacatttatgtgttgataattttttaattatttaaatgtacttatattaagaaaaatatcaagtactacattttcttttgttcttgatagtagccaaagttaaatgtatcacattgaagaaggctagaaaaaaagaatgagtaatgtgatcgcttggttatccagaagtattgtttacattaaactccctttcatgttaatcaaacaagtgagtagctcacgcagcaacgtttttaataggatttttagacactgagggtcactccaaggatcagaagtatggaattttctgccaggctcaacaagggtctcatatctaacttcctccttaaaacagagaaggtcaatctagttccagagggttgaggcaggtgccaataattacatctttggagaggatttgatttctgcccagggatttgctcaccccaaggtcatctgataatttcacagatgctgtgtaacagaacacagccaaagtaaactgtgtaggggagccacatttacataggaaccaaatcaatgaatttaggggttacgattatagcaatttaagggcccaccagaagcaggcctcgaggagtcaatttgcctctgtgtgcctcagtggagacaagtgggaaaacatggtcccacctgtgcgagaccccctgtcctgtgctgctcactcaacaacatctttgtgttgctttcaccaggctgagaccctaccctatggggtatatgggcttttacctgtgcaccagtgtgacaggaaagattcatgtcactactgtccgtggctacaattcaaaggtatccaatgtcgctgtaaattttatggcactatttttattggaggatttggtcagaatgcagttgttgtacaactcataaatactaactgctgattttgacacatgtgtgctccaaatgatctggtggttatttaacgtacctcttaaaattcgttgaaacgatttcaggtcaactctgaagagtatttgaaagcaggacttcagaacagtgtttgatttttattttataaatttaagcattcaaattaggcaaatctttggctgcaggcagcaaaaacagctggacttatttaaaacaacttgtttttgagttttcttatatatatattgattatttgttttacacacatgcagtagcactttggtaagagttaaagagtaaagcagcttatgttgtcaggtcgttcttatctagagaagagctatagcagatctcggacaaactcagaatatattcactttcatttttgacaggattccctccacaactcagtttcatatattattccgtattacatttttgcagctaaattaccataaaatgtcagcaaatgtaaaaatttaatttctgaaaagcaccattagcccatttcccccaaattaaacgtaaatgttttttttcagcacatgttaccatgtctgacctgcaaaaatgctggagaaaaatgaaggaaaaaattatgtttttcagtttaattctgttaactgaagatattccaactcaaaaccagcctcatgctctgattagataatcttttacattgaacctttactctcaaagccatgtgtggagggggcttgtcactattgtaggctcactggattggtcatttagagtttcacagactcttaccagcatatatagtatttaattgtttcaaaaaaaatcaaactgtagttgttttggcgataggtctcacgcaacacatttttgtatgtgtgtgtgtgtgcgtgtgtgtgtgtgtgtgtgaaaaattgcattcattgacttcaggtagattaaggtatctttttattcattgccctcaggaaagttaaggtatcaatgagacccttaagccaatcatgtaataactgcatgtgtctggtccaggagaagtattgaataagccatttctactgcttactcatgtccctatttatgatttcaacatggatacatatttcagttctttctttttctcactatctgaaaatacatttccctccctctcttccccccaatatctccctttttttctctcttcctctatcttccaaaccccactttctccctcctccttttcctgtgttctcttaagcagatagcacatacccccacccagtaccaaatttcagaacacaagaaggtccagttcttcccccttcacataaaggaacatggtttgtcagcctttctcctgtttatgggtttcttccagcagaacagagacattgccaaccatattggatctgcttgctgtccaaaccagcaaactttcctgggcaaatcacaatcagtgagtaaatagacagcctttctgctgccttgggtttctgtgcagataaacagaaatgctctgattagaaaggaaatgaatggttccactcaaatgtcctgcaatttaggattgcagatttctgccttgaaatacctgtttctttgggacattccgtcctgatgatttttatttttgttggtttttatttttggggggaatgacatgtttgggtcttttatacatgaaaatttgtttgacaataatctcacaaaacatattttacatctgaacaaaatgcctttttgtttaccgtagcgtatacatttgttttgggatttttgtgtgtttgttgggaattttgtttttagccaggtcagtattgatgaggctgatcatttggctctttttttccttccagaagagttgcatcaacaaagttaattgtatttatgtatgtaaatagattttaagcttcattataaaatattgttaatgcctataactttttttcaatttttttgtgtgtgtttctaaggactttttcttaggtttgctaaatactgtagggaaaaaaatgcttctttctactttgtttattttagactttaaaatgagctacttcttattcacttttgtaaacagctaatagcatggttccaattttttttaagttcactttttttgttctaggggaaatgaatgtgcaaaaaaagaaaaagaactgttggttatttgtgttattctggatgtataaaaatcaatggaaaaaaataaactttcaaattgaaatgacggtataacacatctactgaaaaagcaacgggaaatgtggtcctatttaagccagcccccacctagggtctatttgtgtggcagttattgggtttggtcacaaaacatcctgaaaattcgtgcgtgggcttctttctccctggtacaaacgtatggaatgcttcttaaaggggaactgtcaagctggtgtcttcagccagatgacatgagagaatatcccagaaccctctctccaaggtgtttctagatagcacaggagagcaggcactgcactgtccacagtccacggtacacagtcgggtgggccgcctcccctctcctgggagcattcgtcgtgcccagcctgagcagggcagctggactgctgctgttcaggagccaccagagccttcctctctttgtaccacagtttcttctgtaaatccagtgttacaatcagtgtgaatggcaaataaacagtttgacaagtacatacaccata

SEQ ID NO: 3734 - DNA, 792 bp, Homo sapiens
gagcatcaccaacccacagccaaggcggcgctggctttttttttttttttaatctttaacaatttgaatatttgtttttacaaaggtaaaagaaatcattgagtcccccgccttcagaagagggtgcattttcaggaggaagcgatggcttcagacagcatatttgagtcatttccttcgtacccacagtgcttcatgagagaatgcatacttggaatgaatccttctagagacgtccacgatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaaactctttgacctggcctcggtatcctcacatttaa

SEQ ID NO: 3735 - DNA, 2720 bp, Homo sapiens
catagagccagcgggcgcgggcgggacgggcgccccgcggccggacccagccagggcaccacgctgcccggccctgcgccgccaggcacttctttccggggctcctagggacgccagaaggaagtcaacctctgctgcttctccttggcctgcgttggaccttcctttttttgttgtttttttttgtttttcccctttcttccttttgaattaactggcttcttggctggatgttttcaacttctttcctggctgcgaacttttccccaattgttttccttttacaacagggggagaaagtgctctgtggtccgaggcgagccgtgaagttgcgtgtgcgtggcagtgtgcgtggcaggatgtgcgtgcgtgtgtaacccgagccgcccgatctgtttcgatctgcgccgcggagccctccctcaaggcccgctccacctgctgcggttacgcggcgctcgtgggtgttcgtgcctcggagcagctaaccggcgggtgctgggcgacggtggaggagtatcgtctcgctgctgcccgagtcagggctgagtcacccagctgatgtagacagtggctgccttccgaagagtgcgtgtttgcatgtgtgtgactctgcggctgctcaactcccaacaaaccagaggaccagccacaaacttaaccaacatccccaaacccgagttcacagatgtgggagagctgtagaaccctgagtgtcatcgactgggccttcttatgattgttgttttaagattagctgaagatctctgaaacgctgaattttctgcactgagcgttttgacagaattcattgagagaacagagaacatgacaagtacttctagctcagcactgctccaactactgaagctgattttcaaggctacttaaaaaaatctgcagcgtacattaatggatttctgttgtgtttaaattctccacagattgtattgtaaatattttatgaagtagagcatatgtatatatttatatatacgtgcacatacattagtagcactacctttggaagtctcagctcttgcttttcgggactgaagccagttttgcatgataaaagtggccttgttacgggagataattgtgttctgttgggactttagacaaaactcacctgcaaaaaactgacaggcattaactactggaacttccaaataatgtgtttgctgatcgttttactcttcgcataaatattttaggaagtgtatgagaattttgccttcaggaacttttctaacagccaaagacagaacttaacctctgcaagcaagattcgtggaagatagtctccactttttaatgcactaagcaatcggttgctaggagcccatcctgggtcagaggccgatccgcagaaccagaacgttttcccctcctggactgttagtaacttagtctccctcctcccctaaccacccccgcccccccccaccccccgcagtaataaaggcccctgaacgtgtatgttggtctcccgggagctgcttgctgaagatccgcgcccctgtcgccgtctggtaggagctgtttgcagggtcctaactcaatcggcttgttgtgatgcgtatccccgtagatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaagacatcggcagaaactagatgatcagaccaagcccgggagcttgtccttttccgagcggctcagtgaactggagcagctgcggcgcacagccatgagggtcagcccacaccacccagcccccacgcccaaccctcgtgcctccctgaaccactccactgcctttaaccctcagcctcagagtcagatgcaggaggaagacacagcaccctggagatgttaaggcagaagtcagttcttctgtccatccctctccccagccaggatagagctatcttttccatctcatcctcagaagagactcagaagaaagatgacagccctcagaatgcacgttatgaggaaggcagaatgtgggtctgtaattcctccgtgtcccttctccccctctgcaaaccgtcgtaacaataatagttcctaacacatgggacaattgtgaggattaaatgagttagcctgcagaaatcacttgatgcacagcacatgggaagcattgtgtgtatttattaatccttcacaaagtctttgagatatatttttatcaaatatttagcatggatcccggtacactttcaatacttaataaatggtcaatgttattctttttcacta

SEQ ID NO: 3736 - DNA, 1770 bp, Homo sapiens
atgcttcattcgcctcacaaacaaccacagaaccacaagtgcggtgcaaactttctccaggaggacagcaagaagtctctggtttttaaatggttaatctccgcaggtcactaccagccaccgagaccaacagagtcatttaaggctgcaagcagtatttacaacagagggtacaagttctatctgaaaaaaaaaggagggactatggcatcaaacagcctcttcagcacagtgacaccatgtcagcaaaacttcttttgggatccgagcaccagccggcgcttcagccccccctccagcagcctgcagcccggcaaaatgagcgacgtgagcccggtggtggctgcgcaacagcagcagcaacagcagcagcagcaacagcagcagcagcagcagcaacagcagcagcagcagcaggaggcggcggcggcggctgcggcggcggcggcggctgcggcggcggcagctgcagtgccccggttgcggccgccccacgacaaccgcaccatggtggagatcatcgccgaccacccggccgaactcgtccgcaccgacagccccaacttcctgtgctcggtgctgccctcgcactggcgctgcaacaagaccctgcccgtggccttcaaggtggtagccctcggagaggtaccagatgggactgtggttactgtcatggcgggtaacgatgaaaattattctgctgagctccggaatgcctctgctgttatgaaaaaccaagtagcaaggttcaacgatctgagatttgtgggccggagtggacgaggcaagagtttcaccttgaccataaccgtcttcacaaatcctccccaagtagctacctatcacagagcaattaaagttacagtagatggacctcgggaacccagaaggcacagacagaagcttgatgactctaaacctagtttgttctctgaccgcctcagtgatttagggcgcattcctcatcccagtatgagagtaggtgtcccgcctcagaacccacggccctccctgaactctgcaccaagtccttttaatccacaaggacagagtcagattacagaccccaggcaggcacagtcttccccgccgtggtcctatgaccagtcttacccctcctacctgagccagatgacgtccccgtccatccactctaccaccccgctgtcttccacacggggcactgggcttcctgccatcaccgatgtgcctaggcgcatttcagatgatgacactgccacctctgacttctgcctctggccttccactctcagtaagaagagccaggcaggtgcttcagaactgggccctttttcagaccccaggcagttcccaagcatttcatccctcactgagagccgcttctccaacccacgaatgcactatccagccacctttacttacaccccgccagtcacctcaggcatgtccctcggtatgtccgccaccactcactaccacacctacctgccaccaccctaccccggctcttcccaaagccagagtggacccttccagaccagcagcactccatatctctactatggcacttcgtcaggatcctatcagtttcccatggtgccggggggagaccggtctccttccagaatgcttccgccatgcaccaccacctcgaatggcagcacgctattaaatccaaatttgcctaaccagaatgatggtgttgacgctgatggaagccacagcagttccccaactgttttgaattctagtggcagaatggatgaatctgtttggcgaccatattga

SEQ ID NO: 3737 - DNA, 5700 bp, Homo sapiens
ggactccaactgggagggggcgccagcgcacccaggacgcggtgccccaagggaccccattccaagctgcaaactcaagtcccccgcctccccaggccaaacacacccccgcgcccgttcgcagctgccaccccgggtgttccaaagactccggcaaagatctgcgcctcccgggtctccctacccgccagcccgactgcgccgcatcgccagactctgttggcccatcagactccgcccggcagtcggcctcatcaaacttgatttctcacctcctcagccccatcacctccatcctctttccccccgtctcgccttcacccccccaatttcctccttgcccctcatttccaccctcctccccctcccccggccacttcgctaacttgtggctgttgtgatgcgtattcccgtagatccgagcaccagccggcgcttcagccccccctccagcagcctgcagcccggcaaaatgagcgacgtgagcccggtggtggctgcgcaacagcagcagcaacagcagcagcagcaacagcagcagcagcagcagcaacagcagcagcagcagcaggaggcggcggcggcggctgcggcggcggcggcggctgcggcggcggcagctgcagtgccccggttgcggccgccccacgacaaccgcaccatggtggagatcatcgccgaccacccggccgaactcgtccgcaccgacagccccaacttcctgtgctcggtgctgccctcgcactggcgctgcaacaagaccctgcccgtggccttcaaggtggtagccctcggagaggtaccagatgggactgtggttactgtcatggcgggtaacgatgaaaattattctgctgagctccggaatgcctctgctgttatgaaaaaccaagtagcaaggttcaacgatctgagatttgtgggccggagtggacgaggcaagagtttcaccttgaccataaccgtcttcacaaatcctccccaagtagctacctatcacagagcaattaaagttacagtagatggacctcgggaacccagaaggcacagacagaagcttgatgactctaaacctagtttgttctctgaccgcctcagtgatttagggcgcattcctcatcccagtatgagagtaggtgtcccgcctcagaacccacggccctccctgaactctgcaccaagtccttttaatccacaaggacagagtcagattacagaccccaggcaggcacagtcttccccgccgtggtcctatgaccagtcttacccctcctacctgagccagatgacgtccccgtccatccactctaccaccccgctgtcttccacacggggcactgggcttcctgccatcaccgatgtgcctaggcgcatttcagatgatgacactgccacctctgacttctgcctctggccttccactctcagtaagaagagccaggcaggtgcttcagaactgggccctttttcagaccccaggcagttcccaagcatttcatccctcactgagagccgcttctccaacccacgaatgcactatccagccacctttacttacaccccgccagtcacctcaggcatgtccctcggtatgtccgccaccactcactaccacacctacctgccaccaccctaccccggctcttcccaaagccagagtggacccttccagaccagcagcactccatatctctactatggcacttcgtcaggatcctatcagtttcccatggtgccggggggagaccggtctccttccagaatgcttccgccatgcaccaccacctcgaatggcagcacgctattaaatccaaatttgcctaaccagaatgatggtgttgacgctgatggaagccacagcagttccccaactgttttgaattctagtggcagaatggatgaatctgtttggcgaccatattgaaattcctcagcagtggcccagtggtatctgggggccacatcccacacgtatcaatatatacatatatagagagagtgcatatatatgtatatcgattagctatctacaaagtgcctattttttagaagatttttcattcactcactcagtcatgatcttgcagccataagagggtagatattgagaagcagaaggctcaagagagacaattgcaatcgagcttcagattgtttactatttaagatgtacttttacaaaggaacaaagaagggaaaaggtatttttgtttttgttgtttggtctgttatcatcaataacctgttcatatgccaattcagagaggtggactccaggttcaggagggagaagagcaaagccgcttcctctctgtgctttgaaacttcacaccctcacggtggcagctgtgtatggaccagtgccctccgcagacagctcacaaaaccagttgaggtgcactaaagggacatgaggtagaatggatgcttccatcacagtaccatcattcagaataactcttccaatttctgctttcagacatgctgcaggtcctcatctgaactgttgggttcgtttttttttttttttttcctgctccaagaaagtgacttcaaaaataactgatcaggatagattattttattttactttttaacactccttctccccttttcccactgaaccaaaaagaaatcccatccctaaaacctgccttctccttttatgcaaaactgaaaatggcaatacattattatagccataatggtatagatagtgattgcgtttggctatgtgttgttttctttttttttaaattatgaatatgtgtaaaatctgaggtaacttgctaacgtgaatggtcatataactttaaagatatatttataattatttaatgacatttggacccttgaaacatttcttagtgtattgatatgttgacttcggtctctaaaagtgctctttattaaataacaaatttcttcagtggtctagagccatatctgaaatattgctaagcaatttcagttcatccaggcacaatgtgattttaaaaaatacttccatctccaaatattttagatatagattgtttttgtgatgtatgaaggaaatgttatgtttagttctttcagatctttgaatgcctctaacacagctttgccttctaaagcggtaattagggatttaaaaaacaacctttagccctttatcagcatgaaatgctggagtgatgtggttttctaatttctttggggtaattatgactcttgtcatattaaaaagacaagcacaagtaaatcattgaactacagaaaaatgttctgtggtttcatagttaagcaaaactctaaatcgccaggcttcatagcaaagacatagtcagctaaaagccgcacatgtggatagagggttcaattatgagacacctagtacaggagagcaaaattgcaccagagattcttaaccaaccagccttaccaaacaacacaacaggggaaccccaatctgccttacccaaggccccactggcagctttccacagaatttgcatttagaggagcagaatgacatcactgtcctttgggagtaggtcctctgaaaaggcagcaggttccagcaggtagctgagctgagaggacatatggcccacggggacctacagacagcctttgacatttgtatttcttacaatggagggccaaggagggcaaggggctgtggagtttggtgtctactagtgtgtatgaatttgagctagagtccttctgtggcatgcactttgaccactcctggcagtcacatggcagatttccaagtgcaaatccttaatccaaacaaggatcatctaatgacaccaccaggccaatccctgctctcctccccgaaaagtcagggtcccttcattggaatcctccacccacccaagcagaatttagcagagatttgccttcaaaccctaacggcccccttgttctctggtccttctcaaacccacctttgtaggccacccagcattgcaggacagcgtgtggggcagctggacctgtgcttcctgcctgggagtctcccttggaattcatcctgactccttctaataaaaatggatgggaaagcaaaacactttgccttctaaaggccgtataccaagtatgcttagataaataagccacttttctattacttaagtaagaaggaagtagtaattgatactatttattgtttgtgtgtggtagcttgaagcacaccactgtccatttatttgtaagtgtaaaatatgtgtgtttgtttcagcagcacttaaaaaagccagtgtctggttacacatttcaattttaattaattgacataaaaatgctaccgccagtgccagctgcatcctatttaattaaaaaggtactatatttgtacattattttttaatgttaaaagggcttttttaagtttacagtacacataccgagtgactttagggatgcttttgtgttgaaatgttactatagtggctgcaggcagcaacccagaaacactttagaagctttttttccttgggaaaaattcaagcacttcttccctccaccctcactccaaccaccccaatgggggtaattcacatttcttagaacaaattctgcccttttttggtctagggattaaaattttgtttttctttctttctttttttttttttttcactgaacccttaatttgcactgggtcatgtgtttgatttgtgatttcaagaccaaagcaaagtcttactactactgtggaaccatgtactagttcctgggaattaaaatagcgtggttctctttgtagcacaaacattgctggaatttgcagtcttttcaatgcagccacatttttatccatttcagttgtctcacaaattttaacccatatcagagttccagaacaggtaccacagctttggttttagattagtggaataacattcagcccagaactgagaaactcaacagattaactatcgtttgctctttagacggtctcactgcctctcacttgccagagccctttcaaaatgagcagagaagtccacaccattagggaccatctgtgataaattcagaagggaggagatgtgtgtacagctttaaggattccctcaattccgaggaaagggactggcccagaatccaggttaatacatggaaacacgaagcattagcaaaagtaataattatacctatggtatttgaaagaacaataataaaagacacttcttccaaaccttgaatttgttgtttttagaaaacgaatgcatttaaaaatattttctatgtgagaattttttagatgtgtgtttacttcatgtttacaaataactgtttgctttttaatgcagtactttgaaatatatcagccaaaaccataacttacaataatttcttaggtattctgaataaaattccatttcttttggatatgctttaccattcttaggtttctgtggaacaaaaatatttgtagcattttgtgtaaatacaagctttcatttttattttttccaattgctattgcccaagaattgctttccatgcacatattgtaaaaattccgctttgtgccacaggtcatgattgtggatgagtttactcttaacttcaaagggactatttgtattgtatgttgcaactgtaaattgaattatttggcatttttctcatgattgtaatattaatttgaagtttgaatttaattttcaataaaatggcttttttggttttgtt

SEQ ID NO: 3738 - DNA, 5634 bp, Homo sapiens
ggactccaactgggagggggcgccagcgcacccaggacgcggtgccccaagggaccccattccaagctgcaaactcaagtcccccgcctccccaggccaaacacacccccgcgcccgttcgcagctgccaccccgggtgttccaaagactccggcaaagatctgcgcctcccgggtctccctacccgccagcccgactgcgccgcatcgccagactctgttggcccatcagactccgcccggcagtcggcctcatcaaacttgatttctcacctcctcagccccatcacctccatcctctttccccccgtctcgccttcacccccccaatttcctccttgcccctcatttccaccctcctccccctcccccggccacttcgctaacttgtggctgttgtgatgcgtattcccgtagatccgagcaccagccggcgcttcagccccccctccagcagcctgcagcccggcaaaatgagcgacgtgagcccggtggtggctgcgcaacagcagcagcaacagcagcagcagcaacagcagcagcagcagcagcaacagcagcagcagcagcaggaggcggcggcggcggctgcggcggcggcggcggctgcggcggcggcagctgcagtgccccggttgcggccgccccacgacaaccgcaccatggtggagatcatcgccgaccacccggccgaactcgtccgcaccgacagccccaacttcctgtgctcggtgctgccctcgcactggcgctgcaacaagaccctgcccgtggccttcaaggtggtagccctcggagaggtaccagatgggactgtggttactgtcatggcgggtaacgatgaaaattattctgctgagctccggaatgcctctgctgttatgaaaaaccaagtagcaaggttcaacgatctgagatttgtgggccggagtggacgaggcaagagtttcaccttgaccataaccgtcttcacaaatcctccccaagtagctacctatcacagagcaattaaagttacagtagatggacctcgggaacccagaaggcacagacagaagcttgatgactctaaacctagtttgttctctgaccgcctcagtgatttagggcgcattcctcatcccagtatgagagtaggtgtcccgcctcagaacccacggccctccctgaactctgcaccaagtccttttaatccacaaggacagagtcagattacagaccccaggcaggcacagtcttccccgccgtggtcctatgaccagtcttacccctcctacctgagccagatgacgtccccgtccatccactctaccaccccgctgtcttccacacggggcactgggcttcctgccatcaccgatgtgcctaggcgcatttcaggtgcttcagaactgggccctttttcagaccccaggcagttcccaagcatttcatccctcactgagagccgcttctccaacccacgaatgcactatccagccacctttacttacaccccgccagtcacctcaggcatgtccctcggtatgtccgccaccactcactaccacacctacctgccaccaccctaccccggctcttcccaaagccagagtggacccttccagaccagcagcactccatatctctactatggcacttcgtcaggatcctatcagtttcccatggtgccggggggagaccggtctccttccagaatgcttccgccatgcaccaccacctcgaatggcagcacgctattaaatccaaatttgcctaaccagaatgatggtgttgacgctgatggaagccacagcagttccccaactgttttgaattctagtggcagaatggatgaatctgtttggcgaccatattgaaattcctcagcagtggcccagtggtatctgggggccacatcccacacgtatcaatatatacatatatagagagagtgcatatatatgtatatcgattagctatctacaaagtgcctattttttagaagatttttcattcactcactcagtcatgatcttgcagccataagagggtagatattgagaagcagaaggctcaagagagacaattgcaatcgagcttcagattgtttactatttaagatgtacttttacaaaggaacaaagaagggaaaaggtatttttgtttttgttgtttggtctgttatcatcaataacctgttcatatgccaattcagagaggtggactccaggttcaggagggagaagagcaaagccgcttcctctctgtgctttgaaacttcacaccctcacggtggcagctgtgtatggaccagtgccctccgcagacagctcacaaaaccagttgaggtgcactaaagggacatgaggtagaatggatgcttccatcacagtaccatcattcagaataactcttccaatttctgctttcagacatgctgcaggtcctcatctgaactgttgggttcgtttttttttttttttttcctgctccaagaaagtgacttcaaaaataactgatcaggatagattattttattttactttttaacactccttctccccttttcccactgaaccaaaaagaaatcccatccctaaaacctgccttctccttttatgcaaaactgaaaatggcaatacattattatagccataatggtatagatagtgattgcgtttggctatgtgttgttttctttttttttaaattatgaatatgtgtaaaatctgaggtaacttgctaacgtgaatggtcatataactttaaagatatatttataattatttaatgacatttggacccttgaaacatttcttagtgtattgatatgttgacttcggtctctaaaagtgctctttattaaataacaaatttcttcagtggtctagagccatatctgaaatattgctaagcaatttcagttcatccaggcacaatgtgattttaaaaaatacttccatctccaaatattttagatatagattgtttttgtgatgtatgaaggaaatgttatgtttagttctttcagatctttgaatgcctctaacacagctttgccttctaaagcggtaattagggatttaaaaaacaacctttagccctttatcagcatgaaatgctggagtgatgtggttttctaatttctttggggtaattatgactcttgtcatattaaaaagacaagcacaagtaaatcattgaactacagaaaaatgttctgtggtttcatagttaagcaaaactctaaatcgccaggcttcatagcaaagacatagtcagctaaaagccgcacatgtggatagagggttcaattatgagacacctagtacaggagagcaaaattgcaccagagattcttaaccaaccagccttaccaaacaacacaacaggggaaccccaatctgccttacccaaggccccactggcagctttccacagaatttgcatttagaggagcagaatgacatcactgtcctttgggagtaggtcctctgaaaaggcagcaggttccagcaggtagctgagctgagaggacatatggcccacggggacctacagacagcctttgacatttgtatttcttacaatggagggccaaggagggcaaggggctgtggagtttggtgtctactagtgtgtatgaatttgagctagagtccttctgtggcatgcactttgaccactcctggcagtcacatggcagatttccaagtgcaaatccttaatccaaacaaggatcatctaatgacaccaccaggccaatccctgctctcctccccgaaaagtcagggtcccttcattggaatcctccacccacccaagcagaatttagcagagatttgccttcaaaccctaacggcccccttgttctctggtccttctcaaacccacctttgtaggccacccagcattgcaggacagcgtgtggggcagctggacctgtgcttcctgcctgggagtctcccttggaattcatcctgactccttctaataaaaatggatgggaaagcaaaacactttgccttctaaaggccgtataccaagtatgcttagataaataagccacttttctattacttaagtaagaaggaagtagtaattgatactatttattgtttgtgtgtggtagcttgaagcacaccactgtccatttatttgtaagtgtaaaatatgtgtgtttgtttcagcagcacttaaaaaagccagtgtctggttacacatttcaattttaattaattgacataaaaatgctaccgccagtgccagctgcatcctatttaattaaaaaggtactatatttgtacattattttttaatgttaaaagggcttttttaagtttacagtacacataccgagtgactttagggatgcttttgtgttgaaatgttactatagtggctgcaggcagcaacccagaaacactttagaagctttttttccttgggaaaaattcaagcacttcttccctccaccctcactccaaccaccccaatgggggtaattcacatttcttagaacaaattctgcccttttttggtctagggattaaaattttgtttttctttctttctttttttttttttttcactgaacccttaatttgcactgggtcatgtgtttgatttgtgatttcaagaccaaagcaaagtcttactactactgtggaaccatgtactagttcctgggaattaaaatagcgtggttctctttgtagcacaaacattgctggaatttgcagtcttttcaatgcagccacatttttatccatttcagttgtctcacaaattttaacccatatcagagttccagaacaggtaccacagctttggttttagattagtggaataacattcagcccagaactgagaaactcaacagattaactatcgtttgctctttagacggtctcactgcctctcacttgccagagccctttcaaaatgagcagagaagtccacaccattagggaccatctgtgataaattcagaagggaggagatgtgtgtacagctttaaggattccctcaattccgaggaaagggactggcccagaatccaggttaatacatggaaacacgaagcattagcaaaagtaataattatacctatggtatttgaaagaacaataataaaagacacttcttccaaaccttgaatttgttgtttttagaaaacgaatgcatttaaaaatattttctatgtgagaattttttagatgtgtgtttacttcatgtttacaaataactgtttgctttttaatgcagtactttgaaatatatcagccaaaaccataacttacaataatttcttaggtattctgaataaaattccatttcttttggatatgctttaccattcttaggtttctgtggaacaaaaatatttgtagcattttgtgtaaatacaagctttcatttttattttttccaattgctattgcccaagaattgctttccatgcacatattgtaaaaattccgctttgtgccacaggtcatgattgtggatgagtttactcttaacttcaaagggactatttgtattgtatgttgcaactgtaaattgaattatttggcatttttctcatgattgtaatattaatttgaagtttgaatttaattttcaataaaatggcttttttggttttgtt

SEQ ID NO: 3739 - DNA, 1588 bp, Homo sapiens
atggcatcaaacagcctcttcagcacagtgacaccatgtcagcaaaacttcttttgggatccgagcaccagccggcgcttcagccccccctccagcagcctgcagcccggcaaaatgagcgacgtgagcccggtggtggctgcgcaacagcagcagcaacagcagcagcagcaacagcagcagcagcagcagcaacagcagcagcagcagcaggaggcggcggcggcggctgcggcggcggcggcggctgcggcggcggcagctgcagtgccccggttgcggccgccccacgacaaccgcaccatggtggagatcatcgccgaccacccggccgaactcgtccgcaccgacagccccaacttcctgtgctcggtgctgccctcgcactggcgctgcaacaagaccctgcccgtggccttcaaggtggtagccctcggagaggtaccagatgggactgtggttactgtcatggcgggtaacgatgaaaattattctgctgagctccggaatgcctctgctgttatgaaaaaccaagtagcaaggttcaacgatctgagatttgtgggccggagtggacgaggcaagagtttcaccttgaccataaccgtcttcacaaatcctccccaagtagctacctatcacagagcaattaaagttacagtagatggacctcgggaacccagaaggcacagacagaagcttgatgactctaaacctagtttgttctctgaccgcctcagtgatttagggcgcattcctcatcccagtatgagagtaggtgtcccgcctcagaacccacggccctccctgaactctgcaccaagtccttttaatccacaaggacagagtcagattacagaccccaggcaggcacagtcttccccgccgtggtcctatgaccagtcttacccctcctacctgagccagatgacgtccccgtccatccactctaccaccccgctgtcttccacacggggcactgggcttcctgccatcaccgatgtgcctaggcgcatttcaggtgcttcagaactgggccctttttcagaccccaggcagttcccaagcatttcatccctcactgagagccgcttctccaacccacgaatgcactatccagccacctttacttacaccccgccagtcacctcaggcatgtccctcggtatgtccgccaccactcactaccacacctacctgccaccaccctaccccggctcttcccaaagccagagtggacccttccagaccagcagcactccatatctctactatggcacttcgtcaggatcctatcagtttcccatggtgccggggggagaccggtctccttccagaatgcttccgccatgcaccaccacctcgaatggcagcacgctattaaatccaaatttgcctaaccagaatgatggtgttgacgctgatggaagccacagcagttccccaactgttttgaattctagtggcagaatggatgaatctgtttggcgaccatattgaaattcctcagcagtggcccagtggtatctgggggccacatcccacacgtatcaatatatacatatatagagagagtgcatatatatgt

SEQ ID NO: 3740 - DNA, 5698 bp, Homo sapiens
caaactttctccaggaggacagcaagaagtctctggtttttaaatggttaatctccgcaggtcactaccagccaccgagaccaacagagtcagtgagtgctctctaaccacagtctatgcagtaatagtaggtccttcaaatatttgctcattctctttttgttttgtttctttgcttttcacatgttaccagctacataatttcttgacagaaaaaaataaatataaagtctatgtactccaggcatactgtaaaactaaaacaaggtttgggtatggtttgtattttcagtttaaggctgcaagcagtatttacaacagagggtacaagttctatctgaaaaaaaaaggagggactatggcatcaaacagcctcttcagcacagtgacaccatgtcagcaaaacttcttttgggatccgagcaccagccggcgcttcagccccccctccagcagcctgcagcccggcaaaatgagcgacgtgagcccggtggtggctgcgcaacagcagcagcaacagcagcagcagcaacagcagcagcagcagcagcaacagcagcagcagcagcaggaggcggcggcggcggctgcggcggcggcggcggctgcggcggcggcagctgcagtgccccggttgcggccgccccacgacaaccgcaccatggtggagatcatcgccgaccacccggccgaactcgtccgcaccgacagccccaacttcctgtgctcggtgctgccctcgcactggcgctgcaacaagaccctgcccgtggccttcaaggtggtagccctcggagaggtaccagatgggactgtggttactgtcatggcgggtaacgatgaaaattattctgctgagctccggaatgcctctgctgttatgaaaaaccaagtagcaaggttcaacgatctgagatttgtgggccggagtggacgaggcaagagtttcaccttgaccataaccgtcttcacaaatcctccccaagtagctacctatcacagagcaattaaagttacagtagatggacctcgggaacccagaaggcacagacagaagcttgatgactctaaacctagtttgttctctgaccgcctcagtgatttagggcgcattcctcatcccagtatgagagtaggtgtcccgcctcagaacccacggccctccctgaactctgcaccaagtccttttaatccacaaggacagagtcagattacagaccccaggcaggcacagtcttccccgccgtggtcctatgaccagtcttacccctcctacctgagccagatgacgtccccgtccatccactctaccaccccgctgtcttccacacggggcactgggcttcctgccatcaccgatgtgcctaggcgcatttcagatgatgacactgccacctctgacttctgcctctggccttccactctcagtaagaagagccaggcaggtgcttcagaactgggccctttttcagaccccaggcagttcccaagcatttcatccctcactgagagccgcttctccaacccacgaatgcactatccagccacctttacttacaccccgccagtcacctcaggcatgtccctcggtatgtccgccaccactcactaccacacctacctgccaccaccctaccccggctcttcccaaagccagagtggacccttccagaccagcagcactccatatctctactatggcacttcgtcaggatcctatcagtttcccatggtgccggggggagaccggtctccttccagaatgcttccgccatgcaccaccacctcgaatggcagcacgctattaaatccaaatttgcctaaccagaatgatggtgttgacgctgatggaagccacagcagttccccaactgttttgaattctagtggcagaatggatgaatctgtttggcgaccatattgaaattcctcagcagtggcccagtggtatctgggggccacatcccacacgtatcaatatatacatatatagagagagtgcatatatatgtatatcgattagctatctacaaagtgcctattttttagaagatttttcattcactcactcagtcatgatcttgcagccataagagggtagatattgagaagcagaaggctcaagagagacaattgcaatcgagcttcagattgtttactatttaagatgtacttttacaaaggaacaaagaagggaaaaggtatttttgtttttgttgtttggtctgttatcatcaataacctgttcatatgccaattcagagaggtggactccaggttcaggagggagaagagcaaagccgcttcctctctgtgctttgaaacttcacaccctcacggtggcagctgtgtatggaccagtgccctccgcagacagctcacaaaaccagttgaggtgcactaaagggacatgaggtagaatggatgcttccatcacagtaccatcattcagaataactcttccaatttctgctttcagacatgctgcaggtcctcatctgaactgttgggttcgtttttttttttttttttcctgctccaagaaagtgacttcaaaaataactgatcaggatagattattttattttactttttaacactccttctccccttttcccactgaaccaaaaagaaatcccatccctaaaacctgccttctccttttatgcaaaactgaaaatggcaatacattattatagccataatggtatagatagtgattgcgtttggctatgtgttgttttctttttttttaaattatgaatatgtgtaaaatctgaggtaacttgctaacgtgaatggtcatataactttaaagatatatttataattatttaatgacatttggacccttgaaacatttcttagtgtattgatatgttgacttcggtctctaaaagtgctctttattaaataacaaatttcttcagtggtctagagccatatctgaaatattgctaagcaatttcagttcatccaggcacaatgtgattttaaaaaatacttccatctccaaatattttagatatagattgtttttgtgatgtatgaaggaaatgttatgtttagttctttcagatctttgaatgcctctaacacagctttgccttctaaagcggtaattagggatttaaaaaacaacctttagccctttatcagcatgaaatgctggagtgatgtggttttctaatttctttggggtaattatgactcttgtcatattaaaaagacaagcacaagtaaatcattgaactacagaaaaatgttctgtggtttcatagttaagcaaaactctaaatcgccaggcttcatagcaaagacatagtcagctaaaagccgcacatgtggatagagggttcaattatgagacacctagtacaggagagcaaaattgcaccagagattcttaaccaaccagccttaccaaacaacacaacaggggaaccccaatctgccttacccaaggccccactggcagctttccacagaatttgcatttagaggagcagaatgacatcactgtcctttgggagtaggtcctctgaaaaggcagcaggttccagcaggtagctgagctgagaggacatatggcccacggggacctacagacagcctttgacatttgtatttcttacaatggagggccaaggagggcaaggggctgtggagtttggtgtctactagtgtgtatgaatttgagctagagtccttctgtggcatgcactttgaccactcctggcagtcacatggcagatttccaagtgcaaatccttaatccaaacaaggatcatctaatgacaccaccaggccaatccctgctctcctccccgaaaagtcagggtcccttcattggaatcctccacccacccaagcagaatttagcagagatttgccttcaaaccctaacggcccccttgttctctggtccttctcaaacccacctttgtaggccacccagcattgcaggacagcgtgtggggcagctggacctgtgcttcctgcctgggagtctcccttggaattcatcctgactccttctaataaaaatggatgggaaagcaaaacactttgccttctaaaggccgtataccaagtatgcttagataaataagccacttttctattacttaagtaagaaggaagtagtaattgatactatttattgtttgtgtgtggtagcttgaagcacaccactgtccatttatttgtaagtgtaaaatatgtgtgtttgtttcagcagcacttaaaaaagccagtgtctggttacacatttcaattttaattaattgacataaaaatgctaccgccagtgccagctgcatcctatttaattaaaaaggtactatatttgtacattattttttaatgttaaaagggcttttttaagtttacagtacacataccgagtgactttagggatgcttttgtgttgaaatgttactatagtggctgcaggcagcaacccagaaacactttagaagctttttttccttgggaaaaattcaagcacttcttccctccaccctcactccaaccaccccaatgggggtaattcacatttcttagaacaaattctgcccttttttggtctagggattaaaattttgtttttctttctttctttttttttttttttcactgaacccttaatttgcactgggtcatgtgtttgatttgtgatttcaagaccaaagcaaagtcttactactactgtggaaccatgtactagttcctgggaattaaaatagcgtggttctctttgtagcacaaacattgctggaatttgcagtcttttcaatgcagccacatttttatccatttcagttgtctcacaaattttaacccatatcagagttccagaacaggtaccacagctttggttttagattagtggaataacattcagcccagaactgagaaactcaacagattaactatcgtttgctctttagacggtctcactgcctctcacttgccagagccctttcaaaatgagcagagaagtccacaccattagggaccatctgtgataaattcagaagggaggagatgtgtgtacagctttaaggattccctcaattccgaggaaagggactggcccagaatccaggttaatacatggaaacacgaagcattagcaaaagtaataattatacctatggtatttgaaagaacaataataaaagacacttcttccaaaccttgaatttgttgtttttagaaaacgaatgcatttaaaaatattttctatgtgagaattttttagatgtgtgtttacttcatgtttacaaataactgtttgctttttaatgcagtactttgaaatatatcagccaaaaccataacttacaataatttcttaggtattctgaataaaattccatttcttttggatatgctttaccattcttaggtttctgtggaacaaaaatatttgtagcattttgtgtaaatacaagctttcatttttattttttccaattgctattgcccaagaattgctttccatgcacatattgtaaaaattccgctttgtgccacaggtcatgattgtggatgagtttactcttaacttcaaagggactatttgtattgtatgttgcaactgtaaattgaattatttggcatttttctcatgattgtaatattaatttgaagtttgaatttaattttcaataaaatggcttttttggttttg

SEQ ID NO: 3741 - DNA, 5544 bp, Homo sapiens
atgcttcattcgcctcacaaacaaccacagaaccacaagtgcggtgcaaactttctccaggaggacagcaagaagtctctggtttttaaatggttaatctccgcaggtcactaccagccaccgagaccaacagagtcatttaaggctgcaagcagtatttacaacagagggtacaagttctatctgaaaaaaaaaggagggactatggcatcaaacagcctcttcagcacagtgacaccatgtcagcaaaacttcttttgggatccgagcaccagccggcgcttcagccccccctccagcagcctgcagcccggcaaaatgagcgacgtgagcccggtggtggctgcgcaacagcagcagcaacagcagcagcagcaacagcagcagcagcagcagcaacagcagcagcagcagcaggaggcggcggcggcggctgcggcggcggcggcggctgcggcggcggcagctgcagtgccccggttgcggccgccccacgacaaccgcaccatggtggagatcatcgccgaccacccggccgaactcgtccgcaccgacagccccaacttcctgtgctcggtgctgccctcgcactggcgctgcaacaagaccctgcccgtggccttcaaggtggtagccctcggagaggtaccagatgggactgtggttactgtcatggcgggtaacgatgaaaattattctgctgagctccggaatgcctctgctgttatgaaaaaccaagtagcaaggttcaacgatctgagatttgtgggccggagtggacgaggcaagagtttcaccttgaccataaccgtcttcacaaatcctccccaagtagctacctatcacagagcaattaaagttacagtagatggacctcgggaacccagaaggcacagacagaagcttgatgactctaaacctagtttgttctctgaccgcctcagtgatttagggcgcattcctcatcccagtatgagagtaggtgtcccgcctcagaacccacggccctccctgaactctgcaccaagtccttttaatccacaaggacagagtcagattacagaccccaggcaggcacagtcttccccgccgtggtcctatgaccagtcttacccctcctacctgagccagatgacgtccccgtccatccactctaccaccccgctgtcttccacacggggcactgggcttcctgccatcaccgatgtgcctaggcgcatttcagatgatgacactgccacctctgacttctgcctctggccttccactctcagtaagaagagccaggcaggtgcttcagaactgggccctttttcagaccccaggcagttcccaagcatttcatccctcactgagagccgcttctccaacccacgaatgcactatccagccacctttacttacaccccgccagtcacctcaggcatgtccctcggtatgtccgccaccactcactaccacacctacctgccaccaccctaccccggctcttcccaaagccagagtggacccttccagaccagcagcactccatatctctactatggcacttcgtcaggatcctatcagtttcccatggtgccggggggagaccggtctccttccagaatgcttccgccatgcaccaccacctcgaatggcagcacgctattaaatccaaatttgcctaaccagaatgatggtgttgacgctgatggaagccacagcagttccccaactgttttgaattctagtggcagaatggatgaatctgtttggcgaccatattgaaattcctcagcagtggcccagtggtatctgggggccacatcccacacgtatcaatatatacatatatagagagagtgcatatatatgtatatcgattagctatctacaaagtgcctattttttagaagatttttcattcactcactcagtcatgatcttgcagccataagagggtagatattgagaagcagaaggctcaagagagacaattgcaatcgagcttcagattgtttactatttaagatgtacttttacaaaggaacaaagaagggaaaaggtatttttgtttttgttgtttggtctgttatcatcaataacctgttcatatgccaattcagagaggtggactccaggttcaggagggagaagagcaaagccgcttcctctctgtgctttgaaacttcacaccctcacggtggcagctgtgtatggaccagtgccctccgcagacagctcacaaaaccagttgaggtgcactaaagggacatgaggtagaatggatgcttccatcacagtaccatcattcagaataactcttccaatttctgctttcagacatgctgcaggtcctcatctgaactgttgggttcgtttttttttttttttttcctgctccaagaaagtgacttcaaaaataactgatcaggatagattattttattttactttttaacactccttctccccttttcccactgaaccaaaaagaaatcccatccctaaaacctgccttctccttttatgcaaaactgaaaatggcaatacattattatagccataatggtatagatagtgattgcgtttggctatgtgttgttttctttttttttaaattatgaatatgtgtaaaatctgaggtaacttgctaacgtgaatggtcatataactttaaagatatatttataattatttaatgacatttggacccttgaaacatttcttagtgtattgatatgttgacttcggtctctaaaagtgctctttattaaataacaaatttcttcagtggtctagagccatatctgaaatattgctaagcaatttcagttcatccaggcacaatgtgattttaaaaaatacttccatctccaaatattttagatatagattgtttttgtgatgtatgaaggaaatgttatgtttagttctttcagatctttgaatgcctctaacacagctttgccttctaaagcggtaattagggatttaaaaaacaacctttagccctttatcagcatgaaatgctggagtgatgtggttttctaatttctttggggtaattatgactcttgtcatattaaaaagacaagcacaagtaaatcattgaactacagaaaaatgttctgtggtttcatagttaagcaaaactctaaatcgccaggcttcatagcaaagacatagtcagctaaaagccgcacatgtggatagagggttcaattatgagacacctagtacaggagagcaaaattgcaccagagattcttaaccaaccagccttaccaaacaacacaacaggggaaccccaatctgccttacccaaggccccactggcagctttccacagaatttgcatttagaggagcagaatgacatcactgtcctttgggagtaggtcctctgaaaaggcagcaggttccagcaggtagctgagctgagaggacatatggcccacggggacctacagacagcctttgacatttgtatttcttacaatggagggccaaggagggcaaggggctgtggagtttggtgtctactagtgtgtatgaatttgagctagagtccttctgtggcatgcactttgaccactcctggcagtcacatggcagatttccaagtgcaaatccttaatccaaacaaggatcatctaatgacaccaccaggccaatccctgctctcctccccgaaaagtcagggtcccttcattggaatcctccacccacccaagcagaatttagcagagatttgccttcaaaccctaacggcccccttgttctctggtccttctcaaacccacctttgtaggccacccagcattgcaggacagcgtgtggggcagctggacctgtgcttcctgcctgggagtctcccttggaattcatcctgactccttctaataaaaatggatgggaaagcaaaacactttgccttctaaaggccgtataccaagtatgcttagataaataagccacttttctattacttaagtaagaaggaagtagtaattgatactatttattgtttgtgtgtggtagcttgaagcacaccactgtccatttatttgtaagtgtaaaatatgtgtgtttgtttcagcagcacttaaaaaagccagtgtctggttacacatttcaattttaattaattgacataaaaatgctaccgccagtgccagctgcatcctatttaattaaaaaggtactatatttgtacattattttttaatgttaaaagggcttttttaagtttacagtacacataccgagtgactttagggatgcttttgtgttgaaatgttactatagtggctgcaggcagcaacccagaaacactttagaagctttttttccttgggaaaaattcaagcacttcttccctccaccctcactccaaccaccccaatgggggtaattcacatttcttagaacaaattctgcccttttttggtctagggattaaaattttgtttttctttctttctttttttttttttttcactgaacccttaatttgcactgggtcatgtgtttgatttgtgatttcaagaccaaagcaaagtcttactactactgtggaaccatgtactagttcctgggaattaaaatagcgtggttctctttgtagcacaaacattgctggaatttgcagtcttttcaatgcagccacatttttatccatttcagttgtctcacaaattttaacccatatcagagttccagaacaggtaccacagctttggttttagattagtggaataacattcagcccagaactgagaaactcaacagattaactatcgtttgctctttagacggtctcactgcctctcacttgccagagccctttcaaaatgagcagagaagtccacaccattagggaccatctgtgataaattcagaagggaggagatgtgtgtacagctttaaggattccctcaattccgaggaaagggactggcccagaatccaggttaatacatggaaacacgaagcattagcaaaagtaataattatacctatggtatttgaaagaacaataataaaagacacttcttccaaaccttgaatttgttgtttttagaaaacgaatgcatttaaaaatattttctatgtgagaattttttagatgtgtgtttacttcatgtttacaaataactgtttgctttttaatgcagtactttgaaatatatcagccaaaaccataacttacaataatttcttaggtattctgaataaaattccatttcttttggatatgctttaccattcttaggtttctgtggaacaaaaatatttgtagcattttgtgtaaatacaagctttcatttttattttttccaattgctattgcccaagaattgctttccatgcacatattgtaaaaattccgctttgtgccacaggtcatgattgtggatgagtttactcttaacttcaaagggactatttgtattgtatgttgcaactgtaaattgaattatttggcatttttctcatgattgtaatattaatttgaagtttgaatttaattttcaataaaatggcttttttggttttg

SEQ ID NO: 3742 - DNA, 1704 bp, Homo sapiens
atgcttcattcgcctcacaaacaaccacagaaccacaagtgcggtgcaaactttctccaggaggacagcaagaagtctctggtttttaaatggttaatctccgcaggtcactaccagccaccgagaccaacagagtcatttaaggctgcaagcagtatttacaacagagggtacaagttctatctgaaaaaaaaaggagggactatggcatcaaacagcctcttcagcacagtgacaccatgtcagcaaaacttcttttgggatccgagcaccagccggcgcttcagccccccctccagcagcctgcagcccggcaaaatgagcgacgtgagcccggtggtggctgcgcaacagcagcagcaacagcagcagcagcaacagcagcagcagcagcagcaacagcagcagcagcagcaggaggcggcggcggcggctgcggcggcggcggcggctgcggcggcggcagctgcagtgccccggttgcggccgccccacgacaaccgcaccatggtggagatcatcgccgaccacccggccgaactcgtccgcaccgacagccccaacttcctgtgctcggtgctgccctcgcactggcgctgcaacaagaccctgcccgtggccttcaaggtggtagccctcggagaggtaccagatgggactgtggttactgtcatggcgggtaacgatgaaaattattctgctgagctccggaatgcctctgctgttatgaaaaaccaagtagcaaggttcaacgatctgagatttgtgggccggagtggacgaggcaagagtttcaccttgaccataaccgtcttcacaaatcctccccaagtagctacctatcacagagcaattaaagttacagtagatggacctcgggaacccagaaggcacagacagaagcttgatgactctaaacctagtttgttctctgaccgcctcagtgatttagggcgcattcctcatcccagtatgagagtaggtgtcccgcctcagaacccacggccctccctgaactctgcaccaagtccttttaatccacaaggacagagtcagattacagaccccaggcaggcacagtcttccccgccgtggtcctatgaccagtcttacccctcctacctgagccagatgacgtccccgtccatccactctaccaccccgctgtcttccacacggggcactgggcttcctgccatcaccgatgtgcctaggcgcatttcaggtgcttcagaactgggccctttttcagaccccaggcagttcccaagcatttcatccctcactgagagccgcttctccaacccacgaatgcactatccagccacctttacttacaccccgccagtcacctcaggcatgtccctcggtatgtccgccaccactcactaccacacctacctgccaccaccctaccccggctcttcccaaagccagagtggacccttccagaccagcagcactccatatctctactatggcacttcgtcaggatcctatcagtttcccatggtgccggggggagaccggtctccttccagaatgcttccgccatgcaccaccacctcgaatggcagcacgctattaaatccaaatttgcctaaccagaatgatggtgttgacgctgatggaagccacagcagttccccaactgttttgaattctagtggcagaatggatgaatctgtttggcgaccatattga

SEQ ID NO: 3743 - DNA, 3861 bp, Homo sapiens
gccgctgttatgcgtattcccgtagacccaagcaccagccgccgcttcacacctccctccccggccttcccctgcggcggcggcggcggcaagatgggcgagaacagcggcgcgctgagcgcgcaggcggccgtggggcccggagggcgcgcccggcccgaggtgcgctcgatggtggacgtgctggcggaccacgcaggcgagctcgtgcgcaccgacagccccaacttcctctgctccgtgctgccctcgcactggcgctgcaacaagacgctgcccgtcgccttcaaggtggtggcattgggggacgtgccggatggtacggtggtgactgtgatggcaggcaatgacgagaactactccgctgagctgcgcaatgcctcggccgtcatgaagaaccaggtggccaggttcaacgaccttcgcttcgtgggccgcagtgggcgagggaagagtttcaccctgaccatcactgtgttcaccaaccccacccaagtggcgacctaccaccgagccatcaaggtgaccgtggacggaccccgggagcccagacggcaccggcagaagctggaggaccagaccaagccgttccctgaccgctttggggacctggaacggctgcgcatgcgggtgacaccgagcacacccagcccccgaggctcactcagcaccacaagccacttcagcagccagccccagaccccaatccaaggcacctcggaactgaacccattctccgacccccgccagtttgaccgctccttccccacgctgccaaccctcacggagagccgcttcccagaccccaggatgcattatcccggggccatgtcagctgccttcccctacagcgccacgccctcgggcacgagcatcagcagcctcagcgtggcgggcatgccggccaccagccgcttccaccatacctacctcccgccaccctacccgggggccccgcagaaccagagcgggcccttccaggccaacccgtccccctaccacctctactacgggacatcctctggctcctaccagttctccatggtggccggcagcagcagtgggggcgaccgctcacctacccgcatgctggcctcttgcaccagcagcgctgcctctgtcgccgccggcaacctcatgaaccccagcctgggcggccagagtgatggcgtggaggccgacggcagccacagcaactcacccacggccctgagcacgccaggccgcatggatgaggccgtgtggcggccctactgaccgccctggtggactcctcccgctggaggcggggaccctaacaaccttcaagaccagtgatgggccggctccgaggctccgggcgggaatgggacctgcgctccagggtggtctcggtcccagggtggtcccagctggtgggagcctctggctgcatctgtgcagccacatccttgtacagaggcataggttaccacccccaccccggcccgggatactgcccccggcccagatcctggccgtctcatcccatacttctgtggggaatcagcctcctgccacccccccggaaggacctcactgtctccagctatgcccagtgctgcatgggacccatgtctcctgggacagaggccatctctcttccagagagaggcagcattggcccacaggataagcctcaggccctgggaaacctcccgacccctgcaccttcgttggagcccctgcatcccctgggtccagccccctctgcatttacacagatttgagtcagaactggaaagtgtcccccacccccaccaccctcgagcggggttcccctcattgtacagatggggcaggacccagcacgctgctggcagagatggtttgagaacacatccaagccagtccccccagcccagcttcccctccgttcctaactgttggctttcccccagccgcacgggtcccaggccccagagaagatgagtctatggcatcaggttcttaaacccaggaaagcacctacagaccggctcctccatgcactttaccagctcaacgcatccactctctgttctcttggcagggcgggggaggggggataggaggtcccctttcccctaggtggtctcataattccatttgtggagagaacaggagggccagatagataggtcctagcagaaggcattgaggtgagggatcattttgggtcagacatcaatgtccctgtcccccctgggtccagccaagctgtgccccatcccccaagcctcctgggaggatccagccaaatcttgcgactcctggcacacacctgtctgtaacctgttttgtgctctgaaagcaaatagtcctgagcaaaaaaaaaaaaaaaacaaaaaaacaaaaaaaaaacaaaacagtttttaaaactgattttagaaaaagaagcttaatctaacgttttcaaacacaaggtctcttacaggtatagttccgtgattatgatagctctgtgattataagcaacatccccgccccctctcccccccgcggacccccagctgcctcctgagggtgtggggttattagggtctcaatactttctcaaggggctacactccccatcaggcagcatcccaccagcctgcaccacaggctcccctgggaggacgagggaaacgctgatgagacgctgggcatctctcctctgtggctctaggacatctgtccaggaggctgggcggaggtgggcaggatgtgagaggtggggagtactggctgtgcgtggcaggacagaagcactgtaaagggctctccagccgcagctcagctgcactgcgttccgaggtgaagtcttgcccctgaattttgcaaaatgggaaagtgggcgcttgcccaagggccaggctgcatggattctcacatcagagttctctggccctagaaaggcttagaaaaggcgtaagggaactcataaaggctagcagcatgcggtattttaactttctgcctcggcctctgtggatgcagaaatctgccctacaaaatgctcttcattggttgtctctgtgagagcactgtccccacccaacctgtcacaacggccagaaccatacaccagagacacactggcaggttaggcagtccttctggtgatcctattccattccctcctgctgcggtttctcttggcctgtcctcactggaaaaacagtctccatctcctcaaaatagttgctgactccctgcacccaaggggcctctccatgccttcttaggaagcagctatgaatccattgtccttgtagtttcttccctcctgttctctggttatagctggtcccaggtcagcgtgggaggcacctttgggttcccagtgcccagcactttgtagtctcatcccagattactaacccttcctgatcctggagaggcagggatagtaaataaattgctcttcctaccccatcccccatcccctgacaaaaagtgacggcagccgtactgagtctgtaaggcccaaagtgggtacagacagcctgggctggtaaaagtaggtccttatttacaaggctgcgttaaagttgtactaggcaaacacactgatgtaggaagcacgaggaaaggaagacgttttgatatagtgttactgtgagcctgtcagtagtgggtaccaatcttttgtgacatattgtcatgctgaggtgtgacacctgctgcactcatctgatgtaaaaccatcccagagctggcgagaggatggagctgggtggaaactgctttgcactatcgtttgcttggtgtttgtttttaacgcacaacttgcttgtacagtaaactgtcttctgtactatttaactgtaaaatggaattttgactgatttgttacaataatataactctgagatgtgt

SEQ ID NO: 3744 - DNA, 2629 bp, Homo sapiens
ggcggcccactctgctctgtcagcttcggagctcctccaccctggctgccgaaagccccttcccgccatctaatgatacactctgcatacgcttctgttgagaatttgtggctagacattcctgtgggaccgggaatccaaattcttggtagctagaggaaaaaaaaataaaacaacagccaaccaagtgaatcccaacccaaccccctgaagggctgaaaattctcgccttcttcagagcggggcatggcatcgaacagcatcttcgactccttcccgacctactcgccgaccttcatccgcgacccaagcaccagccgccgcttcacacctccctccccggccttcccctgcggcggcggcggcggcaagatgggcgagaacagcggcgcgctgagcgcgcaggcggccgtggggcccggagggcgcgcccggcccgaggtgcgctcgatggtggacgtgctggcggaccacgcaggcgagctcgtgcgcaccgacagccccaacttcctctgctccgtgctgccctcgcactggcgctgcaacaagacgctgcccgtcgccttcaaggtggtggcattgggggacgtgccggatggtacggtggtgactgtgatggcaggcaatgacgagaactactccgctgagctgcgcaatgcctcggccgtcatgaagaaccaggtggccaggttcaacgaccttcgcttcgtgggccgcagtgggcgagggaagagtttcaccctgaccatcactgtgttcaccaaccccacccaagtggcgacctaccaccgagccatcaaggtgaccgtggacggaccccgggagcccagacggcaccggcagaagctggaggaccagaccaagccgttccctgaccgctttggggacctggaacggctgcgcatgcgggtgacaccgagcacacccagcccccgaggctcactcagcaccacaagccacttcagcagccagccccagaccccaatccaaggcacctcggaactgaacccattctccgacccccgccagtttgaccgctccttccccacgctgccaaccctcacggagagccgcttcccagaccccaggatgcattatcccggggccatgtcagctgccttcccctacagcgccacgccctcgggcacgagcatcagcagcctcagcgtggcgggcatgccggccaccagccgcttccaccatacctacctcccgccaccctacccgggggccccgcagaaccagagcgggcccttccaggccaacccgtccccctaccacctctactacgggacatcctctggctcctaccagttctccatggtggccggcagcagcagtgggggcgaccgctcacctacccgcatgctggcctcttgcaccagcagcgctgcctctgtcgccgccggcaacctcatgaaccccagcctgggcggccagagtgatggcgtggaggccgacggcagccacagcaactcacccacggccctgagcacgccaggccgcatggatgaggccgtgtggcggccctactgaccgccctggtggactcctcccgctggaggcggggaccctaacaaccttcaagaccagtgatgggccggctccgaggctccgggcgggaatgggacctgcgctccagggtggtctcggtcccagggtggtcccagctggtgggagcctctggctgcatctgtgcagccacatccttgtacagaggcataggttaccacccccaccccggcccgggatactgcccccggcccagatcctggccgtctcatcccatacttctgtggggaatcagcctcctgccacccccccggaaggacctcactgtctccagctatgcccagtgctgcatgggacccatgtctcctgggacagaggccatctctcttccagagagaggcagcattggcccacaggataagcctcaggccctgggaaacctcccgacccctgcaccttcgttggagcccctgcatcccctgggtccagccccctctgcatttacacagatttgagtcagaactggaaagtgtcccccacccccaccaccctcgagcggggttcccctcattgtacagatggggcaggacccagcacgctgctggcagagatggtttgagaacacatccaagccagtccccccagcccagcttcccctccgttcctaactgttggctttcccccagccgcacgggtcccaggccccagagaagatgagtctatggcatcaggttcttaaacccaggaaagcacctacagaccggctcctccatgcactttaccagctcaacgcatccactctctgttctcttggcagggcgggggaggggggataggaggtcccctttcccctaggtggtctcataattccatttgtggagagaacaggagggccagatagataggtcctagcagaaggcattgaggtgagggatcattttgggtcagacatcaatgtccctgtcccccctgggtccagccaagctgtgccccatcccccaagcctcctgggaggatccagccaaatcttgcgactcctggcacacacctgtctgtaacctgttttgtgctctgaaagcaaatagtcctgagcaaaaaaaaaaaaaaaacaaaaaaa

SEQ ID NO: 3745 - DNA, 4340 bp, Homo sapiens
attcattcattccccgtggcactggaggcggcccactctgctctgtcagcttcggagctcctccaccctggctgccgaaagccccttcccgccatctaatgatacactctgcatacgcttctgttgagaatttgtggctagacattcctgtgggaccgggaatccaaattcttgggtacaaacagaaacttactttccttggggatttttttctctctctcactcacacacactctcgcgttctttccttttttctttttcgtagcagcaggggggaaaaaagagacaaaaacaaaacaaaaaacaacaaaaagcaacaccccccccttttattttcaaaagtagctagaggaaaaaaaaataaaacaacagccaaccaagtgaatcccaacccaaccccctgaagggctgaaaattctcgccttcttcagagcggggcatggcatcgaacagcatcttcgactccttcccgacctactcgccgaccttcatccgcgacccaagcaccagccgccgcttcacacctccctccccggccttcccctgcggcggcggcggcggcaagatgggcgagaacagcggcgcgctgagcgcgcaggcggccgtggggcccggagggcgcgcccggcccgaggtgcgctcgatggtggacgtgctggcggaccacgcaggcgagctcgtgcgcaccgacagccccaacttcctctgctccgtgctgccctcgcactggcgctgcaacaagacgctgcccgtcgccttcaaggtggtggcattgggggacgtgccggatggtacggtggtgactgtgatggcaggcaatgacgagaactactccgctgagctgcgcaatgcctcggccgtcatgaagaaccaggtggccaggttcaacgaccttcgcttcgtgggccgcagtgggcgagggaagagtttcaccctgaccatcactgtgttcaccaaccccacccaagtggcgacctaccaccgagccatcaaggtgaccgtggacggaccccgggagcccagacggcaccggcagaagctggaggaccagaccaagccgttccctgaccgctttggggacctggaacggctgcgcatgcgggtgacaccgagcacacccagcccccgaggctcactcagcaccacaagccacttcagcagccagccccagaccccaatccaaggcacctcggaactgaacccattctccgacccccgccagtttgaccgctccttccccacgctgccaaccctcacggagagccgcttcccagaccccaggatgcattatcccggggccatgtcagctgccttcccctacagcgccacgccctcgggcacgagcatcagcagcctcagcgtggcgggcatgccggccaccagccgcttccaccatacctacctcccgccaccctacccgggggccccgcagaaccagagcgggcccttccaggccaacccgtccccctaccacctctactacgggacatcctctggctcctaccagttctccatggtggccggcagcagcagtgggggcgaccgctcacctacccgcatgctggcctcttgcaccagcagcgctgcctctgtcgccgccggcaacctcatgaaccccagcctgggcggccagagtgatggcgtggaggccgacggcagccacagcaactcacccacggccctgagcacgccaggccgcatggatgaggccgtgtggcggccctactgaccgccctggtggactcctcccgctggaggcggggaccctaacaaccttcaagaccagtgatgggccggctccgaggctccgggcgggaatgggacctgcgctccagggtggtctcggtcccagggtggtcccagctggtgggagcctctggctgcatctgtgcagccacatccttgtacagaggcataggttaccacccccaccccggcccgggatactgcccccggcccagatcctggccgtctcatcccatacttctgtggggaatcagcctcctgccacccccccggaaggacctcactgtctccagctatgcccagtgctgcatgggacccatgtctcctgggacagaggccatctctcttccagagagaggcagcattggcccacaggataagcctcaggccctgggaaacctcccgacccctgcaccttcgttggagcccctgcatcccctgggtccagccccctctgcatttacacagatttgagtcagaactggaaagtgtcccccacccccaccaccctcgagcggggttcccctcattgtacagatggggcaggacccagcacgctgctggcagagatggtttgagaacacatccaagccagtccccccagcccagcttcccctccgttcctaactgttggctttcccccagccgcacgggtcccaggccccagagaagatgagtctatggcatcaggttcttaaacccaggaaagcacctacagaccggctcctccatgcactttaccagctcaacgcatccactctctgttctcttggcagggcgggggaggggggataggaggtcccctttcccctaggtggtctcataattccatttgtggagagaacaggagggccagatagataggtcctagcagaaggcattgaggtgagggatcattttgggtcagacatcaatgtccctgtcccccctgggtccagccaagctgtgccccatcccccaagcctcctgggaggatccagccaaatcttgcgactcctggcacacacctgtctgtaacctgttttgtgctctgaaagcaaatagtcctgagcaaaaaaaaaaaaaaaacaaaaaaacaaaaaaaaaacaaaacagtttttaaaactgattttagaaaaagaagcttaatctaacgttttcaaacacaaggtctcttacaggtatagttccgtgattatgatagctctgtgattataagcaacatccccgccccctctcccccccgcggacccccagctgcctcctgagggtgtggggttattagggtctcaatactttctcaaggggctacactccccatcaggcagcatcccaccagcctgcaccacaggctcccctgggaggacgagggaaacgctgatgagacgctgggcatctctcctctgtggctctaggacatctgtccaggaggctgggcggaggtgggcaggatgtgagaggtggggagtactggctgtgcgtggcaggacagaagcactgtaaagggctctccagccgcagctcagctgcactgcgttccgaggtgaagtcttgcccctgaattttgcaaaatgggaaagtgggcgcttgcccaagggccaggctgcatggattctcacatcagagttctctggccctagaaaggcttagaaaaggcgtaagggaactcataaaggctagcagcatgcggtattttaactttctgcctcggcctctgtggatgcagaaatctgccctacaaaatgctcttcattggttgtctctgtgagagcactgtccccacccaacctgtcacaacggccagaaccatacaccagagacacactggcaggttaggcagtccttctggtgatcctattccattccctcctgctgcggtttctcttggcctgtcctcactggaaaaacagtctccatctcctcaaaatagttgctgactccctgcacccaaggggcctctccatgccttcttaggaagcagctatgaatccattgtccttgtagtttcttccctcctgttctctggttatagctggtcccaggtcagcgtgggaggcacctttgggttcccagtgcccagcactttgtagtctcatcccagattactaacccttcctgatcctggagaggcagggatagtaaataaattgctcttcctaccccatcccccatcccctgacaaaaagtgacggcagccgtactgagtctgtaaggcccaaagtgggtacagacagcctgggctggtaaaagtaggtccttatttacaaggctgcgttaaagttgtactaggcaaacacactgatgtaggaagcacgaggaaaggaagacgttttgatatagtgttactgtgagcctgtcagtagtgggtaccaatcttttgtgacatattgtcatgctgaggtgtgacacctgctgcactcatctgatgtaaaaccatcccagagctggcgagaggatggagctgggtggaaactgctttgcactatcgtttgcttggtgtttgtttttaacgcacaacttgcttgtacagtaaactgtcttctgtactatttaactgtaaaatggaattttgactgatttgttacaataatataactctgagatgtgtggaagga

SEQ ID NO: 3746 - DNA, 1338 bp, Homo sapiens
ctggaggatttgttctggggctgcggccgcccccgggggaagccgcgccgtctccgcctgcccggcgccctgacggccgctgttatgcgtattcccgtagacccaagcaccagccgccgcttcacacctccctccccggccttcccctgcggcggcggcggcggcaagatgggcgagaacagcggcgcgctgagcgcgcaggcggccgtggggcccggagggcgcgcccggcccgaggtgcgctcgatggtggacgtgctggcggaccacgcaggcgagctcgtgcgcaccgacagccccaacttcctctgctccgtgctgccctcgcactggcgctgcaacaagacgctgcccgtcgccttcaaggtggtggcattgggggacgtgccggatggtacggtggtgactgtgatggcaggcaatgacgagaactactccgctgagctgcgcaatgcctcggccgtcatgaagaaccaggtggccaggttcaacgaccttcgcttcgtgggccgcagtgggcgagggaagagtttcaccctgaccatcactgtgttcaccaaccccacccaagtggcgacctaccaccgagccatcaaggtgaccgtggacggaccccgggagcccagacgcacctcggaactgaacccattctccgacccccgccagtttgaccgctccttccccacgctgccaaccctcacggagagccgcttcccagaccccaggatgcattatcccggggccatgtcagctgccttcccctacagcgccacgccctcgggcacgagcatcagcagcctcagcgtggcgggcatgccggccaccagccgcttccaccatacctacctcccgccaccctacccgggggccccgcagaaccagagcgggcccttccaggccaacccgtccccctaccacctctactacgggacatcctctggctcctaccagttctccatggtggccggcagcagcagtgggggcgaccgctcacctacccgcatgctggcctcttgcaccagcagcgctgcctctgtcgccgccggcaacctcatgaaccccagcctgggcggccagagtgatggcgtggaggccgacggcagccacagcaactcacccacggccctgagcacgccaggccgcatggatgaggccgtgtggcggccctactgaccgccctggtggactcctcccgctggaggcggggaccctaacaaccttcaagaccagtgatgggccggctccgaggctccgggcgggaatgggacctgcgctccagggtggtctcggtcccagggtggtcccagctggtgggagcctctggctgcatctgtgcag

SEQ ID NO: 3747 - DNA, 1392 bp, Homo sapiens
gaaattttaccggacggcgctaggccgggatcggggcactgctctccagacgtttgctcggggatattatgcgtcccgaatggtggtggcattgggggacgtgccggatggtacggtggtgactgtgatggcaggcaatgacgagaactactccgctgagctgcgcaatgcctcggccgtcatgaagaaccaggtggccaggttcaacgaccttcgcttcgtgggccgcagtgggcgagggaagagtttcaccctgaccatcactgtgttcaccaaccccacccaagtggcgacctaccaccgagccatcaaggtgaccgtggacggaccccgggagcccagacggcaccggcagaagctggaggaccagaccaagccgttccctgaccgctttggggacctggaacggctgcgcatgcgggtgacaccgagcacacccagcccccgaggctcactcagcaccacaagccacttcagcagccagccccagaccccaatccaaggcacctcggaactgaacccattctccgacccccgccagtttgaccgctccttccccacgctgccaaccctcacggagagccgcttcccagaccccaggatgcattatcccggggccatgtcagctgccttcccctacagcgccacgccctcgggcacgagcatcagcagcctcagcgtggcgggcatgccggccaccagccgcttccaccatacctacctcccgccaccctacccgggggccccgcagaaccagagcgggcccttccaggccaacccgtccccctaccacctctactacgggacatcctctggctcctaccagttctccatggtggccggcagcagcagtgggggcgaccgctcacctacccgcatgctggcctcttgcaccagcagcgctgcctctgtcgccgccggcaacctcatgaaccccagcctgggcggccagagtgatggcgtggaggccgacggcagccacagcaactcacccacggccctgagcacgccaggccgcatggatgaggccgtgtggcggccctactgaccgccctggtggactcctcccgctggaggcggggaccctaacaaccttcaagaccagtgatgggccggctccgaggctccgggcgggaatgggacctgcgctccagggtggtctcggtcccagggtggtcccagctggtgggagcctctggctgcatctgtgcagccacatccttgtacagaggcataggttaccacccccaccccggcccgggatactgcccccggcccagatcctggccgtctcatcccatacttctgtggggaatcagcctcctgccacccccccggaaggacctcactgtctccagctatgcccagtgctgcatgggacccatgtctcct

SEQ ID NO: 3748 - DNA, 4048 bp, Homo sapiens
tatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccagaacaacaaaacagcgcagaagcacaaacaaatcagcttttagtatcaaccacgtgtcaaggcaggtcacgtcctctggcgtcagccacggcggcactgtcagcctgcaggatgctgtgactcgacggcctcctgtattggacgagtcttggattcgtgaacagaccacagtggaccacttctggggtcttgatgatgatggtgatcttaaaggtggaaataaagctgccattcagggaaacggggatgtgggagccgccgccgccaccgcgcacaacggcttctcctgcagcaactgcagcatgctgtccgagcgcaaggacgtgctcacggcgcaccccgcggcccccgggcccgtgtcgagagtttattctagggacaggaatcaaaaatgcgacgactgtaagggcaagaggcacctcgacgcgcaccccggtcgggcagggaccctctggcacatctgggcatgtgcaggttacttcttgctgcagattctgcgcaggatcggagctgtgggccaggctgtgtccaggacggcgtggtcggccctttggctggccgtggttgctccagggaaggcagcctctggagtgttctggtggctggggattggatggtaccagtttgttactttgatttcttggctgaatgtgtttcttcttaccaggtgccttcgaaacatctgcaagtttttagtcttgctcatcccactcttccttttactagcaggtctctccttacggggccagggcaatttcttttcgttcttgcccgtgttgaactgggcaagcatgcatagaacacagcgggtggatgacccccaggacgtgtttaaacccacgacttctcgcctgaagcagcctctgcagggtgacagtgaggcttttccgtggcattggatgagtggcgtggagcagcaggtggcctctctgtctggacagtgccaccaccatggtgagaatctccgagagctgaccactttgctacagaagctgcaggctcgggtggaccagatggaaggcggcgctgccgggccgtcagcttcggtcagagacgctgtgggacagcccccgagggagactgactttatggcctttcaccaagaacatgaagtgcgtatgtcacacttggaagatattctgggaaaactgagagaaaaatctgaggccatccagaaggaactagaacagaccaagcaaaaaacaatcagtgcggttggtgagcagctcctgcccacagtcgagcacctccagctggagctggatcagctaaagtcagagctgtccagctggcgacacgtgaagaccggctgtgagacagtggatgccgtacaagaaagagtggacgtgcaagtcagagaaatggtgaaactcctgttttccgaagatcagcaaggcggttctctggaacagctgctgcagaggttctcatcacagtttgtgagcaaaggcgacttgcagacgatgctgcgagacctgcagctgcagatcctgcggaacgtcacccaccacgtttccgtgaccaagcagctcccaacctcagaagccgtggtgtctgctgtgagcgaggcgggggcgtctggaataacagaggcgcaagcacgtgccatcgtgaacagcgccttgaagctgtattcccaagataagaccgggatggtggactttgctctggaatctggtggtggcagcatcttgagtactcgctgttctgaaacttacgaaaccaaaacggcgctgatgagtctgtttgggatcccgctgtggtacttctcgcagtccccgcgcgtggtcatccagcctgacatttaccccggtaactgctgggcatttaaaggctcccaggggtacctggtggtgaggctctccatgatgatccacccagccgccttcactctggagcacatccctaagacgctgtcgccaacaggcaacatcagcagcgcccccaaggacttcgccgtctatggattagaaaatgagtatcaggaagaagggcagcttctgggacagttcacgtatgatcaggatggggagtcgctccagatgttccaggccctgaaaagacccgacgacacagctttccaaatagtggaacttcggattttttctaactggggccatcctgagtatacctgtctgtatcggttcagagttcatggcgaacctgtcaagtgaagacactactcattatttttgtacatttttgtatatactgggacagcgtgaaacactggaatccttcatggacgagggcatatacaatgatgggacagtgccacactccttcaataaacgtggctgctggccagaggacgtgagcgtgtgacgggcgccttggcgccacctgttgggtgctcactgcctctgcaggtgcagaggggtcagcagcaggagaagcgtgttgaacacgtggctctcagacactccttgtttttaacgggaagctctttgcatttgcatttcctcaacaaaggagcaaagcagaggaagctgagagtctggcgtgttcttgacgctttggtcttcagccttgcactggctcttctaaaggacttttggagggcagataatttcatctgttaaatccaacacacatttctttcagggaaaaacaatgtcaccaaattttcagagttctaaactcctttccttcaagccggaattttccttttttcagcaccagtaggtactaagtctccagatggggaaataactaaaatgtgtttttctgctttgttcgctcttacttctgaggaaggtttccagtcaggactcgctgtaccaatatccatggaggaatatgggagcgtttcgctctccttgtaggctgaagtcagtctgacttgaaggggcctggtttggatctaagcaaacacccagatggggttctctggtctcagcaaggcttttcctgttgggagtcacagtaaacagaaacccaaaaatctcatcttgggtgttttcagggcttgttttgagttttgctgaatagggagcgcaagacgccctgagcctccctctcactggtggtgataagaggagccgtctggtgtgtcagggtcacgaacccgttacatttcaggacgatcctttttccttcagcagcatttcttactggctgtggctggaatctgccttttatcacagctgtcaccattctcacgtgattcttgtgagactctttttggttataattactatttaatatttagactattttactgagcagactttataaatgagatatctacaaggcacttaaagtgttacagatgttttaccttaagaattatttaagttgtgttgggttaagacagttttcagtgtaccgtaaatgttgtgttttcagaaaaagacaaaacgatggtgctgactggttttctgtatattgcacaacagtcctcaaatacactgatgtatgaaactattcatacatcaagcagcatttttttcactctccttagaattggaactatgcagttaaggcagataaaatgtacagatgtttcatatattacaggttacatatataaatcaaaatttcctatataaaactgatttgggatttggggtggaaatattttgaatattaatttatttttaaagatgcaagataggactttgtgcaatgtatttttgtaaatgcttttcaaaatatctgtctttggtagtgcttctgctgctgccaccaaattgataagatgctattaagaggtttaaataaagagttttaatttttaaaagggcatgggatataaacagtc

SEQ ID NO: 3749 - DNA, 3812 bp, Homo sapiens
agagcgtcttctcgggcctgggcggcgcagacgaggcctgaggcggcggcgcgaggcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccagaacaacaaaacagcgcagaagcacaaacaaatcagcttttagtatcaaccacgtgtcaaggcaggtcacgtcctctggcgtcagccacggcggcactgtcagcctgcaggatgctgtgactcgacggcctcctgtattggacgagtcttggattcgtgaacagaccacagtggaccacttctggggtcttgatgatgatggtgatcttaaaggtggaaataaagctgccattcagggaaacggggatgtgggagccgccgccgccaccgcgcacaacggcttctcctgcagcaactgcagcatgctgtccgagcgcaaggacgtgctcacggcgcaccccgcggcccccgggcccgtgtcgagagtttattctagggacaggaatcaaaaatggaaggcagcctctggagtgttctggtggctggggattggatggtaccagtttgttactttgatttcttggctgaatgtgtttcttcttaccaggtgccttcgaaacatctgcaagtttttagtcttgctcatcccactcttccttttactagcaggtctctccttacggggccagggcaatttcttttcgttcttgcccgtgttgaactgggcaagcatgcatagaacacagcgggtggatgacccccaggacgtgtttaaacccacgacttctcgcctgaagcagcctctgcagggtgacagtgaggcttttccgtggcattggatgagtggcgtggagcagcaggtggcctctctgtctggacagtgccaccaccatggtgagaatctccgagagctgaccactttgctacagaagctgcaggctcgggtggaccagatggaaggcggcgctgccgggccgtcagcttcggtcagagacgctgtgggacagcccccgagggagactgactttatggcctttcaccaagaacatgaagtgcgtatgtcacacttggaagatattctgggaaaactgagagaaaaatctgaggccatccagaaggaactagaacagaccaagcaaaaaacaatcagtgcggttggtgagcagctcctgcccacagtcgagcacctccagctggagctggatcagctaaagtcagagctgtccagctggcgacacgtgaagaccggctgtgagacagtggatgccgtacaagaaagagtggacgtgcaagtcagagaaatggtgaaactcctgttttccgaagatcagcaaggcggttctctggaacagctgctgcagaggttctcatcacagtttgtgagcaaaggcgacttgcagacgatgctgcgagacctgcagctgcagatcctgcggaacgtcacccaccacgtttccgtgaccaagcagctcccaacctcagaagccgtggtgtctgctgtgagcgaggcgggggcgtctggaataacagaggcgcaagcacgtgccatcgtgaacagcgccttgaagctgtattcccaagataagaccgggatggtggactttgctctggaatctggtggtggcagcatcttgagtactcgctgttctgaaacttacgaaaccaaaacggcgctgatgagtctgtttgggatcccgctgtggtacttctcgcagtccccgcgcgtggtcatccagcctgacatttaccccggtaactgctgggcatttaaaggctcccaggggtacctggtggtgaggctctccatgatgatccacccagccgccttcactctggagcacatccctaagacgctgtcgccaacaggcaacatcagcagcgcccccaaggacttcgccgtctatggattagaaaatgagtatcaggaagaagggcagcttctgggacagttcacgtatgatcaggatggggagtcgctccagatgttccaggccctgaaaagacccgacgacacagctttccaaatagtggaacttcggattttttctaactggggccatcctgagtatacctgtctgtatcggttcagagttcatggcgaacctgtcaagtgaagacactactcattatttttgtacatttttgtatatactgggacagcgtgaaacactggaatccttcatggacgagggcatatacaatgatgggacagtgccacactccttcaataaacgtggctgctggccagaggacgtgagcgtgtgacgggcgccttggcgccacctgttgggtgctcactgcctctgcaggtgcagaggggtcagcagcaggagaagcgtgttgaacacgtggctctcagacactccttgtttttaacgggaagctctttgcatttgcatttcctcaacaaaggagcaaagcagaggaagctgagagtctggcgtgttcttgacgctttggtcttcagccttgcactggctcttctaaaggacttttggagggcagataatttcatctgttaaatccaacacacatttctttcagggaaaaacaatgtcaccaaattttcagagttctaaactcctttccttcaagccggaattttccttttttcagcaccagtaggtactaagtctccagatggggaaataactaaaatgtgtttttctgctttgttcgctcttacttctgaggaaggtttccagtcaggactcgctgtaccaatatccatggaggaatatgggagcgtttcgctctccttgtaggctgaagtcagtctgacttgaaggggcctggtttggatctaagcaaacacccagatggggttctctggtctcagcaaggcttttcctgttgggagtcacagtaaacagaaacccaaaaatctcatcttgggtgttttcagggcttgttttgagttttgctgaatagggagcgcaagacgccctgagcctccctctcactggtggtgataagaggagccgtctggtgtgtcagggtcacgaacccgttacatttcaggacgatcctttttccttcagcagcatttcttactggctgtggctggaatctgccttttatcacagctgtcaccattctcacgtgattcttgtgagactctttttggttataattactatttaatatttagactattttactgagcagactttataaatgagatatctacaaggcacttaaagtgttacagatgttttaccttaagaattatttaagttgtgttgggttaagacagttttcagtgtaccgtaaatgttgtgttttcagaaaaagacaaaacgatggtgctgactggttttctgtatattgcacaacagtcctcaaatacactgatgtatgaaactattcatacatcaagcagcatttttttcactctccttagaattggaactatgcagttaaggcagataaaatgtacagatgtttcatatattacaggttacatatataaatcaaaatttcctatataaaactgatttgggatttggggtggaaatattttgaatattaatttatttttaaagatgcaagataggactttgtgcaatgtatttttgtaaatgcttttcaaaatatctgtctttggtagtgcttctgctgctgccaccaaattgataagatgctattaagaggtttaaataaagagttttaatttttaaaaggg

SEQ ID NO: 3750 - DNA, 3953 bp, Homo sapiens
gcagtatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccagaacaacaaaacagcgcagaagcacaaacaaatcagcttttagtatcaaccacgtgtcaaggcaggtcacgtcctctggcgtcagccacggcggcactgtcagcctgcaggatgctgtgactcgacggcctcctgtattggacgagtcttggattcgtgaacagaccacagtggaccacttctggggtcttgatgatgatggtgatcttaaaggtggaaataaagctgccattcagggaaacggggatgtgggagccgccgccgccaccgcgcacaacggcttctcctgcagcaactgcagcatgctgtccgagcgcaaggacgtgctcacggcgcaccccgcggcccccgggcccgtgtcgagagtttattctagggacaggaatcaaaaatgttacttcttgctgcagattctgcgcaggatcggagctgtgggccaggctgtgtccaggacggcgtggtcggccctttggctggccgtggttgctccagggaaggcagcctctggagtgttctggtggctggggattggatggtaccagtttgttactttgatttcttggctgaatgtgtttcttcttaccaggtgccttcgaaacatctgcaagtttttagtcttgctcatcccactcttccttttactagcaggtctctccttacggggccagggcaatttcttttcgttcttgcccgtgttgaactgggcaagcatgcatagaacacagcgggtggatgacccccaggacgtgtttaaacccacgacttctcgcctgaagcagcctctgcagggtgacagtgaggcttttccgtggcattggatgagtggcgtggagcagcaggtggcctctctgtctggacagtgccaccaccatggtgagaatctccgagagctgaccactttgctacagaagctgcaggctcgggtggaccagatggaaggcggcgctgccgggccgtcagcttcggtcagagacgctgtgggacagcccccgagggagactgactttatggcctttcaccaagaacatgaagtgcgtatgtcacacttggaagatattctgggaaaactgagagaaaaatctgaggccatccagaaggaactagaacagaccaagcaaaaaacaatcagtgcggttggtgagcagctcctgcccacagtcgagcacctccagctggagctggatcagctaaagtcagagctgtccagctggcgacacgtgaagaccggctgtgagacagtggatgccgtacaagaaagagtggacgtgcaagtcagagaaatggtgaaactcctgttttccgaagatcagcaaggcggttctctggaacagctgctgcagaggttctcatcacagtttgtgagcaaaggcgacttgcagacgatgctgcgagacctgcagctgcagatcctgcggaacgtcacccaccacgtttccgtgaccaagcagctcccaacctcagaagccgtggtgtctgctgtgagcgaggcgggggcgtctggaataacagaggcgcaagcacgtgccatcgtgaacagcgccttgaagctgtattcccaagataagaccgggatggtggactttgctctggaatctggtggtggcagcatcttgagtactcgctgttctgaaacttacgaaaccaaaacggcgctgatgagtctgtttgggatcccgctgtggtacttctcgcagtccccgcgcgtggtcatccagcctgacatttaccccggtaactgctgggcatttaaaggctcccaggggtacctggtggtgaggctctccatgatgatccacccagccgccttcactctggagcacatccctaagacgctgtcgccaacaggcaacatcagcagcgcccccaaggacttcgccgtctatggattagaaaatgagtatcaggaagaagggcagcttctgggacagttcacgtatgatcaggatggggagtcgctccagatgttccaggccctgaaaagacccgacgacacagctttccaaatagtggaacttcggattttttctaactggggccatcctgagtatacctgtctgtatcggttcagagttcatggcgaacctgtcaagtgaagacactactcattatttttgtacatttttgtatatactgggacagcgtgaaacactggaatccttcatggacgagggcatatacaatgatgggacagtgccacactccttcaataaacgtggctgctggccagaggacgtgagcgtgtgacgggcgccttggcgccacctgttgggtgctcactgcctctgcaggtgcagaggggtcagcagcaggagaagcgtgttgaacacgtggctctcagacactccttgtttttaacgggaagctctttgcatttgcatttcctcaacaaaggagcaaagcagaggaagctgagagtctggcgtgttcttgacgctttggtcttcagccttgcactggctcttctaaaggacttttggagggcagataatttcatctgttaaatccaacacacatttctttcagggaaaaacaatgtcaccaaattttcagagttctaaactcctttccttcaagccggaattttccttttttcagcaccagtaggtactaagtctccagatggggaaataactaaaatgtgtttttctgctttgttcgctcttacttctgaggaaggtttccagtcaggactcgctgtaccaatatccatggaggaatatgggagcgtttcgctctccttgtaggctgaagtcagtctgacttgaaggggcctggtttggatctaagcaaacacccagatggggttctctggtctcagcaaggcttttcctgttgggagtcacagtaaacagaaacccaaaaatctcatcttgggtgttttcagggcttgttttgagttttgctgaatagggagcgcaagacgccctgagcctccctctcactggtggtgataagaggagccgtctggtgtgtcagggtcacgaacccgttacatttcaggacgatcctttttccttcagcagcatttcttactggctgtggctggaatctgccttttatcacagctgtcaccattctcacgtgattcttgtgagactctttttggttataattactatttaatatttagactattttactgagcagactttataaatgagatatctacaaggcacttaaagtgttacagatgttttaccttaagaattatttaagttgtgttgggttaagacagttttcagtgtaccgtaaatgttgtgttttcagaaaaagacaaaacgatggtgctgactggttttctgtatattgcacaacagtcctcaaatacactgatgtatgaaactattcatacatcaagcagcatttttttcactctccttagaattggaactatgcagttaaggcagataaaatgtacagatgtttcatatattacaggttacatatataaatcaaaatttcctatataaaactgatttgggatttggggtggaaatattttgaatattaatttatttttaaagatgcaagataggactttgtgcaatgtatttttgtaaatgcttttcaaaatatctgtctttggtagtgcttctgctgctgccaccaaattgataagatgctattaagaggtttaaataaagagttttaatttttaaaaggg

SEQ ID NO: 3751 - DNA, 978 bp, Homo sapiens
agtatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccagaacaacaaaacagcgcagaagcacaaacaaatcagcttttagtatcaaccacgtgtcaaggcaggtcacgtcctctggcgtcagccacggcggcactgtcagcctgcaggatgctgtgactcgacggcctcctgtattggacgagtcttggattcgtgaacagaccacagtggaccacttctggggtcttgatgatgatggtgatcttaaaggtggaaataaagctgccattcagggaaacggggatgtgggagccgccgccgccaccgcgcacaacggcttctcctgcagcaactgcagcatgctgtccgagcgcaaggacgtgctcacggcgcaccccgcggcccccgggcccgtgtcgagagtttattctagggacaggaatcaaaaatgtaagtctcagtcctttaaaactcagaaaaaggtgtgttttccaaatttaatatttcctttctgtaagtctcagtgtctgcactatttgtcttggagacttaaaattatcccttgaaagcataagaagtacaccccaaaccagctttgtccttcctgtcctcttctagtttacattttatgtggttagtaattttgtacctaaaagtatttgaaattctataaatttggacttgacgtgagcaaaagaaaatttctacgtaagcgaaactaataaaactacagtcactttcagatgca

SEQ ID NO: 3752 - DNA, 4062 bp, Homo sapiens
gcagtatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccagaacaacaaaacagcgcagaagcacaaacaaatcagcttttagtatcaaccacgtgtcaaggcaggtcacgtcctctggcgtcagccacggcggcactgtcagcctgcaggatgctgtgactcgacggcctcctgtattggacgagtcttggattcgtgaacagaccacagtggaccacttctggggtcttgatgatgatggtgatcttaaaggtggaaataaagctgccattcagggaaacggggatgtgggagccgccgccgccaccgcgcacaacggcttctcctgcagcaactgcagcatgctgtccgagcgcaaggacgtgctcacggcgcaccccgcggcccccgggcccgtgtcgagagtttattctagggacaggaatcaaaaatgcgacgactgtaagggcaagaggcacctcgacgcgcacacagccgcccactcgcagtcgccacggctgcccggtcgggcagggaccctctggcacatctgggcatgtgcaggttacttcttgctgcagattctgcgcaggatcggagctgtgggccaggctgtgtccaggacggcgtggtcggccctttggctggccgtggttgctccagggaaggcagcctctggagtgttctggtggctggggattggatggtaccagtttgttactttgatttcttggctgaatgtgtttcttcttaccaggtgccttcgaaacatctgcaagtttttagtcttgctcatcccactcttccttttactagcaggtctctccttacggggccagggcaatttcttttcgttcttgcccgtgttgaactgggcaagcatgcatagaacacagcgggtggatgacccccaggacgtgtttaaacccacgacttctcgcctgaagcagcctctgcagggtgacagtgaggcttttccgtggcattggatgagtggcgtggagcagcaggtggcctctctgtctggacagtgccaccaccatggtgagaatctccgagagctgaccactttgctacagaagctgcaggctcgggtggaccagatggaaggcggcgctgccgggccgtcagcttcggtcagagacgctgtgggacagcccccgagggagactgactttatggcctttcaccaagaacatgaagtgcgtatgtcacacttggaagatattctgggaaaactgagagaaaaatctgaggccatccagaaggaactagaacagaccaagcaaaaaacaatcagtgcggttggtgagcagctcctgcccacagtcgagcacctccagctggagctggatcagctaaagtcagagctgtccagctggcgacacgtgaagaccggctgtgagacagtggatgccgtacaagaaagagtggacgtgcaagtcagagaaatggtgaaactcctgttttccgaagatcagcaaggcggttctctggaacagctgctgcagaggttctcatcacagtttgtgagcaaaggcgacttgcagacgatgctgcgagacctgcagctgcagatcctgcggaacgtcacccaccacgtttccgtgaccaagcagctcccaacctcagaagccgtggtgtctgctgtgagcgaggcgggggcgtctggaataacagaggcgcaagcacgtgccatcgtgaacagcgccttgaagctgtattcccaagataagaccgggatggtggactttgctctggaatctggtggtggcagcatcttgagtactcgctgttctgaaacttacgaaaccaaaacggcgctgatgagtctgtttgggatcccgctgtggtacttctcgcagtccccgcgcgtggtcatccagcctgacatttaccccggtaactgctgggcatttaaaggctcccaggggtacctggtggtgaggctctccatgatgatccacccagccgccttcactctggagcacatccctaagacgctgtcgccaacaggcaacatcagcagcgcccccaaggacttcgccgtctatggattagaaaatgagtatcaggaagaagggcagcttctgggacagttcacgtatgatcaggatggggagtcgctccagatgttccaggccctgaaaagacccgacgacacagctttccaaatagtggaacttcggattttttctaactggggccatcctgagtatacctgtctgtatcggttcagagttcatggcgaacctgtcaagtgaagacactactcattatttttgtacatttttgtatatactgggacagcgtgaaacactggaatccttcatggacgagggcatatacaatgatgggacagtgccacactccttcaataaacgtggctgctggccagaggacgtgagcgtgtgacgggcgccttggcgccacctgttgggtgctcactgcctctgcaggtgcagaggggtcagcagcaggagaagcgtgttgaacacgtggctctcagacactccttgtttttaacgggaagctctttgcatttgcatttcctcaacaaaggagcaaagcagaggaagctgagagtctggcgtgttcttgacgctttggtcttcagccttgcactggctcttctaaaggacttttggagggcagataatttcatctgttaaatccaacacacatttctttcagggaaaaacaatgtcaccaaattttcagagttctaaactcctttccttcaagccggaattttccttttttcagcaccagtaggtactaagtctccagatggggaaataactaaaatgtgtttttctgctttgttcgctcttacttctgaggaaggtttccagtcaggactcgctgtaccaatatccatggaggaatatgggagcgtttcgctctccttgtaggctgaagtcagtctgacttgaaggggcctggtttggatctaagcaaacacccagatggggttctctggtctcagcaaggcttttcctgttgggagtcacagtaaacagaaacccaaaaatctcatcttgggtgttttcagggcttgttttgagttttgctgaatagggagcgcaagacgccctgagcctccctctcactggtggtgataagaggagccgtctggtgtgtcagggtcacgaacccgttacatttcaggacgatcctttttccttcagcagcatttcttactggctgtggctggaatctgccttttatcacagctgtcaccattctcacgtgattcttgtgagactctttttggttataattactatttaatatttagactattttactgagcagactttataaatgagatatctacaaggcacttaaagtgttacagatgttttaccttaagaattatttaagttgtgttgggttaagacagttttcagtgtaccgtaaatgttgtgttttcagaaaaagacaaaacgatggtgctgactggttttctgtatattgcacaacagtcctcaaatacactgatgtatgaaactattcatacatcaagcagcatttttttcactctccttagaattggaactatgcagttaaggcagataaaatgtacagatgtttcatatattacaggttacatatataaatcaaaatttcctatataaaactgatttgggatttggggtggaaatattttgaatattaatttatttttaaagatgcaagataggactttgtgcaatgtatttttgtaaatgcttttcaaaatatctgtctttggtagtgcttctgctgctgccaccaaattgataagatgctattaagaggtttaaataaagagttttaatttttaaaag

SEQ ID NO: 3753 - DNA, 1822 bp, Homo sapiens
caagtggttttaatgaagctcagttatgaatcagaaaattacaaattgaaaactcatgaatcaaaagattgtgaatccgaaagctataagtcaaaaagccatgaatcaaaagctcatgccagttactatgggagaatgaatgtgagagaggttctcagagaggatggccacctcagtgtaaatggggaagcgctgtggaaggcagcctctggagtgttctggtggctggggattggatggtaccagtttgttactttgatttcttggctgaatgtgtttcttcttaccaggtgccttcgaaacatctgcaagtttttagtcttgctcatcccactcttccttttactagcaggtctctccttacggggccagggcaatttcttttcgttcttgcccgtgttgaactgggcaagcatgcatagaacacagcgggtggatgacccccaggacgtgtttaaacccacgacttctcgcctgaagcagcctctgcagggtgacagtgaggcttttccgtggcattggatgagtggcgtggagcagcaggtggcctctctgtctggacagtgccaccaccatggtgagaatctccgagagctgaccactttgctacagaagctgcaggctcgggtggaccagatggaaggcggcgctgccgggccgtcagcttcgactgactttatggcctttcaccaagaacatgaagtgcgtatgtcacacttggaagatattctgggaaaactgagagaaaaatctgaggccatccagaaggaactagaacagaccaagcaaaaaacaatcagtgcggttggtgagcagctcctgcccacagtcgagcacctccagctggagctggatcagctaaagtcagagctgtccagctggcgacacgtgaagaccggctgtgagacagtggatgccgtacaagaaagagtggacgtgcaagtcagagaaatggtgaaactcctgttttccgaagatcagcaaggcggttctctggaacagctgctgcagaggttctcatcacagtttgtgagcaaaggcgacttgcagacgatgctgcgagacctgcagctgcagatcctgcggaacgtcacccaccacgtttccgtgaccaagcagctcccaacctcagaagccgtggtgtctgctgtgagcgaggcgggggcgtctggaataacagaggcgcaagcacgtgccatcgtgaacagcgccttgaagctgtattcccaagataagaccgggatggtggactttgctctggaatctggtggtggcagcatcttgagtactcgctgttctgaaacttacgaaaccaaaacggcgctgatgagtctgtttgggatcccgctgtggtacttctcgcagtccccgcgcgtggtcatccagcctgacatttaccccggtaactgctgggcatttaaaggctcccaggggtacctggtggtgaggctctccatgatgatccacccagccgccttcactctggagcacatccctaagacgctgtcgccaacaggcaacatcagcagcgcccccaaggacttcgccgtctatggattagaaaatgagtatcaggaagaagggcagcttctgggacagttcacgtatgatcaggatggggagtcgctccagatgttccaggccctgaaaagacccgacgacacagctttccaaatagtggaacttcggattttttctaactggggccatcctgagtatacctgtctgtatcggttcagagttcatggcgaacctgtcaagtgaagacactactcattatttttgtacatttttgtatatactgggacagcgtgaaacactg

SEQ ID NO: 3754 - DNA, 540 bp, Homo sapiens
aatatactcaacactttctaacctaaaaaatatcctgttttttggtgaggaaaaaagtgtaaatagtgccttaagcttttttgttattcaccctgcagtttcttttctgattctgagatgcttgtgagagcttcagccatctaggaacgcatacgctgctgcttgaccacgctgtagcagtatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccagaacaacaaaacagcgcagaagcacaaacaaatcagcttttagtatcaaccacgtgtcaaggcaggtcacgtcct

SEQ ID NO: 3755 - DNA, 633 bp, Homo sapiens
gcgcaggtgaagacgcccggagaccctggcggtcgtggcgcagggggttgtggtctctccatgctgcccaggtcggactcctaggctcaagcgatcccctcgccccagcctgcctggaggcgcgcgcgtggtctccgcgccctgttgcgccttcaaagtgcccagaatggtgtctggtgcaaaataagcagcggcggggaacaccttgccactgtcaccgtcatggggaggatttctcccggctccccagggctccccaggacagtttcttttctgattctgagatgcttgtgagagcttcagccatctaggaacgcatacgctgctgcttgaccacgctgtagcagtatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccag

SEQ ID NO: 3756 - DNA, 3868 bp, Homo sapiens
tatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccagaacaacaaaacagcgcagaagcacaaacaaatcagcttttagtatcaaccacgtgtcaaggcaggtcacgtcctctggcgtcagccacggcggcactgtcagcctgcaggatgctgtgactcgacggcctcctgtattggacgagtcttggattcgtgaacagaccacagtggaccacttctggggtcttgatgatgatggtgatcttaaaggtggaaataaagctgccattcagggaaacggggatgtgggagccgccgccgccaccgcgcacaacggcttctcctgcagcaactgcagcatgctgtccgagcgcaaggacgtgctcacggcgcaccccgcggcccccgggcccgtgtcgagagtttattctagggacaggaatcaaaaatggaaggcagcctctggagtgttctggtggctggggattggatggtaccagtttgttactttgatttcttggctgaatgtgtttcttcttaccaggtgccttcgaaacatctgcaagtttttagtcttgctcatcccactcttccttttactagcaggtctctccttacggggccagggcaatttcttttcgttcttgcccgtgttgaactgggcaagcatgcatagaacacagcgggtggatgacccccaggacgtgtttaaacccacgacttctcgcctgaagcagcctctgcagggtgacagtgaggcttttccgtggcattggatgagtggcgtggagcagcaggtggcctctctgtctggacagtgccaccaccatggtgagaatctccgagagctgaccactttgctacagaagctgcaggctcgggtggaccagatggaaggcggcgctgccgggccgtcagcttcggtcagagacgctgtgggacagcccccgagggagactgactttatggcctttcaccaagaacatgaagtgcgtatgtcacacttggaagatattctgggaaaactgagagaaaaatctgaggccatccagaaggaactagaacagaccaagcaaaaaacaatcagtgcggttggtgagcagctcctgcccacagtcgagcacctccagctggagctggatcagctaaagtcagagctgtccagctggcgacacgtgaagaccggctgtgagacagtggatgccgtacaagaaagagtggacgtgcaagtcagagaaatggtgaaactcctgttttccgaagatcagcaaggcggttctctggaacagctgctgcagaggttctcatcacagtttgtgagcaaaggcgacttgcagacgatgctgcgagacctgcagctgcagatcctgcggaacgtcacccaccacgtttccgtgaccaagcagctcccaacctcagaagccgtggtgtctgctgtgagcgaggcgggggcgtctggaataacagaggcgcaagcacgtgccatcgtgaacagcgccttgaagctgtattcccaagataagaccgggatggtggactttgctctggaatctggtggtggcagcatcttgagtactcgctgttctgaaacttacgaaaccaaaacggcgctgatgagtctgtttgggatcccgctgtggtacttctcgcagtccccgcgcgtggtcatccagcctgacatttaccccggtaactgctgggcatttaaaggctcccaggggtacctggtggtgaggctctccatgatgatccacccagccgccttcactctggagcacatccctaagacgctgtcgccaacaggcaacatcagcagcgcccccaaggacttcgccgtctatggattagaaaatgagtatcaggaagaagggcagcttctgggacagttcacgtatgatcaggatggggagtcgctccagatgttccaggccctgaaaagacccgacgacacagctttccaaatagtggaacttcggattttttctaactggggccatcctgagtatacctgtctgtatcggttcagagttcatggcgaacctgtcaagtgaagacactactcattatttttgtacatttttgtatatactgggacagcgtgaaacactggaatccttcatggacgagggcatatacaatgatgggacagtgccacactccttcaataaacgtggctgctggccagaggacgtgagcgtgtgacgggcgccttggcgccacctgttgggtgctcactgcctctgcaggtgcagaggggtcagcagcaggagaagcgtgttgaacacgtggctctcagacactccttgtttttaacgggaagctctttgcatttgcatttcctcaacaaaggagcaaagcagaggaagctgagagtctggcgtgttcttgacgctttggtcttcagccttgcactggctcttctaaaggacttttggagggcagataatttcatctgttaaatccaacacacatttctttcagggaaaaacaatgtcaccaaattttcagagttctaaactcctttccttcaagccggaattttccttttttcagcaccagtaggtactaagtctccagatggggaaataactaaaatgtgtttttctgctttgttcgctcttacttctgaggaaggtttccagtcaggactcgctgtaccaatatccatggaggaatatgggagcgtttcgctctccttgtaggctgaagtcagtctgacttgaaggggcctggtttggatctaagcaaacacccagatggggttctctggtctcagcaaggcttttcctgttgggagtcacagtaaacagaaacccaaaaatctcatcttgggtgttttcagggcttgttttgagttttgctgaatagggagcgcaagacgccctgagcctccctctcactggtggtgataagaggagccgtctggtgtgtcagggtcacgaacccgttacatttcaggacgatcctttttccttcagcagcatttcttactggctgtggctggaatctgccttttatcacagctgtcaccattctcacgtgattcttgtgagactctttttggttataattactatttaatatttagactattttactgagcagactttataaatgagatatctacaaggcacttaaagtgttacagatgttttaccttaagaattatttaagttgtgttgggttaagacagttttcagtgtaccgtaaatgttgtgttttcagaaaaagacaaaacgatggtgctgactggttttctgtatattgcacaacagtcctcaaatacactgatgtatgaaactattcatacatcaagcagcatttttttcactctccttagaattggaactatgcagttaaggcagataaaatgtacagatgtttcatatattacaggttacatatataaatcaaaatttcctatataaaactgatttgggatttggggtggaaatattttgaatattaatttatttttaaagatgcaagataggactttgtgcaatgtatttttgtaaatgcttttcaaaatatctgtctttggtagtgcttctgctgctgccaccaaattgataagatgctattaagaggtttaaataaagagttttaatttttaaaagggcatgggatataaacagtc

SEQ ID NO: 3757 - DNA, 676 bp, Homo sapiens
ttctcgggcctgggcggcgcagacgaggcctgaggcggcggcgcgaggcagtttcttttctgattctgagatgcttgtgagagcttcagccatctaggaacgcatacgctgctgcttgaccacgctgtagcagtatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccagaacaacaaaacagcgcagaagcacaaacaaatcagcttttagtatcaaccacgtgtcaaggcaggtcacgtcctctggcgtcagccacggcggcactgtcagcctgcaggatgctgtgactcgacggcctcctgtattggacgagtcttggattcgtgaacagaccacagtggaccacttctggggtcttgatgatgatggtgatcttaaaggtggaaataaagctgccattcagggaaacggggatgtgggagccg

SEQ ID NO: 3758 - DNA, 626 bp, Homo sapiens
ggggggacgcggggtcgcggcctgggcgccctcagcgcgggctgcgccagggcctcctgggccaacggctgccgcccccgcccgtcccgcgccccgcagctaccccggcccgcgcagtttcttttctgattctgagatgcttgtgagagcttcagccatctaggaacgcatacgctgctgcttgaccacgctgtagcagtatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccagaacaacaaaacagcgcagaagcacaaacaaatcagcttttagtatcaaccacgtgtcaaggcaggtcacgtcctctggcgtcagccacggcggcactgtcagcctgcaggatgctgtgactcgacggcctcctgtattgga

SEQ ID NO: 3759 - DNA, 537 bp, Homo sapiens
agacgaggcctgaggcggcggcgcgaggcagggttgtggtctctccatgctgcccaggtcggactcctaggctcaagcgatcccctcgccccagcctgcctggaggcgcgcgcgtggtctccgcgccctgttgcgccttcaaagtgcccagaatggtgtctggtgcaaaataagcagcggcggggaacaccttgccactgtcaccgtcatggggaggatttctcccggctccccagggctccccaggacagtatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccag

SEQ ID NO: 3760 - DNA, 3717 bp, Homo sapiens
agagcgtcttctcgggcctgggcggcgcagacgaggcctgaggcggcggcgcgaggcagtatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccagaacaacaaaacagcgcagaagcacaaacaaatcagcttttagtatcaaccacgtgtcaaggcaggtcacgtcctctggcgtcagccacggcggcactgtcagcctgcaggatgctgtgactcgacggcctcctgtattggacgagtcttggattcgtgaacagaccacagtggaccacttctgggggaaggcagcctctggagtgttctggtggctggggattggatggtaccagtttgttactttgatttcttggctgaatgtgtttcttcttaccaggtgccttcgaaacatctgcaagtttttagtcttgctcatcccactcttccttttactaggtctctccttacggggccagggcaatttcttttcgttcttgcccgtgttgaactgggcaagcatgcatagaacacagcgggtggatgacccccaggacgtgtttaaacccacgacttctcgcctgaagcagcctctgcagggtgacagtgaggcttttccgtggcattggatgagtggcgtggagcagcaggtggcctctctgtctggacagtgccaccaccatggtgagaatctccgagagctgaccactttgctacagaagctgcaggctcgggtggaccagatggaaggcggcgctgccgggccgtcagcttcggtcagagacgctgtgggacagcccccgagggagactgactttatggcctttcaccaagaacatgaagtgcgtatgtcacacttggaagatattctgggaaaactgagagaaaaatctgaggccatccagaaggaactagaacagaccaagcaaaaaacaatcagtgcggttggtgagcagctcctgcccacagtcgagcacctccagctggagctggatcagctaaagtcagagctgtccagctggcgacacgtgaagaccggctgtgagacagtggatgccgtacaagaaagagtggacgtgcaagtcagagaaatggtgaaactcctgttttccgaagatcagcaaggcggttctctggaacagctgctgcagaggttctcatcacagtttgtgagcaaaggcgacttgcagacgatgctgcgagacctgcagctgcagatcctgcggaacgtcacccaccacgtttccgtgaccaagcagctcccaacctcagaagccgtggtgtctgctgtgagcgaggcgggggcgtctggaataacagaggcgcaagcacgtgccatcgtgaacagcgccttgaagctgtattcccaagataagaccgggatggtggactttgctctggaatctggtggtggcagcatcttgagtactcgctgttctgaaacttacgaaaccaaaacggcgctgatgagtctgtttgggatcccgctgtggtacttctcgcagtccccgcgcgtggtcatccagcctgacatttaccccggtaactgctgggcatttaaaggctcccaggggtacctggtggtgaggctctccatgatgatccacccagccgccttcactctggagcacatccctaagacgctgtcgccaacaggcaacatcagcagcgcccccaaggacttcgccgtctatggattagaaaatgagtatcaggaagaagggcagcttctgggacagttcacgtatgatcaggatggggagtcgctccagatgttccaggccctgaaaagacccgacgacacagctttccaaatagtggaacttcggattttttctaactggggccatcctgagtatacctgtctgtatcggttcagagttcatggcgaacctgtcaagtgaagacactactcattatttttgtacatttttgtatatactgggacagcgtgaaacactggaatccttcatggacgagggcatatacaatgatgggacagtgccacactccttcaataaacgtggctgctggccagaggacgtgagcgtgtgacgggcgccttggcgccacctgttgggtgctcactgcctctgcaggtgcagaggggtcagcagcaggagaagcgtgttgaacacgtggctctcagacactccttgtttttaacgggaagctctttgcatttgcatttcctcaacaaaggagcaaagcagaggaagctgagagtctggcgtgttcttgacgctttggtcttcagccttgcactggctcttctaaaggacttttggagggcagataatttcatctgttaaatccaacacacatttctttcagggaaaaacaatgtcaccaaattttcagagttctaaactcctttccttcaagccggaattttccttttttcagcaccagtaggtactaagtctccagatggggaaataactaaaatgtgtttttctgctttgttcgctcttacttctgaggaaggtttccagtcaggactcgctgtaccaatatccatggaggaatatgggagcgtttcgctctccttgtaggctgaagtcagtctgacttgaaggggcctggtttggatctaagcaaacacccagatggggttctctggtctcagcaaggcttttcctgttgggagtcacagtaaacagaaacccaaaaatctcatcttgggtgttttcagggcttgttttgagttttgctgaatagggagcgcaagacgccctgagcctccctctcactggtggtgataagaggagccgtctggtgtgtcagggtcacgaacccgttacatttcaggacgatcctttttccttcagcagcatttcttactggctgtggctggaatctgccttttatcacagctgtcaccattctcacgtgattcttgtgagactctttttggttataattactatttaatatttagactattttactgagcagactttataaatgagatatctacaaggcacttaaagtgttacagatgttttaccttaagaattatttaagttgtgttgggttaagacagttttcagtgtaccgtaaatgttgtgttttcagaaaaagacaaaacgatggtgctgactggttttctgtatattgcacaacagtcctcaaatacactgatgtatgaaactattcatacatcaagcagcatttttttcactctccttagaattggaactatgcagttaaggcagataaaatgtacagatgtttcatatattacaggttacatatataaatcaaaatttcctatataaaactgatttgggatttggggtggaaatattttgaatattaatttatttttaaagatgcaagataggactttgtgcaatgtatttttgtaaatgcttttcaaaatatctgtctttggtagtgcttctgctgctgccaccaaattgataagatgctattaagaggtttaaataaagagttttaatttttaaaagggcatgggatataaacagtc

SEQ ID NO: 3761 - DNA, 4514 bp, Homo sapiens
atgggagacgtgcggaaggccaaggaggcactggccgaggtgcagatccctcccccagatgcgggcccctcccccagatgcaaaccccccccagcagagcgtcttctcgggcctgggcggcgcagacgaggcctgaggcggcggcgcgaggcagtatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccagaacaacaaaacagcgcagaagcacaaacaaatcagcttttagtatcaaccacgtgtcaaggcaggtcacgtcctctggcgtcagccacggcggcactgtcagcctgcaggatgctgtgactcgacggcctcctgtattggacgagtcttggattcgtgaacagaccacagtggaccacttctggggtcttgatgatgatggtgatcttaaaggtggaaataaagctgccattcagggaaacggggatgtgggagccgccgccgccaccgcgcacaacggcttctcctgcagcaactgcagcatgctgtccgagcgcaaggacgtgctcacggcgcaccccgcggcccccgggcccgtgtcgagagtttattctagggacaggaatcaaaaatgcggtgcgtctttctacgtgaataggattttgtggctggccagatacactgcatcatctttttcatcatttttagttcaactttttcaagtggttttaatgaagctcagttatgaatcagaaaattacaaattgaaaactcatgaatcaaaagattgtgaatccgaaagctataagtcaaaaagccatgaatcaaaagctcatgccagttactatgggagaatgaatgtgagagaggttctcagagaggatggccacctcagtgtaaatggggaagcgctgtgcgacgactgtaagggcaagaggcacctcgacgcgcacacagccgcccactcgcagtcgccacggctgcccggtcgggcagggaccctctggcacatctgggcatgtgcaggttacttcttgctgcagattctgcgcaggatcggagctgtgggccaggctgtgtccaggacggcgtggtcggccctttggctggccgtggttgctccagggaaggcagcctctggagtgttctggtggctggggattggatggtaccagtttgttactttgatttcttggctgaatgtgtttcttcttaccaggtgccttcgaaacatctgcaagtttttagtcttgctcatcccactcttccttttactagcaggtctctccttacggggccagggcaatttcttttcgttcttgcccgtgttgaactgggcaagcatgcatagaacacagcgggtggatgacccccaggacgtgtttaaacccacgacttctcgcctgaagcagcctctgcagggtgacagtgaggcttttccgtggcattggatgagtggcgtggagcagcaggtggcctctctgtctggacagtgccaccaccatggtgagaatctccgagagctgaccactttgctacagaagctgcaggctcgggtggaccagatggaaggcggcgctgccgggccgtcagcttcggtcagagacgctgtgggacagcccccgagggagactgactttatggcctttcaccaagaacatgaagtgcgtatgtcacacttggaagatattctgggaaaactgagagaaaaatctgaggccatccagaaggaactagaacagaccaagcaaaaaacaatcagtgcggttggtgagcagctcctgcccacagtcgagcacctccagctggagctggatcagctaaagtcagagctgtccagctggcgacacgtgaagaccggctgtgagacagtggatgccgtacaagaaagagtggacgtgcaagtcagagaaatggtgaaactcctgttttccgaagatcagcaaggcggttctctggaacagctgctgcagaggttctcatcacagtttgtgagcaaaggcgacttgcagacgatgctgcgagacctgcagctgcagatcctgcggaacgtcacccaccacgtttccgtgaccaagcagctcccaacctcagaagccgtggtgtctgctgtgagcgaggcgggggcgtctggaataacagaggcgcaagcacgtgccatcgtgaacagcgccttgaagctgtattcccaagataagaccgggatggtggactttgctctggaatctggtggtggcagcatcttgagtactcgctgttctgaaacttacgaaaccaaaacggcgctgatgagtctgtttgggatcccgctgtggtacttctcgcagtccccgcgcgtggtcatccagcctgacatttaccccggtaactgctgggcatttaaaggctcccaggggtacctggtggtgaggctctccatgatgatccacccagccgccttcactctggagcacatccctaagacgctgtcgccaacaggcaacatcagcagcgcccccaaggacttcgccgtctatggattagaaaatgagtatcaggaagaagggcagcttctgggacagttcacgtatgatcaggatggggagtcgctccagatgttccaggccctgaaaagacccgacgacacagctttccaaatagtggaacttcggattttttctaactggggccatcctgagtatacctgtctgtatcggttcagagttcatggcgaacctgtcaagtgaagacactactcattatttttgtacatttttgtatatactgggacagcgtgaaacactggaatccttcatggacgagggcatatacaatgatgggacagtgccacactccttcaataaacgtggctgctggccagaggacgtgagcgtgtgacgggcgccttggcgccacctgttgggtgctcactgcctctgcaggtgcagaggggtcagcagcaggagaagcgtgttgaacacgtggctctcagacactccttgtttttaacgggaagctctttgcatttgcatttcctcaacaaaggagcaaagcagaggaagctgagagtctggcgtgttcttgacgctttggtcttcagccttgcactggctcttctaaaggacttttggagggcagataatttcatctgttaaatccaacacacatttctttcagggaaaaacaatgtcaccaaattttcagagttctaaactcctttccttcaagccggaattttccttttttcagcaccagtaggtactaagtctccagatggggaaataactaaaatgtgtttttctgctttgttcgctcttacttctgaggaaggtttccagtcaggactcgctgtaccaatatccatggaggaatatgggagcgtttcgctctccttgtaggctgaagtcagtctgacttgaaggggcctggtttggatctaagcaaacacccagatggggttctctggtctcagcaaggcttttcctgttgggagtcacagtaaacagaaacccaaaaatctcatcttgggtgttttcagggcttgttttgagttttgctgaatagggagcgcaagacgccctgagcctccctctcactggtggtgataagaggagccgtctggtgtgtcagggtcacgaacccgttacatttcaggacgatcctttttccttcagcagcatttcttactggctgtggctggaatctgccttttatcacagctgtcaccattctcacgtgattcttgtgagactctttttggttataattactatttaatatttagactattttactgagcagactttataaatgagatatctacaaggcacttaaagtgttacagatgttttaccttaagaattatttaagttgtgttgggttaagacagttttcagtgtaccgtaaatgttgtgttttcagaaaaagacaaaacgatggtgctgactggttttctgtatattgcacaacagtcctcaaatacactgatgtatgaaactattcatacatcaagcagcatttttttcactctccttagaattggaactatgcagttaaggcagataaaatgtacagatgtttcatatattacaggttacatatataaatcaaaatttcctatataaaactgatttgggatttggggtggaaatattttgaatattaatttatttttaaagatgcaagataggactttgtgcaatgtatttttgtaaatgcttttcaaaatatctgtctttggtagtgcttctgctgctgccaccaaattgataagatgctattaagaggtttaaataaagagttttaatttttaaaagggcatgggatataaacagtc

SEQ ID NO: 3762 - DNA, 1309 bp, Homo sapiens
agagcgtcttctcgggcctgggcggcgcagacgaggcctgaggcggcggcgcgaggcagggttgtggtctctccatgctgcccaggtcggactcctaggctcaagcgatcccctcgccccagcctgcctggaggcgcgcgcgtggtctccgcgccctgttgcgccttcaaagtgcccagaatggtgtctggtgcaaaataagcagcggcggggaacaccttgccactgtcaccgtcatggggaggatttctcccggctccccagggctccccaggacagtatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccagaacaacaaaacagcgcagaagcacaaacaaatcagcttttagtatcaaccacgtgtcaaggcaggtcacgtcctctggcgtcagccacggcggcactgtcagcctgcaggatgctgtgactcgacggcctcctgtattggacgagtcttggattcgtgaacagaccacagtggaccacttctggggtcttgatgatgatggtgatcttaaaggtggaaataaagctgccattcagggaaacggggatgtgggagccgccgccgccaccgcgcacaacggcttctcctgcagcaactgcagcatgctgtccgagcgcaaggacgtgctcacggcgcaccccgcggcccccgggcccgtgtcgagagtttattctagggacaggaatcaaaaatgtaagtctcagtcctttaaaactcagaaaaaggtgtgttttccaaatttaatatttcctttctgtaagtctcagtgtctgcactatttgtcttggagacttaaaattatcccttgaaagcataagaagtacaccccaaaccagctttgtccttcctgtcctcttctagtttacattttatgtggttagtaattttgtacctaaaagtatttgaaattctataaatttggacttgacgtgagcaaaagaaaatttctacgtaagcgaaactaataaaactacagtcactttcagatgcacacctttatttttataaaacggcacagatgttcacacatactgaaggagtggct

SEQ ID NO: 3763 - DNA, 563 bp, Homo sapiens
agagcaggcctgcgcacctcaggagcccaggcatggtgtataggtggagggtagcctacattggatccaggccaaggccctgtcctgtgccgggctcctctgcgttttcttttctgattctgagatgcttgtgagagcttcagccatctaggaacgcatacgctgctgcttgaccacgctgtagcagtatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccagaacaacaaaacagcgcagaagcacaaacaaatcagcttttagtatcaaccacgtgtcaaggcaggtcacgtcctctggcgtcagccacgg

SEQ ID NO: 3764 - DNA, 4712 bp, Homo sapiens
atgcggcgcggccccggaggcagcagcagcggcggcggcagccggagcagtaggcacccgagcagcgccagcggccgagcgggcggcttcctggcctgggcgctccggtggcggcggaggtgcgcgcggagccatggttatcatgtcggagttcagcgcggaccccgcgggccagggtcagggccagcagaagcccctccgggtgggtttttacgacatcgagcggaccctgggcaaaggcaacttcgcggtggtgaagctggcgcggcatcgagtcaccaaaacgcaggttgcaataaaaataattgataaaacacgattagattcaagcaatttggagaaaatctatcgtgaggttcagctgatgaagcttctgaaccatccacacatcataaagctttaccaggttatggaaacaaaggacatgctttacatcgtcactgaatttgctaaaaatggagaaatgtttgattatttgacttccaacgggcacctgagtgagaacgaggcgcggaagaagttctggcaaatcctgtcggccgtggagtactgtcacgaccatcacatcgtccaccgggacctcaagaccgagaacctcctgctggatggcaacatggacatcaagctggcagattttggatttgggaatttctacaagtcaggagagcctctgtccacgtggtgtgggagccccccgtatgccgccccggaagtctttgaggggaaggagtatgaaggcccccagctggacatctggagcctgggcgtggtgctgtacgtcctggtctgcggttctctccccttcgatgggcctaacctgccgacgctgagacagcgggtgctggagggccgcttccgcatccccttcttcatgtctcaagactgtgagagcctgatccgccgcatgctggtggtggaccccgccaggcgcatcaccatcgcccagatccggcagcaccggtggatgcgggctgagccctgcttgccgggacccgcctgccccgccttctccgcacacagctacacctccaacctgggcgactacgatgagcaggcgctgggtatcatgcagaccctgggcgtggaccggcagaggacggtggagtcactgcaaaacagcagctataaccactttgctgccatttattacctcctccttgagcggctcaaggagtatcggaatgcccagtgcgcccgccccgggcctgccaggcagccgcggcctcggagctcggacctcagtggtttggaggtgcctcaggaaggtctttccaccgaccctttccgacctgccttgctgtgcccgcagccgcagaccttggtgcagtccgtcctccaggccgagatggactgtgagctccagagctcgctgcagtggcccttgttcttcccggtggatgccagctgcagcggagtgttccggccccggcccgtgtccccaagcagcctgctggacacagccatcagtgaggaggccaggcaggggccgggcctagaggaggagcaggacacgcaggagtccctgcccagcagcacgggccggaggcacaccctggccgaggtctccacccgcctctccccactcaccgcgccatgtatagtcgtctccccctccaccacggcaagtcctgcagagggaaccagctctgacagttgtctgaccttctctgcgagcaaaagccccgcggggctcagtggcaccccggccactcaggggctgctgggcgcctgctccccggtcaggctggcctcgcccttcctggggtcgcagtccgccaccccagtgctgcaggctcaggggggcttgggaggagctgttctgctccctgtcagcttccaggagggacggcgggcgtcggacacctcactgactcaagggctgaaggcctttcggcagcagctgaggaagaccacgcggaccaaagggtttctgggactgaacaaaatcaaggggctggctcgccaggtgtgccaggcccccgccagccgggccagcaggggcggcctgagccccttccacgcccctgcacagagcccaggcctgcacggcggcgcagccggcagccgggagggctggagcctgctggaggaggtgctagagcagcagaggctgctccagttacagcaccacccggccgctgcacccggctgctcccaggccccccagccggcccctgccccgtttgtgatcgccccctgtgatggccctggggctgccccgctccccagcaccctcctcacgtcggggctcccgctgctgccgcccccactcctgcagaccggcgcgtccccggtggcctcagcggcgcagctcctggacacacacctgcacattggcaccggccccaccgccctccccgctgtgcccccaccacgcctggccaggctggccccaggttgtgagcccctggggctgctgcagggggactgtgagatggaggacctgatgccctgctccctaggcacgtttgtcctggtgcagtgagggcagccctgcatcctggcacggacactgactcttacagcaataacttcagaggaggtgaagacatctggcctcaaagccaagaactttctagaagcgaaataagcaatacgttaggtgttttggctttttagtttatttttgttttatttttttcttgcactgagtgacctcaactttgagtagggactggaaactttaggaagaaagataattgaggggcgtgtctgggggcgggggcaggaggggagcggggtggagggaacacgtgcagtgccgtggtgtggggatctcggcccctctctctgggttcgtcgtggttgagatgattacctcggacgtctacggaaacgagcgggcgcattgttgtccgcttgtgtgtgtgtgtgtgtgtgtgtgtgtgcgcgtgcattgattactatccatttctttagtcaacgctctccacttcctgatttctgctttaaggaaaactgtgaactttctgcttcatgtatcagttttaaagcagcccaggcaaagatcatctacagattctaggaattctctcccctgaaatcaaaacctggaagacttttttttcttattttagttgagaagtttcataaactgctcaaggattagttttccaggactctgcggaggaacggcaggaagaacctcagagagggcagaggtgacttcaaagtgctggggactccgtcctgagggtcacttggccctgagcccctgcgtgcccttgcggaagcccagaagcttcttcctgctgcacctcccgtttccgctgctgctgacgtttatgcatttcatgatggggtccaacaagaacacctgacttgggtgaagttgtgcaatattggaggctgactgtagggctgggcagctgggagacaggctcatggctcatggctcatggctcagggcggtgcctgccctgggccgggacccccctccccaccccccacctaggctttttgggttttgttcaaggaaggtaaagtgagaggtttaggtcagtgtttttaagtttttgttttttttttaaagcaaatcctgtatatgtatctacatgggagacaggtagacactacttatttgttacattttgtactatacgtttgtgttccaggtttcagcttccctcgctcctgttgttaagaagcgtccctgtcagcacaggtgtgcattgaggaaggggccccagggccttcgctccctcagcactggggtggaggcggcaggaaggggcggcccttacctggcaggtctgggcgcacctttagcaggtggactccgtggggctccaccagccagaagcctctggaaggcaacgaaggcaatgctgctccctgagtccagtccccgcccccaaacccagcccaggtgccttcagctacttcggcttcttaaaccctgcagtgttaaacagaggcattgagaaaggggaaaggcgggtatttttaaaagccaaagattgacccagttacttgagggtagggaggcgggcccagtgcaggaggctgcatccctggcctgctggtgcccaccgggggctgtgcctgtgccgggccgcagggaagctggctgcccccattcctgctgctgctgctgctgctgctctgtggctgtttcaaagactgggcgaaaggctgtccggagggcagaccaggtgccttgccgcagagaaaacaccaaagtctcctgttcgctcataaagaagtttttgggatgggagagaatccagaccatcttggggcagccaggcccttgccttcatttttacagaggtagcacaactgattccaacacaaaaccccttcccctttttaaaatgatttctgttctaatgccatagatcaaaggcctcagaaaccattgtgtgtttcctctttgaagcaatgacaagcactttactttcacggtggtttttgttttttcttattgctgtggaacctcttttggaggacgttaaaggcgtgttttacttgtttttttaagagtgtgtgatgtgtgttttgtagatttcttgacagtgctgtaatacagacggcaatgcaatagcctatttaaagacactacgtgatctgattgagatgtacatagtttttttttttaccataactgaattattttatctcttatgttaacatgagaaatgtatgccaaatgattagttgatgtatgttttttaatttaatatttaaataaaatatttggaaggaaaaaa

SEQ ID NO: 3765 - DNA, 7711 bp, Homo sapiens
attttgaagagaggggtcccggggagctccctccaagatctagaggctccgcggccacccctgccgggtcctgccaagacttgctagaaggaacgagtcgcgtgccttagttagttggttcccgtcacaggaagaaacgcctttgcagtgggtttaattgcttctgggccgagcgaattccccgccgtacaactcagtggtgcggactttgcctcctgctaccctgttgctgcgccgagcggggtgggaaagtttctggagttgtcagtcgcgcagcccgtggccacctagacccgaggtgcgggcgcctgcgaagggcccccgcggggtggccggggccgccggggcatgcagcgcgggggcgcggctcggtgacgccgcgggcggggacccggcatccgggcaggctgcgcgcgggtgcggggcgagggcgccgcggggactgggacgcacggcccgcgcgcgggacacggccatggaggacgcgggagcagctggcccggggccggagcctgagcccgagcccgagccggagcccgagcccgcgccggagccggaaccggagcccaagccgggtgctggcacatccgaggcgttctcccgactctggaccgacgtgatgggtatcctggacggttcactgggaaacatcgatgacctggcgcagcagtatgcagattattacaacacctgtttctccgacgtgtgcgagaggatggaggagctgcggaaacggcgggtttcccaggacctggaagtggagaaacccgatgctagccccacgtcacttcagctgcggtcccagatcgaagagtcgcttggcttctgtagcgccgtgtcaaccccagaagtggaaagaaagaaccctcttcataaatcaaactcagaagacagctctgtaggaaaaggagactggaagaagaaaaataagtatttctggcagaacttccgaaagaaccagaaaggaataatgagacagacttcaaaaggagaagacgttggttatgttgccagtgaaataacgatgagcgatgaggagcggattcagctaatgatgatggtcaaagaaaagatgatcacaattgaggaagcacttgctaggctcaaggaatacgaggcccagcaccggcagtcggctgccctggaccctgctgactggccagatggttcttacccaacgtttgatggctcatcaaactgcaattcaagagaacaatcggatgatgagactgaggagtcggtgaagtttaagaggttacacaagctggtaaactccactcgcagagtcagaaagaaactaattagggtggaagaaatgaaaaaacccagcactgaaggtggggaggagcacgtgtttgagaattcgccggtcctggatgaacggtccgccctctactctggcgtgcacaagaagccccttttctttgatggctctcctgagaaacctcccgaagatgactcagactctctcaccacgtctccatcctccagcagcctggacacctggggggctggccggaagttggtcaaaaccttcagcaaaggagagagccggggcctgattaagccccccaagaagatggggacattcttctcctacccagaagaagaaaaggcccagaaagtgtcccgctccctcaccgagggggagatgaagaagggtctcgggtccctaagccacgggagaacctgcagttttggaggatttgacttgacgaatcgctctctgcacgttggcagtaataattctgacccaatgggtaaagaaggagactttgtgtacaaagaagtcatcaaatcacctactgcctctcgcatctctcttgggaaaaaggtgaaatcagtgaaagagacgatgagaaagagaatgtctaaaaaatacagcagctctgtctctgagcaggactcgggccttgatggaatgcctggctcccctccgccttcacagcccgaccccgaacacttggacaagcccaagctcaaggccgggggttctgtagaaagtcttcgcagttctctcagtgggcagagctccatgagcggtcaaacagtgagcaccactgattcctcaaccagcaaccgggaaagcgtcaagtcggaagatggggatgacgaagagccgccttaccgaggcccgttctgcgggcgtgccagggtgcacaccgacttcacccccagtccctatgacacagactcactcaagctcaagaaaggagatatcatcgatataatcagcaagccacccatggggacctggatgggcctgctgaacaacaaagtcggcacgttcaagttcatctacgtggacgtgctcagtgaagacgaggagaaacccaaacgccccaccaggaggcgtcggaaaggacgaccaccccagcccaagtctgtggaggatctcctggatcggattaacctaaaagagcacatgcccactttcctgttcaatggatatgaagatttggacacctttaagctgctggaggaggaagacttggatgagttaaatatcagggacccggaacacagagctgttctcttgacagcagtggagctgttacaagagtatgacagtaacagcgaccagtcaggatcccaggagaagctgctcgttgacagccagggcctgagtggatgctcaccccgagactcaggatgctacgaaagcagtgagaacctggaaaacggcaagactcggaaagctagcctcctatctgccaagtcatccaccgagcccagcttgaagtcttttagcagaaaccagttgggcaattacccaacattgcctttaatgaaatcaggggatgcactgaagcagggacaggaggagggcaggctgggtggtggccttgccccagacacgtccaagagctgtgacccacctggtgtgactggtttgaataaaaaccgaagaagcctcccagtttccatctgccggagctgtgagaccctggagggcccccagactgtggacacttggccccgatcccattccctggatgaccttcaagtggagcctggtgctgagcaagacgtgcctaccgaggtgacagaaccgccccctcagattgtacctgaagtgccacagaagacgaccgcctcttccacgaaggcccagcccctggagcaagactctgctgtcgacaatgcattgctactgacccaaagcaagagattttctgaacctcagaaattgacaactaagaaactggagggctcaatcgcagcctctggtcgcggcctgtcaccccctcagtgtttgcccagaaactatgatgctcagcctcctggagctaaacacggtttagcaaggacgcctctggagggccacagaaaaggacacgagtttgaaggaacacaccatcccctgggcaccaaagaaggggtagatgctgagcagagaatgcagcccaaaattccatcacagcctccacctgttcctgccaaaaagagcagagaacgccttgctaacggactccaccctgttcccatgggccccagtggggccctccccagtcccgatgcgccatgcctgccagtgaaaaggggcagccccgccagccccaccagccctagcgactgtcccccagcactggctcccaggcctctctcagggcaggcgcctggcagcccaccaagcacaaggccgcccccctggctctcagagctccccgagaacacaagcctccaggagcacggtgtgaagctgggcccggctttgaccaggaaggtctcctgtgcccggggagtggatctagaaacgctcactgaaaacaagctgcacgctgaaggcatcgatctcacggaggagccgtattctgataagcatggccgctgtgggattcctgaagccctggtgcagagatacgcagaggacttggatcagcccgagcgggacgtcgccgccaacatggaccagatccgggtgaagcagcttcggaagcagcaccgcatggcgattccaagtggtggactcacggaaatctgccgaaagcccgtctctcctgggtgcatttcgtctgtgtcagattggctcatttccatcggtctgcccatgtacgccggcaccctctccaccgcgggcttcagcacactgagccaagtgccttctctgtctcacacttgccttcaggaggccggcatcacagaggagagacacataagaaagctcctatctgcagccagactcttcaaactgccgccaggccctgaggccatgtagccaggcccggaatgggcctctctggacaagagccaccctttcactgtgcatatgatgctgatgcaattcctccatcatctctggacgtgcagaccagatccagaagaaaggcctggcgtgtggccaaacagcgtgaaaccttggcacaggactgaggatcctctcctccagaaaagccccctcgaggaaataaattagtgcggttctctttgacccccaaagacaagacaagcacttatttttattttcagaagacaaaagaaccaagatgccaactggctgcgaatgctctatctccagtctgtctctgtgtactggtagaggctgggaggagtagggggcagcctgttccatttctgatagtgcccttgctcttctgtctgtcatcttgcaggatgcccgagggccagatgggcttagctaggccaaagtaacagactcaagagttattgtacattactgaccacgctcatttgttcaaaagttagaacatctggctgcaccaggaaaaaaaaaaaaaaaaagtcctgttcttctttagataaacaagagacattttcataattgctttctagcaatcagcttttatttgccttaatataagcttttaagcagttatctaactagtgtccacaaccctgtaaccatacttccacatcttcagcttaggcagacatcgaacctctctgggatgtttccagcaaaagtgagcttttctaatcgtctcattgtaacatggcttattttgtagaggtattcatcagccacacacttcatgttggtttttggtttttaagctaactacaaatctagtaaaaagctatctgaaattcacaaatatcatgtgtgtgcgtgcgtgcgtgcgcgtgtgtgtctgtattcatagtgactgcttttggttttaaccagtttagtatcgttactgtgtggatcgtcgcgctgcagtattgacttggaatcctgaccatgtccatcccaaaattcagtcctcagttaacggatcatgtttgcaaaaggtcactgtgaggctgcatatttcagaaagatgtccttaataagggaagtcatgtataagatgttttctaaaagacttttcagtattacaactaatactattattatccttctttttttatttagataattcttttaatttaaacaaaggttcactatggaaccagacaaatctcattagccatgtgttaagtatttgctactttaaattgttttacaactgatttcagcacattctatccttttttttttttgaaatggagtttcgctcttgtcacccaggctggagtgcaatggcacgatcttggctcactgcaacctcagtctcccaggttcaagtgattctcctgccttagcctcccgagtagctgggattataggcacccaccaccacgcccagctaatttttgtattattagtagagacagggtttcaccatgttggccaggctggtctcaaactcaactcctgacctcaggtggtccacccgcctcagcctcccaaagtgctgggattacaggtgtgagccaccgcacctggcctctgtcctcttttagtctagtgtctggttttctagcaaacagtaaatttaaacaagtaaactattatggtttccattgcttacaaaatgattttcctttacattcttatcatgaacactattttaagcatcaaatgcaatcatctaaaatataaaggtcaatcatttataatagaaacaccttgaccacaagcccttgattgaacattttataatatttcatctacttattaaaacaaataatttcccttgggttggaggggaagtgatttcataaattaattagaaagccatctttagcatattgcttatgtctggatccatgtttctgaggaaaaagacattctcaggtgatgtatttttttcatgcattagtatgcatttttaaaaaataatgcatgtttctttaataattaattttcatcttctataagatgccatgtgaagaagttgtggaaatgtagaataaaaagctaaagctgccaaatttctgttgaactcttaaaaacagctcatgtttgtttgtcctctcgggttgtggcctagcctatttgcaatgtaatgaagctgcagggttcttgtatagctaaagcgttcaatgcatttcacgtgctgtggtggatgtgggtgctgtagacaggcttcttctcttcctgctctcaaaatacctcggcttgacatttggacagatcctgtcattgtttaagctgagcaaaaaaccacacaaaagttgtgtaagagatgagataacaaaggagcgagagaaatctcatgtgaatttccaagttttaattcgttctccatgaaggattttcatttcagtgaaagtcgcagcagaagagggaactttctggagtttttgagaatgccaaaccacatttttatcacacttctttggaaatcaatgcctttgcatagaaaatcaaattcagggaccacaaagaattttcagtgggaatgtctagtctgaggggtctgaggttgtttttactttattgtgttgtttaaatattttaaaaatatctttagcgtttggtcttttttttttctgtaaacatttaatttggtctgagaaaagctgaatgtttgggtgtgacgtttgactgaggtggattggggctgcctgtggacattagtgaacaggtggtaggcttcaggaatatccagttttaatcagttgcatttggtacagaattttgagtaatggtgaaaattgttgtctttggaaagcacaaaagaaacctggaaaggcagttcggctcaggtagctacacataacattgtgtatgattttcacttcaaagctgtctggaaggaaatgcagtcagctccagctagtactatttatgtacccagataactaagatattgtttcatggccttgccttagtcagaggcccttttctctgtcctgaacccccaggtatgggtgaaattggaaattactaatctattggaaatcagttcctgacatagtaaagtttgctttcataactgcagcaaaaaaggtcaacttgccaagtcactgctgccatgtgtgtactgtattattttcagaaaaaaatataatagtctgagtccaagttatcttgatttaaaattgatagagaaaagaaactgtcgagcaagttatataacaactaacaacattgcactttctgtatatgaaatcaatatttaaataacttatttttctccattgctgttcttaaaaacattgtaagtagctgtaatataccagtaccaatatgttcttgcaattgcttcagcccaagaaagctgtgtattgttttaaaaattgtaaaaattattgtgatgattcatttagcataaagagaggtggacggaagggttttcctatgtatcaaaacttgtctataattatgtcatctatgtacctagaaaaaagtaaataaatttcttcagttgaatatgcc

SEQ ID NO: 3766 - DNA, 591 bp, Homo sapiens
gagtcagagaggaagtcagagaccatttgaacgtatggccagcagctcacttcatggaggaacaagattgcagggacggttcactgggaaacatcgatgacctggcgcagcagtatgcagattattacaacacctgtttctccgacgtgtgcgagaggatggaggagctgcggaaacggcgggtttcccaggacctggaagtggagaaacccgatgctagccccacgtcacttcagctgcggtcccagatcgaagagtcgcttggcttctgtagcgccgtgtcaaccccagaagtggaaagaaagtaagtctttctccctctgcccaggaccaccttccaagaaggtgtcttttaggtccatgctgacggaaatcaaacaggcgatcatgtgcgtatgtactatggagttatgcgatgtcattttccttaacatgttgcatgcatgtgtgtgtatctaggtggctaagagtgtgttttgtaatgcagttggtgatgtctgaggattttgtgaagagttactgattttacacttattgtgaataaaccctaaataaatctccggaaatagaaagggaaaggataggtgcatt

SEQ ID NO: 3767 - DNA, 537 bp, Homo sapiens
caggcccaggattttaaagacggttcactgggaaacatcgatgacctggcgcagcagtatgcagattattacaacacctgtttctccgacgtgtgcgagaggatggaggagctgcggaaacggcgggtttcccaggacctggaagtggagaaacccgatgctagccccacgtcacttcagctgcggtcccagatcgaagagtcgcttggcttctgtagcgccgtgtcaaccccagaagtggaaagaaagaaccctcttcataaatcaaactcagaagacagctctgtaggaaaaggagactggaagaagaaaaataagtatttctggcagaacttccgaaagaaccagaaaggaataatgagacagacttcaaaaggagaagacgttggttatgttgccagtgaaataacgatgagcgatgaggagcggattcagctaatgatgatggtcaaagaaaagatgatcacaattgaggaagcacttgctaggctcaaggaatacgaggcccagcaccggcagtcggctgccctggaccct

SEQ ID NO: 3768 - DNA, 2520 bp, Homo sapiens
gagattgcggagtttgatgctacaagagtgaagacgctctccgagtggggaggggggtgggaggtacaggacgtcttcagaattaccccttaggcttgctaaatgccgaagccgtcaagagaacaatcggatgatgagactgaggagtcggtgaagtttaagaggttacacaagctggtaaactccactcgcagagtcagaaagaaactaattagggtggaagaaatgaaaaaacccagcactgaaggtggggaggagcacgtgtttgagaattcgccggtcctggatgaacggtccgccctctactctggcgtgcacaagaagccccttttctttgatggctctcctgagaaacctcccgaagatgactcagactctctcaccacgtctccatcctccagcagcctggacacctggggggctggccggaagttggtcaaaaccttcagcaaaggagagagccggggcctgattaagccccccaagaagatggggacattcttctcctacccagaagaagaaaaggcccagaaagtgtcccgctccctcaccgagggggagatgaagaagggtctcgggtccctaagccacgggagaacctgcagttttggaggatttgacttgacgaatcgctctctgcacgttggcagtaataattctgacccaatgggtaaagaaggagactttgtgtacaaagaagtcatcaaatcacctactgcctctcgcatctctcttgggaaaaaggtgaaatcagtgaaagagacgatgagaaagagaatgtctaaaaaatacagcagctctgtctctgagcaggactcgggccttgatggaatgcctggctcccctccgccttcacagcccgaccccgaacacttggacaagcccaagctcaaggccgggggttctgtagaaagtcttcgcagttctctcagtgggcagagctccatgagcggtcaaacagtgagcaccactgattcctcaaccagcaaccgggaaagcgtcaagtcggaagatggggatgacgaagagccgccttaccgaggcccgttctgcgggcgtgccagggtgcacaccgacttcacccccagtccctatgacacagactcactcaagctcaagaaaggagatatcatcgatataatcagcaagccacccatggggacctggatgggcctgctgaacaacaaagtcggcacgttcaagttcatctacgtggacgtgctcagtgaagacgaggagaaacccaaacgccccaccaggaggcgtcggaaaggacgaccaccccagcccaagtctgtggaggatctcctggatcggattaacctaaaagagcacatgcccactttcctgttcaatggatatgaagatttggacacctttaagctgctggaggaggaagacttggatgagttaaatatcagggacccggaacacagagctgttctcttgacagcagtggagctgttacaagagtatgacagtaacagcgaccagtcaggatcccaggagaagctgctcgttgacagccagggcctgagtggatgctcaccccgagactcaggatgctacgaaagcagtgagaacctggaaaacggcaagactcggaaagctagcctcctatctgccaagtcatccaccgagcccagcttgaagtcttttagcagaaaccagttgggcaattacccaacattgcctttaatgaaatcaggggatgcactgaagcagggacaggaggagggcaggctgggtggtggccttgccccagacacgtccaagagctgtgacccacctggtgtgactggtttgaataaaaaccgaagaagcctcccagtttccatctgccggagctgtgagaccctggagggcccccagactgtggacacttggccccgatcccattccctggatgaccttcaagtggagcctggtgctgagcaagacgtgcctaccgaggtgacagaaccgccccctcagattgtacctgaagtgccacagaagacgaccgcctcttccacgaaggcccagcccctggagcaagactctgctgtcgacaatgcattgctactgacccaaagcaagagattttctgaacctcagaaattgacaactaagaaactggagggctcaatcgcagcctctggtcgcggcctgtcaccccctcagtgtttgcccagaaactatgatgctcagcctcctggagctaaacacggtttagcaaggacgcctctggagggccacagaaaaggacacgagtttgaaggaacacaccatcccctgggcaccaaagaaggggtagatgctgagcagagaatgcagcccaaaattccatcacagcctccacctgttcctgccaaaaagagcagagaacgccttgctaacggactccaccctgttcccatgggccccagtggggccctccccagtcccgatgcgccatgcctgccagtgaaaaggggcagccccgccagccccaccagccctagcgactgtcccccagcactggctcccaggcctctctca

SEQ ID NO: 3769 - DNA, 5075 bp, Homo sapiens
agtggcttttactagaaaaacaacagtgaatttgaatcaagttctgcaaatacagaaatcactaagatataagcagttccgtgaagtttgcaaccacctaaaaggataataaagttttcattctttataacatcagcattgttcctactgaaattaaaaagtgtggtcaaacacagtcactgaatcaaccgttttctttctgggcaaatgtggcatcttcattcactgagagaaaagggtcaccatgaattaacttgggcagttcgatgggaaagttaccagcgtttttggctaggatggggaagcggtgagtgagtaattctcttggcctgattggacaactgtaaacataaccttctccccccctcttctcagcgatttaaagctaaacaaaatgaaagtctgtttgaaaagcttgctgttggtgtcagagccgtgggatttcaaacctgggttttcaggatgcctgagtacatggatcctctaacacatatcccttcattatctctactgaatgtagctgatgttaggggaagttctgtgctggagacagggaatctcacagcactggactcatggagggtttttcttttgttttttaggctttttaaaaaaaatggttggtttttgcatgttaaggggattctagacctctggggtaggcagagttccagtggcctgtgaaagggaaaaatgagtgaagtttccttacgacatgactcatgtgtttttttctcatcatttctcgttttctactttcatcctgtccacgtatttgtgattcagagatgtcctgcaaacggggactgctgggttggtgcactgccggctggcttaagcataactgaagtttttctgccctaccctcttttccacagagaacctgcagttttggaggatttgacttgacgaatcgctctctgcacgttggcagtaataattctgacccaatgggtaaagaaggagactttgtgtacaaagaagtcatcaaatcacctactgcctctcgcatctctcttgggaaaaaggtgaaatcagtgaaagagacgatgagaaagagaatgtctaaaaaatacagcagctctgtctctgagcaggcggtcaaacagtgagcaccactgattcctcaaccagcaaccgggaaagcgtcaagtcggaagatggggatgacgaagagccgccttaccgaggcccgttctgcgggcgtgccagggtgcacaccgacttcacccccagtccctatgacacagactcactcaagctcaagaaaggagatatcatcgatataatcagcaagccacccatggggacctggatgggcctgctgaacaacaaagtcggcacgttcaagttcatctacgtggacgtgctcagtgaagacgaggagaaacccaaacgccccaccaggaggcgtcggaaaggacgaccaccccagcccaagtctgtggaggatctcctggatcggattaacctaaaagagcacatgcccactttcctgttcaatggatatgaagatttggacacctttaagctgctggaggaggaagacttggatgagttaaatatcagggacccggaacacagagctgttctcttgacagcagtggagctgttacaagagtatgacagtaacagcgaccagtcaggatcccaggagaagctgctcgttgacagccagggcctgagtggatgctcaccccgagactcaggatgctacgaaagcagtgagaacctggaaaacggcaagactcggaaagctagcctcctatctgccaagtcatccaccgagcccagcttgaagtcttttagcagaaaccagttgggcaattacccaacattgcctttaatgaaatcaggggatgcactgaagcagggacaggaggagggcaggctgggtggtggccttgccccagacacgtccaagagctgtgacccacctggtgtgactggtttgaataaaaaccgaagaagcctcccagtttccatctgccggagctgtgagaccctggagggcccccagactgtggacacttggccccgatcccattccctggatgaccttcaagtggagcctggtgctgagcaagacgtgcctaccgaggtgacagaaccgccccctcagattgtacctgaagtgccacagaagacgaccgcctcttccacgaaggcccagcccctggagcaagactctgctgtcgacaatgcattgctactgacccaaagcaagagattttctgaacctcagaaattgacaactaagaaactggagggctcaatcgcagcctctggtcgcggcctgtcaccccctcagtgtttgcccagaaactatgatgctcagcctcctggagctaaacacggtttagcaaggacgcctctggagggccacagaaaaggacacgagtttgaaggaacacaccatcccctgggcaccaaagaaggggtagatgctgagcagagaatgcagcccaaaattccatcacagcctccacctgttcctgccaaaaagagcagagaacgccttgctaacggactccaccctgttcccatgggccccagtggggccctccccagtcccgatgcgccatgcctgccagtgaaaaggggcagccccgccagccccaccagccctagcgactgtcccccagcactggctcccaggcctctctcagggcaggcgcctggcagcccaccaagcacaaggccgcccccctggctctcagagctccccgagaacacaagcctccaggagcacggtgtgaagctgggcccggctttgaccaggaaggtctcctgtgcccggggagtggatctagaaacgctcactgaaaacaagctgcacgctgaaggcatcgatctcacggaggagccgtattctgataagcatggccgctgtgggattcctgaagccctggtgcagagatacgcagaggacttggatcagcccgagcgggacgtcgccgccaacatggaccagatccgggtgaagcagcttcggaagcagcaccgcatggcgattccaagtggtggactcacggaaatctgccgaaagcccgtctctcctgggtgcatttcgtctgtgtcagattggctcatttccatcggtctgcccatgtacgccggcaccctctccaccgcgggcttcagcacactgagccaagtgccttctctgtctcacacttgccttcaggaggccggcatcacagaggagagacacataagaaagctcctatctgcagccagactcttcaaactgccgccaggccctgaggccatgtagccaggcccggaatgggcctctctggacaagagccaccctttcactgtgcatatgatgctgatgcaattcctccatcatctctggacgtgcagaccagatccagaagaaaggcctggcgtgtggccaaacagcgtgaaaccttggcacaggactgaggatcctctcctccagaaaagccccctcgaggaaataaattagtgcggttctctttgacccccaaagacaagacaagcacttatttttattttcagaagacaaaagaaccaagatgccaactggctgcgaatgctctatctccagtctgtctctgtgtactggtagaggctgggaggagtagggggcagcctgttccatttctgatagtgcccttgctcttctgtctgtcatcttgcaggatgcccgagggccagatgggcttagctaggccaaagtaacagactcaagagttattgtacattactgaccacgctcatttgttcaaaagttagaacatctggctgcaccaggaaaaaaaaaaaaaaaaagtcctgttcttctttagataaacaagagacattttcataattgctttctagcaatcagcttttatttgccttaatataagcttttaagcagttatctaactagtgtccacaaccctgtaaccatacttccacatcttcagcttaggcagacatcgaacctctctgggatgtttccagcaaaagtgagcttttctaatcgtctcattgtaacatggcttattttgtagaggtattcatcagccacacacttcatgttggtttttggtttttaagctaactacaaatctagtaaaaagctatctgaaattcacaaatatcatgtgtgtgcgtgcgtgcgtgcgcgtgtgtgtctgtattcatagtgactgcttttggttttaaccagtttagtatcgttactgtgtggatcgtcgcgctgcagtattgacttggaatcctgaccatgtccatcccaaaattcagtcctcagttaacggatcatgtttgcaaaaggtcactgtgaggctgcatatttcagaaagatgtccttaataagggaagtcatgtataagatgttttctaaaagacttttcagtattacaactaatactattattatccttctttttttatttagataattcttttaatttaaacaaaggttcactatggaaggaaatgcagtcagctccagctagtactatttatgtacccagataactaagatattgtttcatggccttgccttagtcagaggcccttttctctgtcctgaacccccaggtatgggtgaaattggaaattactaatctattggaaatcagttcctgacatagtaaagtttgctttcataactgcagcaaaaaaggtcaacttgccaagtcactgctgccatgtgtgtactgtattattttcagaaaaaaatataatagtctgagtccaagttatcttgatttaaaattgatagagaaaagaaactgtcgagcaagttatataacaactaacaacattgcactttctgtatatgaaatcaatatttaaataacttatttttctccattgctgttcttaaaaacattgtaagtagctgtaatataccagtaccaatatgttcttgcaattgcttcagcccaagaaagctgtgtattgttttaaaaattgtaaaaattattgtgatgattcatttagcataaagagaggtggacggaagggttttcctatgtatcaaaacttgtctataattatgtcatctatgtacctagaaaaaagtaaataaatttcttcagttgaatatg

SEQ ID NO: 3770 - DNA, 1869 bp, Homo sapiens
agggatcccaccccttctctgtgttttcactctgaagctctacacaactttacacctgaatgaacgccaaacctctatggatatataaagggaagcttgaggaggaatttcacagttacagtgcagaagcagaagcaaaagaattaaccagctcttcagtcaagcaaatcctctactcaccatgcttcctcctgccattcatttctatctccttccccttgcatgcatcctaatgaaaagctgtttggcttttaaaaatgatgccacagaaatcctttattcacatgtggttaaacctgttccagcacaccccagcagcaacagcacgttgaatcaagccagaaatggaggcaggcatttcagtaacactggactggatcggaacactcgggttcaagtgggttgccgggaactgcgttccaccaaatacatctctgatggccagtgcaccagcatcagccctctgaaggagctggtgtgtgctggcgagtgcttgcccctgccagtgctccctaactggattggaggaggctatggaacaaagtactggagcaggaggagctcccaggagtggcggtgtgtcaatgacaaaacccgtacccagagaatccagctgcagtgccaagatggcagcacacgcacctacaaaatcacagtagtcactgcctgcaagtgcaagaggtacacccggcagcacaacgagtccagtcacaactttgagagcatgtcacctgccaagccagtccagcatcacagagagcggaaaagagccagcaaatccagcaagcacagcatgagttagaactcagactcccataactagacttactagtaaccatctgctttacagatttgattgcttggaagactcaagcctgccactgctgttttctcacttgaaagtatatgctttctgctttgatcaaacccagcaagctgtcttaagtatcaggaccttctttgggaatagtttttccttttcaagtttttcaagatgtaggtatatccatgaatgcaatttgcatttaaattccacgtatcctgtagttttaattcctcattgttcttaaaagactgttgatactataaacatcagtgaatcattatattttaaaacagaaaagggcttctcagataccctccatctactggcccatcccctctcctaaacaaaactccttcaaaacaggttaaaaaaaatatgttgtcatgaatcttcacagtaacatttcagaaaggtgcttttttggtactcttcatgggaacagtttagcagccatgagtgatcttcctttgaaagagaatgaaagaccctgtgacatttcacttcaaaaataagccctgtagctctttacggtcgcatagtatgaaattataccctgcatgctgaccctcgcttggaatggaatgccagaaatgcatggcagcagctaataagtaaagctgattaactatttatttgtcaatgttattatttaatgagctttcacatgtgatttgtttcaaaactttaattttttaatgttttgaaactttttcatggacctaaatattttcctatatgatttgtggttgattagaaatatgaaatacatgttgtagatatgtaaaatgaatattttagtctccttattacatatatgttcatggtgaactttatcaatagtatggatctttttaaatcaataagatgctttgtaaagttgaaataagtaatactttcttgtttaatctgtgcaatcagaaggtgtcttgaccttcaattcaattggtttcttttaacaaaaataaacactgctaaaagttattgttgttgcctctaacatgtataaagggtgcaaaaattgtagaataaatgtataagggtaa

SEQ ID NO: 3771 - DNA, 2411 bp, Homo sapiens
aaaatatagagaagtggtctgatggttaattttatatataaatttgactggactaggggatgcccagaagctggtaaaacattatttatgggtgtgtttctgaggatgtttttggaagagattagcattagtattagtggactgagtaaacaagatcaccctcgccaacaggggtggatattatccaatccactgagggccccaatagaacagaaaaacagaggaatgtgaattcatgcttgcttctggagttaggacatccatcttctgccttcagacatcagcattcctagttctcaggtctctgggcttggactaaactacattactggctctctcctgggctccagattgcagacagcagattgtgggacttctcagcctccgtaatcaatcctgtcttggaacctgcttcttagagggcctggactaacatactctggtagtgcatgaagcatctgtgatcacagcgtgacaagaaaatagcacaaacaaacctatgaggacttgagagaattcaaaagggtcatgtagggatcccaccccttctctgtgttttcactctgaagctctacacaactttacacctgaatgaacgccaaacctctatggatatataaagggaagcttgaggaggaatttcacagttacagtgcagaagcagaagcaaaagaattaaccagctcttcagtcaagcaaatcctctactcaccatgcttcctcctgccattcatttctatctccttccccttgcatgcatcctaatgaaaagctgtttggcttttaaaaatgatgccacagaaatcctttattcacatgtggttaaacctgttccagcacaccccagcagcaacagcacgttgaatcaagccagaaatggaggcaggcatttcagtaacactggactggatcggaacagaacagaaagcttgacgagacaaaattatttctggctatttccaggtgcattcctgaggcagctgcaggaagctcgggttcaagtgggttgccgggaactgcgttccaccaaatacatctctgatggccagtgcaccagcatcagccctctgaaggagctggtgtgtgctggcgagtgcttgcccctgccagtgctccctaactggattggaggaggctatggaacaaagtactggagcaggaggagctcccaggagtggcggtgtgtcaatgacaaaacccgtacccagagaatccagctgcagtgccaagatggcagcacacgcacctacaaaatcacagtagtcactgcctgcaagtgcaagaggtacacccggcagcacaacgagtccagtcacaactttgagagcatgtcacctgccaagccagtccagcatcacagagagcggaaaagagccagcaaatccagcaagcacagcatgagttagaactcagactcccataactagacttactagtaaccatctgctttacagatttgattgcttggaagactcaagcctgccactgctgttttctcacttgaaagtatatgctttctgctttgatcaaacccagcaagctgtcttaagtatcaggaccttctttgggaatagtttttccttttcaagtttttcaagatgtaggtatatccatgaatgcaatttgcatttaaattccacgtatcctgtagttttaattcctcattgttcttaaaagactgttgatactataaacatcagtgaatcattatattttaaaacagaaaagggcttctcagataccctccatctactggcccatcccctctcctaaacaaaactccttcaaaacaggttaaaaaaaatatgttgtcatgaatcttcacagtaacatttcagaaaggtgcttttttggtactcttcatgggaacagtttagcagccatgagtgatcttcctttgaaagagaatgaaagaccctgtgacatttcacttcaaaaataagccctgtagctctttacggtcgcatagtatgaaattataccctgcatgctgaccctcgcttggaatggaatgccagaaatgcatggcagcagctaataagtaaagctgattaactatttatttgtcaatgttattatttaatgagctttcacatgtgatttgtttcaaaactttaattttttaatgttttgaaactttttcatggacctaaatattttcctatatgatttgtggttgattagaaatatgaaatacatgttgtagatatgtaaaatgaatattttagtctccttattacatatatgttcatggtgaactttatcaatagtatggatctttttaaatcaataagatgctttgtaaagttgaaataagtaatactttcttgtttaatctgtgcaatcagaaggtgtcttgaccttcaattcaattggtttcttttaacaaaaataaacactgctaaaagtta

SEQ ID NO: 3772 - DNA, 2916 bp, Homo sapiens
ctgcttggctttgaggaagagtggcagtactgcctcactgcataagggatgggatcagagaacagtgctttaaagagctatacactgagagaaccaccatttaccttaccctctggacttgctgtttatcccgctgtactgcaagatggcaaatttgcttcagtttttgtgtataagagagaaaatgaagacaaggttaataaagctgccaagcatttgaagacacttcgtcacccttgcttgctaagatttttatcttgtactgtggaagcggatggcattcatcttgtcactgagcgagtacagcccctggaagtggctttggaaacattgtcttctgcagaggtctgtgctgggatctatgacatattgctggctcttatcttccttcatgacagaggacacctaacacacaataatgtctgtttatcatctgtgtttgtgagtgaagatggacactggaagctaggaggaatggaaactgtttgtaaagtttctcaggccacaccagagtttctgaggagtattcagtcaataagagacccagcatctatccctcctgaagagatgtctccagaattcacaactctcccagagtgtcatggacatgcccgggatgccttttcatttggaacattggtggaaagtttgctcacaatcttaaatgaacaggtttcagcggatgttctctccagctttcaacagaccttgcactcaactttgctgaatcccattccaaaatgtcggccagcgctctgcaccttactatctcatgacttcttcagaaatgattttctggaagttgtgaatttcttgaaaagtttaacattgaagagtgaagaggagaaaacggaattctttaaatttctgctggacagagtcagctgcttgtcagaggaattgatagcttcaaggttggtgcctcttctgcttaatcagttggtgtttgcagagccagtggctgttaagagttttcttccttatctgcttggccccaaaaaagatcatgcgcagggagaaactccttgcttgctctcaccagccctgttccagtcacgggtgatccccgtgcttctccagttgtttgaagttcatgaagagcatgtgcggatggtgctgctgtctcacatcgaggcctacgtggagcacttcactcaggagcagctgaagaaagtcatcttgccacaggttttgctgggcctgcgtgatactagcgattccattgtggcaattactctgcatagcctagcagtgctggtctctctgcttggaccagaggtggttgtgggaggagaacgaaccaagatcttcaaacgcactgccccaagttttactaaaaatactgacctttctctagaagattctcctatgtgtgtcgtctgcagccatcacagtcagatctcgccaatcttggagaaccccttctctagcatattccctaaatgtttcttttctggcagcacgcccatcaacagcaagaagcacatacagcgagattactacaatactcttttacagacaggcgatccattttctcagcctattaaatttcccataaatggactctcagatgtaaaaaatacttcggaggacagtgaaaacttcccatcaagttctaaaaagtctgaggagtggcctgactggagtgaacctgaggagcctgaaaatcaaactgtcaacatacagatttggcctagagaaccttgtgatgatgtcaagtcccagtgcactaccttggatgtggaagagtcatcttgggatgactgcgagcccagcagcttagatactaaagtaaacccaggaggtggaatcactgctacaaaacctgttacctcaggggagcagaagcctattcctgctttgctttcactcactgaagagtctatgccttggaaatcaagcttaccccaaaagattagccttgtacaaaggggggatgacgcagaccaaatcgagccgccaaaagtgtcatcacaagaaaggccccttaaggttccatcagaacttggtttaggagaggaattcaccattcaagtaaaaaagaagccagtaaaagatcctgagatggattggtttgctgatatgatcccagaaattaagccttctgctgcttttcttatattacctgaactgaggacagaaatggtcccaaaaaaggatgatgtctccccagtgatgcagttttcctcaaaatttgctgcagcagaaattactgagggagaggctgaaggctgggaagaagaaggggagctgaactgggaagataataactggtgacaatagatgtgagttaaactttaggaaaaaggattccctttttttaaaaaaaatcaatacctcaaaagcaggctttgggacaagaaaaccccaaagtggcctgcttttcccatcccaggagctcattatccagtctgtgccaactgaagtaggagactgactgtgagtgctggctaaaagccctgggtggtgaggctcacagtactggtttccaggaggaagagcctttgtgcatttgactgaggccagtttctatgaagagcaagtagctgaggagaggtcgaatttactgctttttccaggacaattctggaagtaaagaaaatgtaattcaagctggttagcttaattttgtgccattctttaacataagagtaagctctattatgaaatacaactttaaaaaattttagctataaattatataaatgattttaaattgctgaggtttccttaggcagcttatttatttgtttacagttagactatctgagtaaatggttctttgtggacctaggcagttcctgactgttccacatgtagtacattgtaccaaagttcttaataagaatattccccacaatcctgttctctaaatgtcaaataaagattattttcactagattcaactttacaaaa

SEQ ID NO: 3773 - DNA, 2921 bp, Homo sapiens
tttccggacccgtctctatggtgtaggagaaacccggcccccagaagattgtgggtgtagtggccacagccttacaggcaggcaggggtggttggtgtcaacaggggggccaacagggtaccagagccaagaccctcggcctcctcccccgccgccttcctgcagatctgcttggctttgaggaagagtggcagtactgcctcactgcataagggatgggatcagagaacagtgctttaaagagctatacactgagagaaccaccatttaccttaccctctggacttgctgtttatcccgctgtactgcaagatggcaaatttgcttcagtttttgtgtataagagagaaaatgaagacaaggttaataaagctgccaagcatttgaagacacttcgtcacccttgcttgctaagatttttatcttgtactgtggaagcggatggcattcatcttgtcactgagcgagtacagcccctggaagtggctttggaaacattgtcttctgcagaggtctgtgctgggatctatgacatattgctggctcttatcttccttcatgacagaggacacctaacacacaataatgtctgtttatcatctgtgtttgtgagtgaagatggacactggaagctaggaggaatggaaactgtttgtaaagtttctcaggccacaccagagtttctgaggagtattcagtcaataagagacccagcatctatccctcctgaagagatgtctccagaattcacaactctcccagagtgtcatggacatgcccgggatgccttttcatttggaacattggtggaaagtttgctcacaatcttaaatgaacaggtttcagcggatgttctctccagctttcaacagaccttgcactcaactttgctgaatcccattccaaaatgtcggccagcgctctgcaccttactatctcatgacttcttcagaaatgattttctggaagttgtgaatttcttgaaaagtttaacattgaagagtgaagaggagaaaacggaattctttaaatttctgctggacagagtcagctgcttgtcagaggaattgatagcttcaaggttggtgcctcttctgcttaatcagttggtgtttgcagagccagtggctgttaagagttttcttccttatctgcttggccccaaaaaagatcatgcgcagggagaaactccttgcttgctctcaccagccctgttccagtcacgggtgatccccgtgcttctccagttgtttgaagttcatgaagagcatgtgcggatggtgctgctgtctcacatcgaggcctacgtggagcacttcactcaggagcagctgaagaaagtcatcttgccacaggttttgctgggcctgcgtgatactagcgattccattgtggcaattactctgcatagcctagcagtgctggtctctctgcttggaccagaggtggttgtgggaggagaacgaaccaagatcttcaaacgcactgccccaagttttactaaaaatactgacctttctctagaaggcgatccattttctcagcctattaaatttcccataaatggactctcagatgtaaaaaatacttcggaggacagtgaaaacttcccatcaagttctaaaaagtctgaggagtggcctgactggagtgaacctgaggagcctgaaaatcaaactgtcaacatacagatttggcctagagaaccttgtgatgatgtcaagtcccagtgcactaccttggatgtggaagagtcatcttgggatgactgcgagcccagcagcttagatactaaagtaaacccaggaggtggaatcactgctacaaaacctgttacctcaggggagcagaagcctattcctgctttgctttcactcactgaagagtctatgccttggaaatcaagcttaccccaaaagattagccttgtacaaaggggggatgacgcagaccaaatcgagccgccaaaagtgtcatcacaagaaaggccccttaaggttccatcagaacttggtttaggagaggaattcaccattcaagtaaaaaagaagccagtaaaagatcctgagatggattggtttgctgatatgatcccagaaattaagccttctgctgcttttcttatattacctgaactgaggacagaaatggtcccaaaaaaggatgatgtctccccagtgatgcagttttcctcaaaatttgctgcagcagaaattactgagggagaggctgaaggctgggaagaagaaggggagctgaactgggaagataataactggtgacaatagatgtgagttaaactttaggaaaaaggattccctttttttaaaaaaaatcaatacctcaaaagcaggctttgggacaagaaaaccccaaagtggcctgcttttcccatcccaggagctcattatccagtctgtgccaactgaagtaggagactgactgtgagtgctggctaaaagccctgggtggtgaggctcacagtactggtttccaggaggaagagcctttgtgcatttgactgaggccagtttctatgaagagcaagtagctgaggagaggtcgaatttactgctttttccaggacaattctggaagtaaagaaaatgtaattcaagctggttagcttaattttgtgccattctttaacataagagtaagctctattatgaaatacaactttaaaaaattttagctataaattatataaatgattttaaattgctgaggtttccttaggcagcttatttatttgtttacagttagactatctgagtaaatggttctttgtggacctaggcagttcctgactgttccacatgtagtacattgtaccaaagttcttaataagaatattccccacaatcctgttctctaaatgtcaaataaagattattttcactagattcaactttacaaaa

SEQ ID NO: 3774 - DNA, 3477 bp, Homo sapiens
atggtgtaggagaaacccggcccccagaagattgtgggtgtagtggccacagccttacaggcaggcaggggtggttggtgtcaacaggggggccaacagggtaccagagccaagaccctcggcctcctcccccgccgccttcctgcagatctgcttggctttgaggaagagtggcagtactgcctcactgcataagggatgggatcagagaacagtgctttaaagagctatacactgagagaaccaccatttaccttaccctctggacttgctgtttatcccgctgtactgcaagatggcaaatttgcttcagtttttgtgtataagagagaaaatgaagacaaggttaataaagctgccaagcatttgaagacacttcgtcacccttgcttgctaagatttttatcttgtactgtggaagcggatggcattcatcttgtcactgagcgagtacagcccctggaagtggctttggaaacattgtcttctgcagaggtctgtgctgggatctatgacatattgctggctcttatcttccttcatgacagaggacacctaacacacaataatgtctgtttatcatctgtgtttgtgagtgaagatggacactggaagctaggaggaatggaaactgtttgtaaagtttctcaggccacaccagagtttctgaggagtattcagtcaataagagacccagcatctatccctcctgaagagatgtctccagaattcacaactctcccagagtgtcatggacatgcccgggatgccttttcatttggaacattggtggaaagtttgctcacaatcttaaatgaacaggtttcagcggatgttctctccagctttcaacagaccttgcactcaactttgctgaatcccattccaaaatgtcggccagcgctctgcaccttactatctcatgacttcttcagaaatgattttctggaagttgtgaatttcttgaaaagtttaacattgaagagtgaagaggagaaaacggaattctttaaatttctgctggacagagtcagctgcttgtcagaggaattgatagcttcaaggttggtgcctcttctgcttaatcagttggtgtttgcagagccagtggctgttaagagttttcttccttatctgcttggccccaaaaaagatcatgcgcagggagaaactccttgcttgctctcaccagccctgttccagtcacgggtgatccccgtgcttctccagttgtttgaagttcatgaagagcatgtgcggatggtgctgctgtctcacatcgaggcctacgtggagcacttcactcaggagcagctgaagaaagtcatcttgccacaggttttgctgggcctgcgtgatactagcgattccattgtggcaattactctgcatagcctagcagtgctggtctctctgcttggaccagaggtggttgtgggaggagaacgaaccaagatcttcaaacgcactgccccaagttttactaaaaatactgacctttctctagaagattctcctatgtgtgtcgtctgcagccatcacagtcagatctcgccaatcttggagaaccccttctctagcatattccctaaatgtttcttttctggcagcacgcccatcaacagcaagaagcacatacagcgagattactacaatactcttttacagacaggcgatccattttctcagcctattaaatttcccataaatggactctcagatgtaaaaaatacttcggaggacagtgaaaacttcccatcaagttctaaaaagtctgaggagtggcctgactggagtgaacctgaggagcctgaaaatcaaactgtcaacatacagatttggcctagagaaccttgtgatgatgtcaagtcccagtgcactaccttggatgtggaagagtcatcttgggatgactgcgagcccagcagcttagatactaaagtaaacccaggaggtggaatcactgctacaaaacctgttacctcaggggagcagaagcctattcctgctttgctttcactcactgaagagtctatgccttggaaatcaagcttaccccaaaagattagccttgtacaaaggggggatgacgcagaccaaatcgagccgccaaaagtgtcatcacaagaaaggccccttaaggttccatcagaacttggtttaggagaggaattcaccattcaagtaaaaaagaagccagtaaaagatcctgagatggattggtttgctgatatgatcccagaaattaagccttctgctgcttttcttatattacctgaactgaggacagaaatggtcccaaaaaaggatgatgtctccccagtgatgcagttttcctcaaaatttgctgcagcagaaattactgagggagaggctgaaggctgggaagaagaaggggagctgaactgggaagataataactggtgacaatagatgtgagttaaactttaggaaaaaggattccctttttttaaaaaaaatcaatacctcaaaagcaggctttgggacaagaaaaccccaaagtggcctgcttttcccatcccaggagctcattatccagtctgtgccaactgaagtaggagactgactgtgagtgctggctaaaagccctgggtggtgaggctcacagtactggtttccaggaggaagagcctttgtgcatttgactgaggccagtttctatgaagagcaagtagctgaggagaggtcgaatttactgctttttccaggacaattctggaagtaaagaaaatgtaattcaagctggttagcttaattttgtgccattctttaacataagagtaagctctattatgaaatacaactttaaaaaattttagctataaattatataaatgattttaaattgctgaggtttccttaggcagcttatttatttgtttacagttagactatctgagtaaatggttctttgtggacctaggcagttcctgactgttccacatgtagtacattgtaccaaagttcttaataagaatattccccacaatcctgttctctaaatgtcaaataaagattattttcactagattcaactttacaaaatttgttttatatctgttagaaaatgtacagacataagtattttcagttgacaaagcatcaaacccagttctgcctagtgataagtttcaccctagagtatgtatgtaacgttttagcttatccatcctttcttggagcgcctccatttccattgaaagccaggctggagcaggacccttttggagtagtgactcagttgcttccaaagcccctgctattgtatgcagcgctgacctgtactcttcttcccaggggaactcctgacgagctctttttgcataaggctggaaaaaaaacataagtaatatcacaatatccattctaaatataaagaaccttccttttggactggagtaaagcttacatgcaaattttattctagtcattggatcacaagggtaggaggatgca

SEQ ID NO: 3775 - DNA, 2077 bp, Homo sapiens
gcacctctactgtttgctacaagtggccagcagccattttggatttgggcggaaatgaaattaaaactgtgctgttaaaagcctaaaaattcaagtcaagacaaacttaagcattcgaccaacacatctagaaagggggcatcttcgtggactaactagaccactggggcagtgagtgaaactcggtatcgtcgcggcgcccacacttaagatggcaccggcctgagactcagctgtgcggcctctctacctcggttcctgatctgcttggctttgaggaagagtggcagtactgcctcactgcataagggatgggatcagagaacagtgctttaaagagctatacactgagagaaccaccatttaccttaccctctggacttgctgtttatcccgctgtactgcaagatggcaaatttgcttcagtttttgtgtataagagagaaaatgaagacaaggttaataaagctgccaagcatttgaagacacttcgtcacccttgcttgctaagatttttatcttgtactgtggaagcggatggcattcatcttgtcactgagcgagtacagcccctggaagtggctttggaaacattgtcttctgcagaggtctgtgctgggatctatgacatattgctggctcttatcttccttcatgacagaggacacctaacacacaataatgtctgtttatcatctgtgtttgtgagtgaagatggacactggaagctaggaggaatggaaactgtttgtaaagtttctcaggccacaccagagtttctgaggagtattcagtcaataagagacccagcatctatccctcctgaagagatgtctccagaattcacaactctcccagagtgtcatggacatgcccgggatgccttttcatttggaacattggtggaaagtttgctcacaatcttaaatgaacaggtttcagcggatgttctctccagctttcaacagaccttgcactcaactttgctgaatcccattccaaaatgtcggccagcgctctgcaccttactatctcatgacttcttcagaaatgattttctggaagttgtgaatttcttgaaaagtttaacattgaagagtgaagaggagaaaacggaattctttaaatttctgctggacagagtcagctgcttgtcagaggaattgatagcttcaaggttggtgcctcttctgcttaatcagttggtgtttgcagagccagtggctgttaagagttttcttccttatctgcttggccccaaaaaagatcatgcgcagggagaaactccttgcttgctctcaccagccctgttccagtcacgggtgatccccgtgcttctccagttgtttgaagttcatgaagagcatgtgcggatggtgctgctgtctcacatcgaggcctacgtggagcacttcactcaggagcagctgaagaaagtcatcttgccacaggttttgctgggcctgcgtgatactagcgattccattgtggcaattactctgcatagcctagcagtgctggtctctctgcttggaccagaggtggttgtgggaggagaacgaaccaagatcttcaaacgcactgccccaagttttactaaaaatactgacctttctctagaaggcgatccattttctcagcctattaaatttcccataaatggactctcagatgtaaaaaatacttcggaggacagtgaaaacttcccatcaagttctaaaaagtctgaggagtggcctgactggagtgaacctgaggagcctgaaaatcaaactgtcaacatacagatttggcctagagaaccttgtgatgatgtcaagtcccagtgcactaccttggatgtggaagagtcatcttgggatgactgcgagcccagcagcttagatactaaagtaaacccaggaggtggaatcactgctacaaaacctgttacctcaggggagcagaagcctattcctgctttgctttcactcactgaagagtctatgccttggaaatcaagcttaccccaaaagattagccttgtacaaaggggggatgacgcagaccaaatcgagccgccaaaagtgtcatcaca

SEQ ID NO: 3776 - DNA, 4488 bp, Homo sapiens
cgagggctcggccgtaggagccccgcgcactccagccctgcagcctccggagtcagtgccgcgcgcccgccgccccgcgccttcctgctcgccgcacctccgggagccggggcgcacccagcccgcagcgccgcctccccgcccgcgccgcctccgaccgcaggccgagggccgccactggccggggggaccgggcagcagcttgcggccgcggagccgggcaacgctggggactgcgccttttgtccccggaggtccctggaagtttgcggcaggacgcgcgcggggaggcggcggaggcagccccgacgtcgcggagaacagggcgcagagccggcatgggcatcgggcgcagcgaggggggccgccgcggggcagccctgggcgtgctgctggcgctgggcgcggcgcttctggccgtgggctcggccagcgagtacgactacgtgagcttccagtcggacatcggcccgtaccagagcgggcgcttctacaccaagccacctcagtgcgtggacatccccgcggacctgcggctgtgccacaacgtgggctacaagaagatggtgctgcccaacctgctggagcacgagaccatggcggaggtgaagcagcaggccagcagctgggtgcccctgctcaacaagaactgccacgccggcacccaggtcttcctctgctcgctcttcgcgcccgtctgcctggaccggcccatctacccgtgtcgctggctctgcgaggccgtgcgcgactcgtgcgagccggtcatgcagttcttcggcttctactggcccgagatgcttaagtgtgacaagttccccgagggggacgtctgcatcgccatgacgccgcccaatgccaccgaagcctccaagccccaaggcacaacggtgtgtcctccctgtgacaacgagttgaaatctgaggccatcattgaacatctctgtgccagcgagtttgcactgaggatgaaaataaaagaagtgaaaaaagaaaatggcgacaagaagattgtccccaagaagaagaagcccctgaagttggggcccatcaagaagaaggacctgaagaagcttgtgctgtacctgaagaatggggctgactgtccctgccaccagctggacaacctcagccaccacttcctcatcatgggccgcaaggtgaagagccagtacttgctgacggccatccacaagtgggacaagaaaaacaaggagttcaaaaacttcatgaagaaaatgaaaaaccatgagtgccccacctttcagtccgtgtttaagtgattctcccgggggcagggtggggagggagcctcgggtggggtgggagcgggggggacagtgccccgggaacccggtgggtcacacacacgcactgcgcctgtcagtagtggacattgtaatccagtcggcttgttcttgcagcattcccgctcccttccctccatagccacgctccaaaccccagggtagccatggccgggtaaagcaagggccatttagattaggaaggtttttaagatccgcaatgtggagcagcagccactgcacaggaggaggtgacaaaccatttccaacagcaacacagccactaaaacacaaaaagggggattgggcggaaagtgagagccagcagcaaaaactacattttgcaacttgttggtgtggatctattggctgatctatgcctttcaactagaaaattctaatgattggcaagtcacgttgttttcaggtccagagtagtttctttctgtctgctttaaatggaaacagactcataccacacttacaattaaggtcaagcccagaaagtgataagtgcagggaggaaaagtgcaagtccattatgtaatagtgacagcaaagggaccaggggagaggcattgccttctctgcccacagtctttccgtgtgattgtctttgaatctgaatcagccagtctcagatgccccaaagtttcggttcctatgagcccggggcatgatctgatccccaagacatgtggaggggcagcctgtgcctgcctttgtgtcagaaaaaggaaaccacagtgagcctgagagagacggcgattttcgggctgagaaggcagtagttttcaaaacacatagttaaaaaagaaacaaatgaaaaaaattttagaacagtccagcaaattgctagtcagggtgaattgtgaaattgggtgaagagcttaggattctaatctcatgttttttccttttcacatttttaaaagaacaatgacaaacacccacttatttttcaaggttttaaaacagtctacattgagcatttgaaaggtgtgctagaacaaggtctcctgatccgtccgaggctgcttcccagaggagcagctctccccaggcatttgccaagggaggcggatttccctggtagtgtagctgtgtggctttccttcctgaagagtccgtggttgccctagaacctaacaccccctagcaaaactcacagagctttccgtttttttctttcctgtaaagaaacatttcctttgaacttgattgcctatggatcaaagaaattcagaacagcctgcctgtccccccgcactttttacatatatttgtttcatttctgcagatggaaagttgacatgggtggggtgtccccatccagcgagagagtttcaaaagcaaaacatctctgcagtttttcccaagtaccctgagatacttcccaaagcccttatgtttaatcagcgatgtatataagccagttcacttagacaactttacccttcttgtccaatgtacaggaagtagttctaaaaaaaatgcatattaatttcttcccccaaagccggattcttaattctctgcaacactttgaggacatttatgattgtccctctgggccaatgcttatacccagtgaggatgctgcagtgaggctgtaaagtggccccctgcggccctagcctgacccggaggaaaggatggtagattctgttaactcttgaagactccagtatgaaaatcagcatgcccgcctagttacctaccggagagttatcctgataaattaacctctcacagttagtgatcctgtccttttaacaccttttttgtggggttctctctgacctttcatcgtaaagtgctggggaccttaagtgatttgcctgtaattttggatgattaaaaaatgtgtatatatattagctaattagaaatattctacttctctgttgtcaaactgaaattcagagcaagttcctgagtgcgtggatctgggtcttagttctggttgattcactcaagagttcagtgctcatacgtatctgctcattttgacaaagtgcctcatgcaaccgggccctctctctgcggcagagtccttagtggaggggtttacctggaacattagtagttaccacagaatacggaagagcaggtgactgtgctgtgcagctctctaaatgggaattctcaggtaggaagcaacagcttcagaaagagctcaaaataaattggaaatgtgaatcgcagctgtgggttttaccaccgtctgtctcagagtcccaggaccttgagtgtcattagttactttattgaaggttttagacccatagcagctttgtctctgtcacatcagcaatttcagaaccaaaagggaggctctctgtaggcacagagctgcactatcacgagcctttgtttttctccacaaagtatctaacaaaaccaatgtgcagactgattggcctggtcattggtctccgagagaggaggtttgcctgtgatttcctaattatcgctagggccaaggtgggatttgtaaagctttacaataatcattctggatagagtcctgggaggtccttggcagaactcagttaaatctttgaagaatatttgtagttatcttagaagatagcatgggaggtgaggattccaaaaacattttatttttaaaatatcctgtgtaacacttggctcttggtacctgtgggttagcatcaagttctccccagggtagaattcaatcagagctccagtttgcatttggatgtgtaaattacagtaatcccatttcccaaacctaaaatctgtttttctcatcagactctgagtaactggttgctgtgtcataacttcatagatgcaggaggctcaggtgatctgtttgaggagagcaccctaggcagcctgcagggaataacatactggccgttctgacctgttgccagcagatacacaggacatggatgaaattcccgtttcctctagtttcttcctgtagtactcctcttttagatcctaagtctcttacaaaagctttgaatactgtgaaaatgttttacattccatttcatttgtgttgtttttttaactgcattttaccagatgttttgatgttatcgcttatgttaatagtaattcccgtacgtgttcattttattttcatgctttttcagccatgtatcaatattcacttgactaaaatcactcaattaatcaa

SEQ ID NO: 3777 - DNA, 1437 bp, Homo sapiens
actccagccctgcagcctccggagtcagtgccgcgcgcccgccgccccgcgccttcctgctcgccgcacctccgggagccggggcgcacccagcccgacgtcgcggagaacagggcgcagagccggcatgggcatcgggcgcagcgaggggggccgccgcggggcagccctgggcgtgctgctggcgctgggcgcggcgcttctggccgtgggctcggccagcgagtacgactacgtgagcttccagtcggacatcggcccgtaccagagcgggcgcttctacaccaagccacctcagtgcgtggacatccccgcggacctgcggctgtgccacaacgtgggctacaagaagatggtgctgcccaacctgctggagcacgagaccatggcggaggtgaagcagcaggccagcagctgggtgcccctgctcaacaagaactgccacgccggcacccaggtcttcctctgctcgctcttcgcgcccgtctgcctggaccggcccatctacccgtgtcgctggctctgcgaggccgtgcgcgactcgtgcgagccggtcatgcagttcttcggcttctactggcccgagatgcttaagtgtgacaagttccccgagggggacgtctgcatcgccatgacgccgcccaatgccaccgaagcctccaagccccaaggcacaacggtgtgtcctccctgtgacaacgagttgaaatctgaggccatcattgaacatctctgtgccagcgagtttgcactgaggatgaaaataaaagaagtgaaaaaagaaaatggcgacaagaagattgtccccaagaagaagaagcccctgaagttggggcccatcaagaagaaggacctgaagaagcttgtgctgtacctgaagaatggggctgactgtccctgccaccagctggacaacctcagccaccacttcctcatcatgggccgcaaggtgaagagccagtacttgctgacggccatccacaagtgggacaagaaaaacaaggagttcaaaaacttcatgaagaaaatgaaaaaccatgagtgccccacctttcagtccgtgtttaagtgattctcccgggggcagggtggggagggagcctcgggaacccggtgggtcacacacacgcactgcgcctgtcagtagtggacattgtaatccagtcggcttgttcttgcagcattcccgctcccttccctccatagccacgctccaaaccccagggtagccatggccgggtaaagcaagggccatttagattaggaaggtttttaagatccgcaatgtggagcagcagccactgcacaggaggaggtgacaaaccatttccaacagcaacacagccactaaaacacaaaaagggggattgggcggaaagtgagagccagcagcaaaaactacattttgcaacttgttggtgtggatctattggctga

SEQ ID NO: 3778 - DNA, 2957 bp, Homo sapiens
gggggagcccgcgccgcggctgcagctgccaagggagcgttccgagcccacgtcaggggaggtgtcgggataaatagggtcccgcaatggccgtggctggctgcgctccgagctgcggagtccgggactggagctgcccgggcgggttcgcgccccgaaggctgagagctggcgctgctcgtgccctgtgtgccagacggcggagctccgcggccggaccccgcggccccgctttgctgccgactggagtttgggggaagaaactctcctgcgccccagaggatttcttcctcggcgaagggacagcgaaagatgagggtggcaggaagagaagggcgctttctgtctgccggggtcgcagcgcgagagggcagtgccatgttcctctccatcctagtggcgctgtgcctgtggctgcacctggcgctgggcgtgcgcggcgcgccctgcgaggcggtgcgcatccctatgtgccggcacatgccctggaacatcacgcggatgcccaaccacctgcaccacagcacgcaggagaacgccatcctggccatcgagcagtacgaggagctggtggacgtgaactgcagcgccgtgctgcgcttcttcctctgtgccatgtacgcgcccatttgcaccctggagttcctgcacgaccctatcaagccgtgcaagtcggtgtgccaacgcgcgcgcgacgactgcgagcccctcatgaagatgtacaaccacagctggcccgaaagcctggcctgcgacgagctgcctgtctatgaccgtggcgtgtgcatctcgcctgaagccatcgtcacggacctcccggaggatgttaagtggatagacatcacaccagacatgatggtacaggaaaggcctcttgatgttgactgtaaacgcctaagccccgatcggtgcaagtgtaaaaaggtgaagccaactttggcaacgtatctcagcaaaaactacagctatgttattcatgccaaaataaaagctgtgcagaggagtggctgcaatgaggtcacaacggtggtggatgtaaaagagatcttcaagtcctcatcacccatccctcgaactcaagtcccgctcattacaaattcttcttgccagtgtccacacatcctgccccatcaagatgttctcatcatgtgttacgagtggcgctcaaggatgatgcttcttgaaaattgcttagttgaaaaatggagagatcagcttagtaaaagatccatacagtgggaagagaggctgcaggaacagcggagaacagttcaggacaagaagaaaacagccgggcgcaccagtcgtagtaatccccccaaaccaaagggaaagcctcctgctcccaaaccagccagtcccaagaagaacattaaaactaggagtgcccagaagagaacaaacccgaaaagagtgtgagctaactagtttccaaagcggagacttccgacttccttacaggatgaggctgggcattgcctgggacagcctatgtaaggccatgtgccccttgccctaacaactcactgcagtgctcttcatagacacatcttgcagcatttttcttaaggctatgcttcagtttttctttgtaagccatcacaagccatagtggtaggtttgccctttggtacagaaggtgagttaaagctggtggaaaaggcttattgcattgcattcagagtaacctgtgtgcatactctagaagagtagggaaaataatgcttgttacaattcgacctaatatgtgcattgtaaaataaatgccatatttcaaacaaaacacgtaatttttttacagtatgttttattaccttttgatatctgttgttgcaatgttagtgatgttttaaaatgtgatcgaaaatataatgcttctaagaaggaacagtagtggaatgaatgtctaaaagatctttatgtgtttatggtctgcagaaggatttttgtgatgaaaggggattttttgaaaaatctagagaagtagcatatggaaaactataatgtgtcttttttacaatgacttcagctctgtttttagctagaaactctaaaaacaaaaataataataaagaaaaataaataaaaaggagaggcagacaatgtctggattcctgttttttggttacctgatttcatgatcatgatgcttcttgtcaacaccctcttaagcagcaccagaaacagtgagtttgtctgtaccattaggagttaggtactaattagttggctaatgctcaagtattttatacccacaagagaggtatgtcactcatcttacttcccaggacatccaccctgagaataatttgacaagcttaaaaatggccttcatgtgagtgccaaattttgttttcttcatttaaatattttctttgcctaaatacatgtgagaggagttaaatataaatgtacagagaggaaagttgaggttccacctctgaaatgagaattacttgacagttgggatactttaatcagaaaaaaagaacttatcttgcagcattttatcaacaaatttcataattgtggacaattggaggcatttattttaaaaaacaattttattggccttttgctaacacagtaagcatgtattctctataaggcattcaataaatgcacaacgcccaaaggaaataaaatcctatctaatcctactctccactacacagaggtaatcactattagtattttggcatattattctccaggtgtttcttatgcacttataaaatgatttgaacaaataaaactaggaacctgctatacatgtgtttcataacctgcctcctttgcttggccctttattgagataagttttcctgtcaagaaagcagaaaccatctcatttctaacagctgtgttatattccatagtatgcattactcaacaaactgttgtgctattggatacttaggtggtttcttcactgacaatactgaataaacatctca

SEQ ID NO: 3779 - DNA, 1532 bp, Homo sapiens
tggctgcgctccgagctgcggagtccgggactggagctgcccgggcgggttcgcgccccgaaggctgagagctggcgctgctcgtgccctgtgtgccagacggcggagctccgcggccggaccccgcggccccgctttgctgccgactggagtttgggggaagaaactctcctgcgccccagaggatttcttcctcggcgaagggacagcgaaagatgagggtggcaggaagagaagggcgctttctgtctgccggggtcgcagcgcgagagggcagtgccatgttcctctccatcctagtggcgctgtgcctgtggctgcacctggcgctgggcgtgcgcggcgcgccctgcgaggcggtgcgcatccctatgtgccggcacatgccctggaacatcacgcggatgcccaaccacctgcaccacagcacgcaggagaacgccatgtacgcgcccatttgcaccctggagttcctgcacgaccctatcaagccgtgcaagtcggtgtgccaacgcgcgcgcgacgactgcgagcccctcatgaagatgtacaaccacagctggcccgaaagcctggcctgcgacgagctgcctgtctatgaccgtggcgtgtgcatctcgcctgaagccatcgtcacggacctcccggaggatgttaagtggatagacatcacaccagacatgatggtacaggaaaggcctcttgatgttgactgtaaacgcctaagccccgatcggtgcaagtgtaaaaaggtgaagccaactttggcaacgtatctcagcaaaaactacagctatgttattcatgccaaaataaaagctgtgcagaggagtggctgcaatgaggtcacaacggtggtggatgtaaaagagatcttcaagtcctcatcacccatccctcgaactcaagtcccgctcattacaaattcttcttgccagtgtccacacatcctgccccatcaagatgttctcatcatgtgttacgagtggcgctcaaggatgatgcttcttgaaaattgcttagttgaaaaatggagagatcagcttagtaaaagatccatacagtgggaagagaggctgcaggaacagcggagaacagttcaggacaagaagaaaacagccgggcgcaccagtcgtagtaatccccccaaaccaaagggaaagcctcctgctcccaaaccagccagtcccaagaagaacattaaaactaggagtgcccagaagagaacaaacccgaaaagagtgtgagctaactagtttccaaagcggagacttccgacttccttacaggatgaggctgggcattgcctgggacagcctatgtaaggccatgtgccccttgccctaacaactcactgcagtgctcttcatagacacatcttgcagcatttttcttaaggctatgcttcagtttttctttgtaagccatcacaagccatagtggtaggtttgccctttggtacagaaggtgagttaaagctggtggaaaaggcttattgcattgcattcagagtaacctgtgtgcatactcta

SEQ ID NO: 3780 - DNA, 1836 bp, Homo sapiens
gcggcggcggcggcggcggctgggtagagtcagggccgggggcgcacgccggaacacctgggccgccgggcaccgagcgtcggggggctgcgcggcgcgcacctggagagggcgcagccatgcgggcggcggcggcgggggggggcgtgcggacggccgcgctggcgctgctgctgggggcgctgcactgggcgccggcgcgctgcgaggagtacgactactatggctggcaggccgagccgctgcacggccgctcctactccaagccgccgcagtgccttgacatccctgccgacctgccgctctgccacacggtgggctacaagcgcatgcggctgcccaacctgctggagcacgagagcctggccgaagtgaagcagcaggcgagcagctggctgccgctgctggccaagcgctgccactcggatacgcaggtcttcctgtgctcgctctttgcgcccgtctgtctcgaccggcccatctacccgtgccgctcgctgtgcgaggccgtgcgcgccggctgcgcgccgctcatggaggcctacggcttcccctggcctgagatgctgcactgccacaagttccccctggacaacgacctctgcatcgccgtgcagttcgggcacctgcccgccaccgcgcctccagtgaccaagatctgcgcccagtgtgagatggagcacagtgctgacggcctcatggagcagatgtgctccagtgactttgtggtcaaaatgcgcatcaaggagatcaagatagagaatggggaccggaagctgattggagcccagaaaaagaagaagctgctcaagccgggccccctgaagcgcaaggacaccaagcggctggtgctgcacatgaagaatggcgcgggctgcccctgcccacagctggacagcctggcgggcagcttcctggtcatgggccgcaaagtggatggacagctgctgctcatggccgtctaccgctgggacaagaagaataaggagatgaagtttgcagtcaaattcatgttctcctacccctgctccctctactaccctttcttctacggggcggcagagccccactgaagggcactcctccttgccctgccagctgtgccttgcttgccctctggccccgccccaacttccaggctgacccggccctactggagggtgttttcacgaatgttgttactggcacaaggcctaagggatgggcacggagcccaggctgtcctttttgacccaggggtcctggggtccctgggatgttgggcttcctctctcaggagcagggcttcttcatctgggtgaagacctcagggtctcagaaagtaggcaggggaggagagggtaagggaaaggtggaggggctcagggcaccctgaggcggaggtttcagagtagaaggtggtgtcagctccagctcccctctgtcggtggtggggcctcaccttgaagagggaagtctcaatattaggctaagctatttgggaaagttctccccaccgcccctgtacgcgtcatcctagccccccttaggaaaggagttagggtctcagtgcctccagccacaccccctgccttccccagcttgcccatttccctgccccaaggcccagagctccccccagactggagagcaagcccagcccagcctcggcatagacccccttctggtccgcccgcggctcgattcccgggattcattcctcagcctctgcttctcccttttatcccaataagttattgctactgctgtgaggccataggtactagacaaccaatacatgcagggttgggttttctaatttttttaactttttaattaaatcaaagaaaacaataa

SEQ ID NO: 3781 - DNA, 1565 bp, Homo sapiens
ggatgtctgcagcagcatttaaattctgggagggcttggttgtcagcagcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatgtaataagaatttggtggtgtcaattgcttatttgttttcccacggttgtccagcaattaataaaacataaccttttttactgcct

SEQ ID NO: 3782 - DNA, 1558 bp, Homo sapiens
ctccctgtgttggtggaggatgtctgcagcagcatttaaattctgggagggcttggttgtcagcagcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagaatgctgtgtcctctgaagaaaccaatgactttaaacaagagacccttccaagtaagtccaacgaaagccatgaccacatggatgatatggatgatgaagatgatgatgaccatcagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatgtaataagaatttggtggtgtcaattgcttatttgttttcccacggttgtccagcaattaataaaacataaccttttttactgcct

SEQ ID NO: 3783 - DNA, 1196 bp, Homo sapiens
agcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagaatgctgtgtcctctgaagaaaccaatgactttaaacaagagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaaga

SEQ ID NO: 3784 - DNA, 1473 bp, Homo sapiens
aattctgggagggcttggttgtcagcagcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagaatgctgtgtcctctgaagaaaccaatgactttaaacaagagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgt

SEQ ID NO: 3785 - DNA, 1501 bp, Homo sapiens
ctccctgtgttggtggaggatgtctgcagcagcatttaaattctgggagggcttggttgtcagcagcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatgtaataagaatttggtggtgtcaattgcttatttgttttcccacggttgtccagcaattaataaaacataaccttttttactgcct

SEQ ID NO: 3786 - DNA, 3701 bp, Homo sapiens
taggcagcagccccggaacagatgaggcaggcagggttgggacgtttggtcaggacagcccaccgcaaaaagaggaggaaagaaatgaaagacagagacagctttggctatgggagaaggaggaggccgggggaaggaggagacaggaggaggagggaccacggggtggaggggagatagacccagcccagagctctgagtggtttcctgttgcctgtctctaaacccctccacattcccgcggtccttcagactgcccggagagcgcgctctgcctgccgcctgcctgcctgccactgagggttcccagcaccatgagggcctggatcttctttctcctttgcctggccgggagggccttggcagcccctcagcaagaagccctgcctgatgagacagaggtggtggaagaaactgtggcagaggtgactgaggtatctgtgggagctaatcctgtccaggtggaagtaggagaatttgatgatggtgcagaggaaaccgaagaggaggtggtggcggaaaatccctgccagaaccaccactgcaaacacggcaaggtgtgcgagctggatgagaacaacacccccatgtgcgtgtgccaggaccccaccagctgcccagcccccattggcgagtttgagaaggtgtgcagcaatgacaacaagaccttcgactcttcctgccacttctttgccacaaagtgcaccctggagggcaccaagaagggccacaagctccacctggactacatcgggccttgcaaatacatccccccttgcctggactctgagctgaccgaattccccctgcgcatgcgggactggctcaagaacgtcctggtcaccctgtatgagagggatgaggacaacaaccttctgactgagaagcagaagctgcgggtgaagaagatccatgagaatgagaagcgcctggaggcaggagaccaccccgtggagctgctggcccgggacttcgagaagaactataacatgtacatcttccctgtacactggcagttcggccagctggaccagcaccccattgacgggtacctctcccacaccgagctggctccactgcgtgctcccctcatccccatggagcattgcaccacccgctttttcgagacctgtgacctggacaatgacaagtacatcgccctggatgagtgggccggctgcttcggcatcaagcagaaggatatcgacaaggatcttgtgatctaaatccactccttccacagtaccggattctctctttaaccctccccttcgtgtttcccccaatgtttaaaatgtttggatggtttgttgttctgcctggagacaaggtgctaacatagatttaagtgaatacattaacggtgctaaaaatgaaaattctaacccaagacatgacattcttagctgtaacttaactattaaggccttttccacacgcattaatagtcccatttttctcttgccatttgtagctttgcccattgtcttattggcacatgggtggacacggatctgctgggctctgccttaaacacacattgcagcttcaacttttctctttagtgttctgtttgaaactaatacttaccgagtcagactttgtgttcatttcatttcagggtcttggctgcctgtgggcttccccaggtggcctggaggtgggcaaagggaagtaacagacacacgatgttgtcaaggatggttttgggactagaggctcagtggtgggagagatccctgcagaacccaccaaccagaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgacttagaaactgccttcctgggtgatttgcatgtgtcttagtcttagtcaccttattatcctgacacaaaaacacatgagcatacatgtctacacatgactacacaaatgcaaacctttgcaaacacattatgcttttgcacacacacacctgtacacacacaccggcatgtttatacacagggagtgtatggttcctgtaagcactaagttagctgttttcatttaatgacctgtggtttaacccttttgatcactaccaccattatcagcaccagactgagcagctatatccttttattaatcatggtcattcattcattcattcattcacaaaatatttatgatgtatttactctgcaccaggtcccatgccaagcactggggacacagttatggcaaagtagacaaagcatttgttcatttggagcttagagtccaggaggaatacattagataatgacacaatcaaatataaattgcaagatgtcacaggtgtgatgaagggagagtaggagagaccatgagtatgtgtaacaggaggacacagcattattctagtgctgtactgttccgtacggcagccactacccacatgtaactttttaagatttaaatttaaattagttaacattcaaaacgcagctccccaatcacactagcaacatttcaagtgcttgagagccatgcatgattagtggttaccctattgaataggtcagaagtagaatcttttcatcatcacagaaagttctattggacagtgctcttctagatcatcataagactacagagcacttttcaaagctcatgcatgttcatcatgttagtgtcgtattttgagctggggttttgagactccccttagagatagagaaacagacccaagaaatgtgctcaattgcaatgggccacatacctagatctccagatgtcatttcccctctcttattttaagttatgttaagattactaaaacaataaaagctcctaaaaaatcaaactgtattctggtgttctcttctacacagtgggagggcgagcagtaggagagattggcccatttggtgctggccatttgaggaatgcaagcccagcactagtctcataatctctaggaatctgtagagagaggaattgaagtaaatttcagcattggctcattcagtcattcggcgacattcatcaggtacctgcaatgtgttaggggatcttatgagtaggcagcgtgcgtgatccttgctcccctggagctttctaacattctagcaggcagaccacacataaatttgcaatactgtttctgataaaaacgtgctgtaaaggaaataaagcagagaactatcatggaaaa

SEQ ID NO: 3787 - DNA, 497 bp, Homo sapiens
gtttcctgttgcctgtctctaaacccctccacattcccgcggtccttcagactgcccggagagcgcgctctgcctgccgcctgcctgcctgccactgaggccttggtcttctcatctgtactattgggcagaaatatgtgacttgagcccccagtggggtgctggattatgaaaacaccctgaaaatgataaatgtatgcatcatcacagactaaagaaatacaaaggagggagtttttgtttaatattggtcatttatatgaagggaatttaaattttcgccaggcacgctacacctaggtttgattggcaaaggatcacagctggttcccagcaccatgagggcctggatcttctttctcctttgcctggccgggagggccttggcagcccctcagcaagaagccctgcctgatgagacagaggtggtggaagaaactgtggcagaggtgactgaggtatctgtgggagctaatcctgtccaggtggaagtagga

SEQ ID NO: 3788 - DNA, 511 bp, Homo sapiens
agctatcagctgccacatcgacatagcctagagcaaagagggggagggaggagaagaagggggttgcctggagaaggaatcaacttttgaaactttctccaagtcccacccaccagaaggctcttctctgcctgactcactctccgaggaatgcgagttgccacgggttcccagcaccatgagggcctggatcttctttctcctttgcctggccgggagggccttggcagcccctcagcaagaagccctgcctgatgagacagaggtggtggaagaaactgtggcagaggtgactgaggtatctgtgggagctaatcctgtccaggtggaagtaggagaatttgatgatggtgcagaggaaaccgaagaggaggtggtggcggaaaatccctgccagaaccaccactgcaaacacggcaaggtgtgcgagctggatgagaacaacacccccatgtgcgtgtgccaggaccccaccagctgcccagcccccattggcgagtttgagaaggtg

SEQ ID NO: 3789 - DNA, 441 bp, Homo sapiens
actagcccaccagactcagagacggaaccagagacgggccagagcatccccctcctccaccatgaaactcgctgtcaccctcaccctggtcacactggctctctgctgcagctccgcttctgcagagatctgcccgagctttcagcgtgtcatcgaaaccctcctcatggacacaccctccagttatgaggctgccatggaacttttcagccctgatcaagacatgagggaggcaggggctcagctgaagaagctggtggacaccctcccccaaaagcccagagaaagcatcattaagctcatggaaaaaatagcccaaagctcactgtgtaattagcatttagaagctgaagatccccaactgctccagcctctgccgctgccatgctttgagtccacgcccaccagccttgctctcttcaataaaccacaagcatctca

SEQ ID NO: 3790 - DNA, 1638 bp, Homo sapiens
cggcggtgctgcgaggtcggcgcgcagctccgccgcgggtcgctcgggcgctgtccaggcggagccggccccgcccgggctgcagccatgatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggct

SEQ ID NO: 3791 - DNA, 1736 bp, Homo sapiens
gaaaggagcaagccaggaagccagacaacaacagcatcaaaacaaggctgtttctgtgtgtgaggaactttgcctgggagataaaattagacctagagctttctgacagggagtctgaagcgtgggacatggaccgttcactgggatggcaagggaattctgtccctgaggacaggactgaagctgggatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggct

SEQ ID NO: 3792 - DNA, 1551 bp, Homo sapiens
atgatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggct

SEQ ID NO: 3793 - DNA, 1584 bp, Homo sapiens
atgcctggcttctactctgttatgacagatgaggagatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggct

SEQ ID NO: 3794 - DNA, 1906 bp, Homo sapiens
cggcggtgctgcgaggtcggcgcgcagctccgccgcgggtcgctcgggcgctgtccaggcggagccggccccgcccgggctgcagccatgatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggtatggtccaagcctgaggctcctggcaccaccgggtgctgtcaagggaacaggccaagagcaccaggggcagggctgccactagcaggtggtcacaggttcctgttccccaggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaagtatgaccagaagccaggacaaagctggcagggggagatcccaagcctagccttgggtgagaccaagccctacttttgttcttctataggccctgggctcaatctaagcgggtgctggggtcctcctcgccttatcaacccttttctccctttagcaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggct

SEQ ID NO: 3795 - DNA, 1650 bp, Homo sapiens
tacagctctccagccctgttcagcagcagagctgctccccagaagccaagaaaagaaggctcccaagcagctgggctgctggtcttctctgactctctggagatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggct

SEQ ID NO: 3796 - DNA, 1709 bp, Homo sapiens
gacaatgagagttgggggaaacagttcctcttctgagctgaggatggggtagaacaggcttctacagaggagtcagtccattctctgccttccactccctgtgggtcatggttcaggccaggccctctcgtgcactgccggctctgggcagaggggatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggcttctgg

SEQ ID NO: 3797 - DNA, 2516 bp, Homo sapiens
agcctcgtctgagggggcgggggacggaggagggagcgggagtcgagcgagagcctgtggaggagtccgcctgctgtagcgtgcgtaagcaaggcagctacgccgggcggctacgctgcggaatcggcgtaggcgcctttggagaatcggcgggctgcgctccgctggggctggtcgcggagggggggaggggatgtcggtcagtgcgagatccgctgctgctgaggagaggagcgtcaacagcagcaccatgggtcaacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaattaaaatatacgaatttccagaaacagatgatgaagaagaaaataaacttgttaaaaagataaaggaccgtttacctcttgctgtggtaggtagtaatactatcattgaagttaatggcaaaagggtcagaggaaggcagtatccttggggtgttgctgaagttgaaaatggtgaacattgtgattttacaatcctaagaaatatgttgataagaacacacatgcaggacttgaaagatgttactaataatgtccactatgagaactacagaagcagaaaacttgcagctgtgacttataatggagttgataacaacaagaataaagggcagctgactaagagccctctggcacaaatggaagaagaaagaagggagcatgtagctaaaatgaagaagatggagatggagatggagcaggtgtttgagatgaaggtcaaagaaaaagttcaaaaactgaaggactctgaagctgagctccagcggcgccatgagcaaatgaaaaagaatttggaagcacagcacaaagaattggaggaaaaacgtcgtcagttcgaggatgagaaagcaaactgggaagctcaacaacgtattttagaacaacagaactcttcaagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattatttttttttttgttcttgatggagattaagatgccttgaattgtctagggtgttctgtacttagaaagtaagagctctaagtacctttcctacattttctttttttattaaacagatatcttcagtttaatgcaagagaacattttactgttgtacaatcatgttctggtggtttgattgtttacaggatattccaaaataaaaggactctggaagattttcattgaggataaattgccataatatgatgcaaactgtgcttctctatgataattacaatacaaaggttccattcagtgcagcatatacaataatgtaatttagtctaacacagttgaccctattttttgacacttccattgtttaaaaatacacatggaaaaaaaaaaaaccctatatgcttactgtgcacctagagcttttttataacaacgtctttttgtttgtttgttttggattctttaaatatatattattctcatttagtgccctctttagccagaatctcattactgcttcatttttgtaataacatttaatttagatattttccatatattggcactgctaaaatagaatatagcatctttcatatggtaggaaccaacaaggaaactttcctttaactccctttttacactttatggtaagtagcagggggggaaatgcatttatagatcatttctaggcaaaattgtgaagctaatgaccaacctgtttctacctatatgcagtctctttattttactagaaatgggaatcatggcctcttgaagagaaaaaagtcaccattctgcatttagctgtattcatatattgcatttctgtattttttgtttgtattgtaaaaaattcacataataaacgatgttgtgatgt

SEQ ID NO: 3798 - DNA, 2522 bp, Homo sapiens
agcctcgtctgagggggcgggggacggaggagggagcgggagtcgagcgagagcctgtggaggagtccgcctgctgtagcgtgcgtaagcaaggcagctacgccgggcggctacgctgcggaatcggcgtaggcgcctttggagaatcggcgggctgcgctccgctggggctggtcgcggagggggggaggggatgtcggtcagtgcgagatccgctgctgctgaggagaggagcgtcaacagcagcaccatggaggttgcccaacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaattaaaatatacgaatttccagaaacagatgatgaagaagaaaataaacttgttaaaaagataaaggaccgtttacctcttgctgtggtaggtagtaatactatcattgaagttaatggcaaaagggtcagaggaaggcagtatccttggggtgttgctgaagttgaaaatggtgaacattgtgattttacaatcctaagaaatatgttgataagaacacacatgcaggacttgaaagatgttactaataatgtccactatgagaactacagaagcagaaaacttgcagctgtgacttataatggagttgataacaacaagaataaagggcagctgactaagagccctctggcacaaatggaagaagaaagaagggagcatgtagctaaaatgaagaagatggagatggagatggagcaggtgtttgagatgaaggtcaaagaaaaagttcaaaaactgaaggactctgaagctgagctccagcggcgccatgagcaaatgaaaaagaatttggaagcacagcacaaagaattggaggaaaaacgtcgtcagttcgaggatgagaaagcaaactgggaagctcaacaacgtattttagaacaacagaactcttcaagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattatttttttttttgttcttgatggagattaagatgccttgaattgtctagggtgttctgtacttagaaagtaagagctctaagtacctttcctacattttctttttttattaaacagatatcttcagtttaatgcaagagaacattttactgttgtacaatcatgttctggtggtttgattgtttacaggatattccaaaataaaaggactctggaagattttcattgaggataaattgccataatatgatgcaaactgtgcttctctatgataattacaatacaaaggttccattcagtgcagcatatacaataatgtaatttagtctaacacagttgaccctattttttgacacttccattgtttaaaaatacacatggaaaaaaaaaaaaccctatatgcttactgtgcacctagagcttttttataacaacgtctttttgtttgtttgttttggattctttaaatatatattattctcatttagtgccctctttagccagaatctcattactgcttcatttttgtaataacatttaatttagatattttccatatattggcactgctaaaatagaatatagcatctttcatatggtaggaaccaacaaggaaactttcctttaactccctttttacactttatggtaagtagcagggggggaaatgcatttatagatcatttctaggcaaaattgtgaagctaatgaccaacctgtttctacctatatgcagtctctttattttactagaaatgggaatcatggcctcttgaagagaaaaaagtcaccattctgcatttagctgtattcatatattgcatttctgtattttttgtttgtattgtaaaaaattcacataataaacgatgttgtgatgt

SEQ ID NO: 3799 - DNA, 2323 bp, Homo sapiens
atgtcggtcagtgcgagatccgctgctgctgaggagaggagcgtcaacagcagcaccatggtacaacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaattaaaatatacgaatttccagaaacagatgatgaagaagaaaataaacttgttaaaaagataaaggaccgtttacctcttgctgtggtaggtagtaatactatcattgaagttaatggcaaaagggtcagaggaaggcagtatccttggggtgttgctgaagttgaaaatggtgaacattgtgattttacaatcctaagaaatatgttgataagaacacacatgcaggacttgaaagatgttactaataatgtccactatgagaactacagaagcagaaaacttgcagctgtgacttataatggagttgataacaacaagaataaagggcagctgactaagagccctctggcacaaatggaagaagaaagaagggagcatgtagctaaaatgaagaagatggagatggagatggagcaggtgtttgagatgaaggtcaaagaaaaagttcaaaaactgaaggactctgaagctgagctccagcggcgccatgagcaaatgaaaaagaatttggaagcacagcacaaagaattggaggaaaaacgtcgtcagttcgaggatgagaaagcaaactgggaagctcaacaacgtattttagaacaacagaactcttcaagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattatttttttttttgttcttgatggagattaagatgccttgaattgtctagggtgttctgtacttagaaagtaagagctctaagtacctttcctacattttctttttttattaaacagatatcttcagtttaatgcaagagaacattttactgttgtacaatcatgttctggtggtttgattgtttacaggatattccaaaataaaaggactctggaagattttcattgaggataaattgccataatatgatgcaaactgtgcttctctatgataattacaatacaaaggttccattcagtgcagcatatacaataatgtaatttagtctaacacagttgaccctattttttgacacttccattgtttaaaaatacacatggaaaaaaaaaaaaccctatatgcttactgtgcacctagagcttttttataacaacgtctttttgtttgtttgttttggattctttaaatatatattattctcatttagtgccctctttagccagaatctcattactgcttcatttttgtaataacatttaatttagatattttccatatattggcactgctaaaatagaatatagcatctttcatatggtaggaaccaacaaggaaactttcctttaactccctttttacactttatggtaagtagcagggggggaaatgcatttatagatcatttctaggcaaaattgtgaagctaatgaccaacctgtttctacctatatgcagtctctttattttactagaaatgggaatcatggcctcttgaagagaaaaaagtcaccattctgcatttagctgtattcatatattgcatttctgtattttttgtttgtattgtaaaaaattcacataataaacgatgttgtgatgt

SEQ ID NO: 3800 - DNA, 1362 bp, Homo sapiens
ggaatgccaacagtttaaaaaacagataatgaaagaaatccaagaacataaaattaaaatatacgaatttccagaaacagatgatgaagaagatggagatggagatggagcaggtgtttgagatgaaggtcaaagaaaaagttcaaaaactgaaggactctgaagctgagctccagcggcgccatgagcaaatgaaaaagaatttggaagcacagcacaaagaattggaggaaaaacgtcgtcagttcgaggatgagaaagcaaactgggaagctcaacaacgtattttagaacaacagaactcttcaagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattatttttttttttgttcttgatggagattaagatgccttgaattgtctagggtgttctgtacttagaaagtaagagctctaagtacctttcctacattttctttttttattaaacagatatcttcagtttaatgcaagagaacattttactgttgtacaatcatgttctggtggtttgattgtttacaggatattccaaaataaaaggactctggaagattttcattgaggataaattgccataatatgatgcaaactgtgcttctctatgataattacaatacaaaggttccattcagtgcagcatatacaataatgtaatttagtctaacacagttgaccctattttttgacacttccattgtttaaaaatacacatggaaaaaaaaaaaaccctatatgcttactgtgcacctagagcttttttataacaacgtctttttgtttgtttgttttggattctttaaatatatattattctcatttagtgccctctttagccagaatctcattactgcttcatttttgtaataacatttaatttagatattttccatatattggcactgctaaaatagaatatagcatctttcatatggtaggaaccaacaaggaaactttcctttaactccctttttacactttatggtaagtagcagggggggaaatgcatttatagatcatttctaggcaaaattgtgaagctaatgaccaacctgtttctacctatatgcagtctctttattttactagaaatgggaatcatggcctcttgaagagaaaaaagtcaccattctgcatttagctgtattcatatattgcatttctgtattttttgtttgtattgtaaaaaattcacataataaacgatgttgtgatgt

SEQ ID NO: 3801 - DNA, 2601 bp, Homo sapiens
aagtcatgctcgaaatggagcgaggcggcggagctggggaggcggtaatctcgcgagatggaagccagcctccgctaggcccggaagcctcgtctgagggggcgggggacggaggagggagcgggagtcgagcgagagcctgtggaggagtccgcctgctgtagcgtgcgtaagcaaggcagctacgccgggcggctacgctgcggaatcggcgtaggcgcctttggagaatcggcgggctgcgctccgctggggctggtcgcggagggggggaggggatgtcggtcagtgcgagatccgctgctgctgaggagaggagcgtcaacagcagcaccatggcaacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaattaaaatatacgaatttccagaaacagatgatgaagaagaaaataaacttgttaaaaagataaaggaccgtttacctcttgctgtggtaggtagtaatactatcattgaagttaatggcaaaagggtcagaggaaggcagtatccttggggtgttgctgaagttgaaaatggtgaacattgtgattttacaatcctaagaaatatgttgataagaacacacatgcaggacttgaaagatgttactaataatgtccactatgagaactacagaagcagaaaacttgcagctgtgacttataatggagttgataacaacaagaataaagggcagctgactaagagccctctggcacaaatggaagaagaaagaagggagcatgtagctaaaatgaagaagatggagatggagatggagcaggtgtttgagatgaaggtcaaagaaaaagttcaaaaactgaaggactctgaagctgagctccagcggcgccatgagcaaatgaaaaagaatttggaagcacagcacaaagaattggaggaaaaacgtcgtcagttcgaggatgagaaagcaaactgggaagctcaacaacgtattttagaacaacagaactcttcaagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattatttttttttttgttcttgatggagattaagatgccttgaattgtctagggtgttctgtacttagaaagtaagagctctaagtacctttcctacattttctttttttattaaacagatatcttcagtttaatgcaagagaacattttactgttgtacaatcatgttctggtggtttgattgtttacaggatattccaaaataaaaggactctggaagattttcattgaggataaattgccataatatgatgcaaactgtgcttctctatgataattacaatacaaaggttccattcagtgcagcatatacaataatgtaatttagtctaacacagttgaccctattttttgacacttccattgtttaaaaatacacatggaaaaaaaaaaaaccctatatgcttactgtgcacctagagcttttttataacaacgtctttttgtttgtttgttttggattctttaaatatatattattctcatttagtgccctctttagccagaatctcattactgcttcatttttgtaataacatttaatttagatattttccatatattggcactgctaaaatagaatatagcatctttcatatggtaggaaccaacaaggaaactttcctttaactccctttttacactttatggtaagtagcagggggggaaatgcatttatagatcatttctaggcaaaattgtgaagctaatgaccaacctgtttctacctatatgcagtctctttattttactagaaatgggaatcatggcctcttgaagagaaaaaagtcaccattctgcatttagctgtattcatatattgcatttctgtattttttgtttgtattgtaaaaaattcacataataaacgatgttgtgatgtaa

SEQ ID NO: 3802 - DNA, 898 bp, Homo sapiens
agcctcgtctgagggggcgggggacggaggagggagcgggagtcgagcgagagcctgtggaggagtccgcctgctgtagcgtgcgtaagcaaggcagctacgccgggcggctacgctgcggaatcggcgtaggcgcctttggagaatcggcgggctgcgctccgctggggctggtcgcggagggggggaggggatgtcggtcagtgcgagatccgctgctgctgaggagaggagcgtcaacagcagcaccatggggcaacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaattaaaatatacgaatttccagaaacagcaaaaaaaaaaaaaaaaaaaaaa

SEQ ID NO: 3803 - DNA, 1464 bp, Homo sapiens
agtgcgagatccgctgctgctgaggagaggagcgtcaacagcagcaccatggttcctctgtggatttcttctgttggaatctggaacactggaatgatggaaatgtgttctttacaaagtagctcaacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaattaaaatatacgaatttccagaaacagatgatgaagaagaaaataaacttgttaaaaagataaaggaccgtttacctcttgctgtggtaggtagtaatactatcattgaagttaatggcaaaagggtcagaggaaggcagtatccttggggtgttgctgaagttgaaaatggtgaacattgtgattttacaatcctaagaaatatgttgataagaacacacatgcaggacttgaaagatgttactaataatgtccactatgagaactacagaagcagaaaacttgcagctgtgacttataatggagttgataacaacaagaataaagggcagctgactaagagccctctggcacaaatggaagaagaaagaagggagcatgtagctaaaatgaagaagatggagatggagatggagcaggtgtttgagatgaaggtcaaagaaaaagttcaaaaactgaaggactctgaagctgagctccagcggcgccatgagcaaatgaaaaagaatttggaagcacagcacaaagaattggaggaaaaacgtcgtcagttcgaggatgagaaagcaaactgggaagctcaacaacgtattttagaacaacagaactcttcaagaaccttggaaaagaacaagaagaaagggaagatcttttaaactctctattgaccaccagttaacgtattagttgccaatatgccagcttggacatcagtgtttgttggatccgtttgaccaatttgcaccag

SEQ ID NO: 3804 - DNA, 6976 bp, Homo sapiens
gttactcacgaaactattgttgagcaacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaattaaaatatacgaatttccagaaacagatgatgaagaagaaaataaacttgttaaaaagataaaggaccgtttacctcttgctgtggtaggtagtaatactatcattgaagttaatggcaaaagggtcagaggaaggcagtatccttggggtgttgctgaagttgaaaatggtgaacattgtgattttacaatcctaagaaatatgttgataagaacacacatgcaggacttgaaagatgttactaataatgtccactatgagaactacagaagcagaaaacttgcagctgtgacttataatggagttgataacaacaagaataaagggcagctgactaagagccctctggcacaaatggaagaagaaagaagggagcatgtagctaaaatgaagaagatggagatggagatggagcaggtgtttgagatgaaggtcaaagaaaaagttcaaaaactgaaggactctgaagctgaggtaatcagtctaatatcccatctcttagcagacattgtgttcctttttaagtagtatcttcagtaaaatttatagataatataacctttttatacatattttttcaaaattaataccctagtgtaacaaaacggataaatttctagaagcaagcaccgtgtttataataaaataatacatacttcaatatgcaagtgcttggacgtagtatattaggtaggacagtgtaatagaatacttataatgaattattagttataatgaacaagtttgagttgtgaaaaataaaattacaaaccattccatacaggtggcataagaacactaaagatgagagtttgggggtggatttatgcacacaaactgtgttaggataataataattgaccatatttatttgtgtatgagtgaaaaagagggaaataacctttattgaactaaagacatgcctggataaattccacacaattaaagaagagaaaattagggaatgtgatatttttgttaacaggttaggccttctttatttataatgtagtgtcaaggtagttcctggtgttacaacattgggcagggtaatgacaaaacatcccagaagacatacctactatcttgaaacccttctagatgttgagttatacatttagtttctattaatcaaaaagaccttggagacatttccttcaataggtggcaagaaagaaaagttggagaaaaagataaactgaacattaaaaatccatagagcagttagtttgatagatgtctgagaatagtagaaaaaaaactatgggtaatcccaaaataacagtggtttcagtatgaagttttcttcacataaatttgttataattaaaaattataaaatagcctgggcatggtggctcatgcctgtaacgccagcactttgggaggctgaggcacacagatcacttgagttcagaagttcgagactagcctggccaacatggtgaaacctcatctctattaaaaatacaaaaattagctggatgtggtggtgagtgcctgtaatcccagctacttgggaggctgaggctggagaatcgcttgaacctgggaggcggaggttgcactgaactgagatcacgtcactgcactcccgcctgggcgacagatcaagactttgcctcaaaaaacaaacagacaaacaaaaagccctataaaataataaattattttaaaatatgtgagatgaggtccaggtgtggtggctcacatctgtaatcccagcagtttgggaggccaaagaagaaggattgcttgagtccaggagtttgagaccagcctgggcaacatggcaagacccaatccctataaaaaatttttaaaaatagttgggcatgatggcctgcacctatggtcccaactactcaggaggctgagacaggaagattacttgagcctgggagatagaggctgtagtgagccatgattgtgccactgcatcccagcctgggtgacagagctagaccttgtctcaaaattatatacatatatatatatggatgacagtaatataaaatagttttaaaacaatctttaatgataaaatttagtaagatccctgttttatgtggcttcactaatatttgtatctaagtgtatgaagaagagattcagatctctcgttatattcttacagttgatctcattgcttttgtaattaccgcataaaatatggaaaccttttttgactaaaggcataacaaaagtatgctaatccattgagtaaatagaatgcacggaatgagaaagtattaaataatttcgaggaaatgtttttattccacatcatttctcttacattattgggcttttcttgtaatttcttattaaaatctttcactgttgttatatttgttgtgagtttaatttagcaggggtatggaataattcctcctggtttcagacgctgagcactacaggattagcatccctggcactgccactaaatgctaatagcagtgccctcctatcatagggcaaaccaaaatgtgcatacacacacacccctaatcaaaagtcactgtcttagctattgctgttgtattataaatgaataattaaagttcttaacatgacattttggagattaatttatcagcatgttgtaaatatatgcattgagtctctacctcttcagtaattcacatataatctggaaaatctatatccaaaagggggaaaaaaacaggaataatcaagagtctactacattatctccacacttagattccattgagaatctaaaagtagtttaacttatatttgaggcagatgtattttaggacatgttgctaaaagtaaatattacgaacaagtaattgtgaacctgtagccaaggaaccctttgggaattttaatgattactgtgaatggtgaagacagttttgaagaactattctttgaaggatggaatgttaacatttcaaggacctgtgaagagctctgggccaaggttcccaccagatactctaagccattagagaattaggcatgctcattctagattctttgtcttttatgaaaccacatctagagtgtatttaccaacatccctgtgataatgagtttgcaaatcatcatgtatatgatacatgatatatattgtgtaaatatacgtgtgaatacataaataggtaaagaaacccttttagccttgtttaatacagtctctccttaaatccattatgctggaaatacttgtttggggcacagctagcagcacagtacatcagccacagcaccaagcaactttcatttattgtgttgtctagtgcacaccacagccctacaaggtagatattattgcccatctctcctttatagataagaaggataaattaacttagtatgccagcatttgaacccagttaatttttaagttaagctagataggtccacagtcctgtttttcacaatttcagaatggaaaaaactctgaaaactgcaaaacctaacatgaactaagttttaatcctacatattgtgaatatttatatattttactgaaacaaataaaaagtaatgtgtttgattatacttgttgccccagatagcccaggaggtattttataaatatagtgtatactcctttctaagcggtgttgtcgttttaataactgaaaaatgttgaacttcaaaaggcatctgaccccatgggtttcttaagagtgagattgtgacctgtacctttatctacatgcagttaacacaaaagataattacttatatgtaacaagttaaagaatgatgaacactgtaagcctactacctggcttaaaaaaatagaatgttatcaactcatttgaagatgctgtgtgcctgtcccctattgtatccctctctctcattcccagaggtaactactattccgaattgtgtatatgtgactcttttcatttaaaaaaaataactagagacattttcttatgttcctactttctgacatttcttagtaacttgtttgctgtcatcaggaagatatcacctcagatttgattcatgtttgcttaagtgtgtcttaggtgattttgttttgtaggaattgcatgaaataattgaaataggaataaatctgaagtcacttcgggcttgcaaaaaaaaattgtatgcaaaattatagtaacatatataatatgtatataatatataatacatataatagttatatattaacattatgttaatgttaactcaccagtgtagtaaaatctgtaacagaacataattcctggataactgaaggttttgaatagtccttgggtatttggcatagaaggatttaatctgatttttaaaatttgttgacttttttttttttcagaaatggattgacttgcacctaaatgaaattacttatctaatgatctcttggacttaaagcactttgtttctgcagttacttcgcatgagtgtttactgcctctcagtcagcattctttacagtattaatacacagagaaggaaggaccagctgcattagaatcactgtaacttgttgaaaatccacatttccagacttaacacccagatattctaattcagtacgtctgagtgaggtccaggattctatatttttaacaaacatcccaggtgatttgcatgaagaccaatgtctgagaaccactgcttacaggaatcagagtactttgctggcatctttgagctcttagggtcctaaactacctgctttcttttcacttgtcttagctttctaaacttggaattaggaggcttattcaagtcctggttcttccactttctggctagcaatcttgggcaagtcacttaaattctgcaactgtttcctcatctgtacaatgagaacagtgatgtgttcactgcccagcctccaacatatttgtgattaaagaaaaacgagataagatagtaattttccattataaagtactccacactgttaagtttgttgctttttttttttttcctgtttcccaagattattgtcttgggtcactggccttttgggtggcaggtcctaaaggaggaggagtccttgaccagagtacttccaggtagtactctgaatttacaacagggctattcaaatagtgctcatactccttatcattagggtgtctggatgaaacatacctctgcttctgatttcttaaatagttttgttttatatattgtgctatgatttagctccagcggcgccatgagcaaatgaaaaagaatttggaagcacagcacaaagaattggaggaaaaacgtcgtcagttcgaggatgagaaagcaaactgggaagctcaacaacgtattttagaacaacagaactcttcaagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattatttttttttttgttcttgatggagattaagatgccttgaattgtctagggtgttctgtacttagaaagtaagagctctaagtacctttcctacattttctttttttattaaacagatatcttcagtttaatgcaagagaacattttactgttgtacaatcatgttctggtggtttgattgtttacaggatattccaaaataaaaggactctggaagattttcattgaggataaattgccataatatgatgcaaactgtgcttctctatgataattacaatacaaaggttccattcagtgcagcatatacaataatgtaatttagtctaacacagttgaccctattttttgacacttccattgtttaaaaatacacatggaaaaaaaaaaaaccctatatgcttactgtgcacctagagcttttttataacaacgtctttttgtttgtttgttttggattctttaaatatatattattctcatttagtgccctctttagccagaatctcattactgcttcatttttgtaataacatttaatttagatattttccatatattggcactgctaaaatagaatatagcatctttcatatggtaggaaccaacaaggaaactttcctttaactccctttttacactttatggtaagtagcagggggggaaatgcatttatagatcatttctaggcaaaattgtgaagctaatgaccaacctgtttctacctatatgcagtctctttattttactagaaatgggaatcatggcctcttgaagagaaaaaagtcaccattctgcatttagctgtattcatatattgcatttctgtattttttgtttgtattgtaaaaaattcacataataaacgatgttgtgatgt

SEQ ID NO: 3805 - DNA, 1404 bp, Homo sapiens
agtgcgagatccgctgctgctgaggagaggagcgtcaacagcagcaccatgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaattaaaatatacgaatttccagaaacagatgatgaagaagaaaataaacttgttaaaaagataaaggaccgtttacctcttgctgtggtaggtagtaatactatcattgaagttaatggcaaaagggtcagaggaaggcagtatccttggggtgttgctgaagttgaaaatggtgaacattgtgattttacaatcctaagaaatatgttgataagaacacacatgcaggacttgaaagatgttactaataatgtccactatgagaactacagaagcagaaaacttgcagctgtgacttataatggagttgataacaacaagaataaagggcagctgactaagagccctctggcacaaatggaagaagaaagaagggagcatgtagctaaaatgaagaagatggagatggagatggagcaggtgtttgagatgaaggtcaaagaaaaagttcaaaaactgaaggactctgaagctgagctccagcggcgccatgagcaaatgaaaaagaatttggaagcacagcacaaagaattggaggaaaaacgtcgtcagttcgaggatgagaaagcaaactgggaagctcaacaacgtattttagaacaacagaactcttcaagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattatttttttttttgttcttgatggagattaagatgccttgaattgtctagggtgttctgtacttagaaagtaagag

SEQ ID NO: 3806 - DNA, 3276 bp, Homo sapiens
gcgtgtcgggcgcggaagggggaggcggcccggggcgcccgcgagtgaggcgcggggcggcgaagggagcgcgggtggcggcacttgctgccgcggccttggatgggctgggcccccctcgccgctccgcctcctccacacgcgcggcggccgcggcgagggggacgcgccgcccggggcccggcaccttcgggaaccccccggcccggagcctgcggcctgcgccgcctcggccgccgggagccccgtggagcccccgccgccgcgccgccccgcggaccggacgctgagggcactcggggcggggcgcgcgctcgggcagacgtttgcggggaggggggcgcctgccgggccccggcgaccaccttgggggtcgcgggccggctcggggggcgcccagtgcgggccctcgcgggcgccgggcagcgaccagccctgagcggagctgttggccgcggcgggaggcctcccggacgcccccagccccccgaacgctcgcccgggccggcgggagtcggcgccccccgggaggtccgctcggtcgtccgcggcggagcgtttgctcctgggacaggcggtgggaccggggcgtcgccggagacgcccccagcgaagttgggctctccaggtgtgggggtcccggggggtagcgacgtcgcggacccggcctgtgggatgggcggcccggagaagactgcgctcggccgtgttcatacttgtccgtgggcctgaggtccccggaggatgacctagcactgaaaagccccggccggcctccccagggtccccgaggacgaagttgaccctgaccgggccgtctcccagttctgaggcccgggtcccactggaactcgcgtctgagccgccgtcccggacccccggtgcccgccggtccgcagaccctgcaccgggcttggactcgcagccgggactgacgtgtagaacaatcgtttctgttggaagaagggtttttcccttccttttggggtttttgttgccttttttttttcttttttctttgtaaaattttggagaagggaagtcggaacacaaggaaggaccgctcacccgcggactcagggctggcggcgggactccaggaccctgggtccagcatggaggtggtggacccgcagcagctgggcatgttcacggagggcgagctgatgtcggtgggtatggacacgttcatccaccgcatcgactccaccgaggtcatctaccagccgcgccgcaagcgggccaagctcatcggcaagtacctgatgggggacctgctgggggaaggctcttacggcaaggtgaaggaggtgctggactcggagacgctgtgcaggagggccgtcaagatcctcaagaagaagaagttgcgaaggatccccaacggggaggccaacgtgaagaaggaaattcaactactgaggaggttacggcacaaaaatgtcatccagctggtggatgtgttatacaacgaagagaagcagaaaatgtatatggtgatggagtactgcgtgtgtggcatgcaggaaatgctggacagcgtgccggagaagcgtttcccagtgtgccaggcccacgggtacttctgtcagctgattgacggcctggagtacctgcatagccagggcattgtgcacaaggacatcaagccggggaacctgctgctcaccaccggtggcaccctcaaaatctccgacctgggcgtggccgaggcactgcacccgttcgcggcggacgacacctgccggaccagccagggctccccggctttccagccgcccgagattgccaacggcctggacaccttctccggcttcaaggtggacatctggtcggctggggtcaccctctacaacatcaccacgggtctgtaccccttcgaaggggacaacatctacaagttgtttgagaacatcgggaaggggagctacgccatcccgggcgactgtggccccccgctctctgacctgctgaaagggatgcttgagtacgaaccggccaagaggttctccatccggcagatccggcagcacagctggttccggaagaaacatcctccggctgaagcaccagtgcccatcccaccgagcccagacaccaaggaccggtggcgcagcatgactgtggtgccgtacttggaggacctgcacggcgcggacgaggacgaggacctcttcgacatcgaggatgacatcatctacactcaggacttcacggtgcccggacaggtcccagaagaggaggccagtcacaatggacagcgccggggcctccccaaggccgtgtgtatgaacggcacagaggcggcgcagctgagcaccaaatccagggcggagggccgggcccccaaccctgcccgcaaggcctgctccgccagcagcaagatccgccggctgtcggcctgcaagcagcagtgaggctggccgcctgcagcccgtgtccaggagccccgccaggtgcccgcgccaggccctcagtcttcctgccggttccgcccgccctcccggagaggtggccgccatgcttctgtgccgaccacgccccaggacctccggagcgccctgcagggccgggcagggggacagcagggaccgggcgcagccctcccccctcggccgcccggcagtgcacgcggcttgttgacttcgcagccccgggcggagccttcccgggcgggcgtgggaggagggaggcggcctccatgcactttatgtggagactactggccccgcccgtggcctcgtgctccgcagggcgcccagcgccgtccggcggccccgccgcagaccagctggcgggtgtggagaccaggctcctgaccccgccatgcatgcagcgccacctggaagccgcgcggccgctttggttttttgtttggttggttccattttctttttttctttttttttttaagaaaaaataaaaggtggatttgagctgtggctgtgaggggtgtttgggagctgctgggtggcaggggggctgtggggtcgggctcacgtcgcggccgcctttgcgctctcgggtcaccctgctttggcggcccggccggagggcaggaccctcacctctcccccaaggccactgcgctcttgggaccccagagaaaacccggagcaagcaggagtgtgcggtcaatatttatatcatccagaaaagaaaaacacgagaaacgccatcgcgggatggtgcagacgcggcggggactcggagggtgccgtgcgggcgaggccgcccaaatttggcaataaataaagcttgggaagcttggacctg

SEQ ID NO: 3807 - DNA, 2777 bp, Homo sapiens
cgggcgcggaagggggaggcggcccggggcgcccgcgagtgaggcgcggggcggcgaagggagcgcgggtggcggcacttgctgccgcggccttggatgggctgggcccccctcgccgctccgcctcctccacacgcgcggcggccgcggcgagggggacgcgccgcccggggcccggcaccttcgggaaccccccggcccggagcctgcggcctgcgccgcctcggccgccgggagccccgtggagcccccgccgccgcgccgccccgcggaccggacgctgagcggagctgttggccgcggcgggaggcctcccggacgcccccagccccccgaacgctcgcccgggccggcgggagtcggcgccccccgggaggtccgctcggtcgtccgcggcggagcgtttgctcctgggacaggcggtgggaccggggcgtcgccggagacgcccccagcgaagttgggctctccaggtgtgggggtcccggggggtagcgacgtcgcggacccggcctgtgggatgggcggcccggagaagactgcgctcggccgtgttcatacttgtccgtgggcctgaggtccccggaggatgacctagcactgaaaagccccggccggcctccccagggtccccgaggacgaagttgaccctgaccgggccgtctcccagttctgaggcccgggtcccactggaactcgcgtctgagccgccgtcccggacccccggtgcccgccggtccgcagaccctgcaccgggcttggactcgcagccgggactgacgtgtagaacaatcgtttctgttggaagaagggtttttcccttccttttggggtttttgttgccttttttttttcttttttctttgtaaaattttggagaagggaagtcggaacacaaggaaggaccgctcacccgcggactcagggctggcggcgggactccaggaccctgggtccagcatggaggtggtggacccgcagcagctgggcatgttcacggagggcgagctgatgtcggtgggtatggacacgttcatccaccgcatcgactccaccgaggtcatctaccagccgcgccgcaagcgggccaagctcatcggcaagtacctgatgggggacctgctgggggaaggctcttacggcaaggtgaaggaggtgctggactcggagacgctgtgcaggagggccgtcaagatcctcaagaagaagaagttgcgaaggatccccaacggggaggccaacgtgaagaaggaaattcaactactgaggaggttacggcacaaaaatgtcatccagctggtggatgtgttatacaacgaagagaagcagaaaatgtatatggtgatggagtactgcgtgtgtggcatgcaggaaatgctggacagcgtgccggagaagcgtttcccagtgtgccaggcccacgggtacttctgtcagctgattgacggcctggagtacctgcatagccagggcattgtgcacaaggacatcaagccggggaacctgctgctcaccaccggtggcaccctcaaaatctccgacctgggcgtggccgaggcactgcacccgttcgcggcggacgacacctgccggaccagccagggctccccggctttccagccgcccgagattgccaacggcctggacaccttctccggcttcaaggtggacatctggtcggctggggtcaccctctacaacatcaccacgggtctgtaccccttcgaaggggacaacatctacaagttgtttgagaacatcgggaaggggagctacgccatcccgggcgactgtggccccccgctctctgacctgctgaaagggatgcttgagtacgaaccggccaagaggttctccatccggcagatccggcagcacagctggttccggaagaaacatcctccggctgaagcaccagtgcccatcccaccgagcccagacaccaaggaccggtggcgcagcatgactgtggtgccgtacttggaggacctgcacggcgcggacgaggacgaggacctcttcgacatcgaggatgacatcatctacactcaggacttcacggtgcccggacaggtcccagaagaggaggccagtcacaatggacagcgccggggcctccccaaggccgtgtgtatgaacggcacagaggcggcgcagctgagcaccaaatccagggcggaggccgggcccccaaccctgcccgcaaggcctgctgccagcagcaagatccgccggctgtcggcctgcaagcagcagtgaggctggccgcctgcagcccgtgtccaggagccccgccaggtgcccgcgccaggccctcagtcttcctgccggttccgcccgccctcccggagaggtggccgccatgcttctgtgccgaccacgccccaggacctccggagcgccctgcagggccgggcagggggacagcagggaccgggcgcagccctcccccctcggccgcccggcagtgcacgcggcttgttgacttcgcagccccgggcggagccttcccgggcgggcgtgggaggagggaggcggcctccatgcactttatgtggagactactggccccgcccgtggcctcgtgctccgcagggcgcccagcgccgtccggcggccccgccgcagaccagctggcgggtgtggagaccaggctcctgaccccgccatgcatgcagcgccacctggaagccgcgcggccgctttggttttttgtttggttggttccattttctttttttctttttttttttaagaaaaaataaaaggtggatttg

SEQ ID NO: 3808 - DNA, 1913 bp, Homo sapiens
gaactgtaacaactctcagaggagcattgcccgtcagacagcaactcagagaataaccagagaacaaccagattgaaacaatggaggatctttgtgtggcaaacacactctttgccctcaatttattcaagcatctggcaaaagcaagccccacccagaacctcttcctctccccatggagcatctcgtccaccatggccatggtctacatgggctccaggggcagcaccgaagaccagatggccaaggtgcttcagtttaatgaagtgggagccaatgcagttacccccatgactccagagaactttaccagctgtgggttcatgcagcagatccagaagggtagttatcctgatgcgattttgcaggcacaagctgcagataaaatccattcatccttccgctctctcagctctgcaatcaatgcatccacagggaattatttactggaaagtgtcaataagctgtttggtgagaagtctgcgagcttccgggaagaatatattcgactctgtcagaaatattactcctcagaaccccaggcagtagacttcctagaatgtgcagaagaagctagaaaaaagattaattcctgggtcaagactcaaaccaaaggcaaaatcccaaacttgttacctgaaggttctgtagatggggataccaggatggtcctggtgaatgctgtctacttcaaaggaaagtggaaaactccatttgagaagaaactaaatgggctttatcctttccgtgtaaactcggctcagcgcacacctgtacagatgatgtacttgcgtgaaaagctaaacattggatacatagaagacctaaaggctcagattctagaactcccatatgctggagatgttagcatgttcttgttgcttccagatgaaattgccgatgtgtccactggcttggagctgctggaaagtgaaataacctatgacaaactcaacaagtggaccagcaaagacaaaatggctgaagatgaagttgaggtatacataccccagttcaaattagaagagcattatgaactcagatccattctgagaagcatgggcatggaggacgccttcaacaagggacgggccaatttctcagggatgtcggagaggaatgacctgtttctttctgaagtgttccaccaagccatggtggatgtgaatgaggagggcactgaagcagccgctggcacaggaggtgttatgacagggagaactggacatggaggcccacagtttgtggcagatcatccttttctttttcttattatgcataagataaccaactgcattttatttttcggcagattttcctcaccctaaaactaagcgtgctgcttctgcaaaagatttttgtagatgagctgtgtgcctcagaattgctatttcaaattgccaaaaatttagagatgttttctacatatttctgctcttctgaacaacttctgctacccactaaataaaaacacagaaataattagacaattgtctattataacatgacaaccctattaatcatttggtcttctaaaatgggatcatgcccatttagattttccttactatcagtttatttttataacattaacttttactttgttatttattattttatataatggtgagtttttaaattattgctcactgcctatttaatgtagctaataaagttatagaagcagatgatctgttaatttcctatctaataaatgcctttaattgttctcataatgaagaataagtaggtatccctccatgcccttctgtaataaatatctggaaaaaacattaaacaataggcaaatatatgttatgtgcatttctagaaatacataacacatatatatgtctgtatcttatattcaattgcaagtatataataaataaacctgcttccaaacaacaata

SEQ ID NO: 3809 - DNA, 717 bp, Homo sapiens
gttgtgcccgctttcctactcagtgcaattgttccaggtttgcaggtcccaggttccaagactttgcggtcttcttttgttcacttggaaccgatatcttttggaggtgcatttcttgcactacaacttgcttaagctcttacacttcatagtgaagctatgcaccaccgagtgaagcgatgtggaacattggaaagagtgggcttccttagacagacctgggcttgaatccctgctccactacctaccagctgtgtgaccttatacaagttacttaatgtttctgagcatcaggatataatctataaaatagggagaatcacctctacctcatacagattctgcaaagattaaacgaggagaggagattgaaacaatggaggatctttgtgtggcaaacacactctttgccctcaatttattcaagcatctggcaaaagcaagccccacccagaacctcttcctctccccatggagcatctcgtccaccatggccatggtctacatgggctccaggggcagcaccgaagaccagatggccaaggtgcttcagtttaatgaagtgggagccaatgcagttacccccatgactccagagaactttaccagctgtgggttcatgcagcagatccagaagggtagttatcctgatgcgattttgcaggcacaagctgcagataaaatccattcatccttccgctctctcagctctgcaat

SEQ ID NO: 3810 - DNA, 762 bp, Homo sapiens
gagaacaaccagcatttcttgcactacaacttgcttaagctcttacacttcatagtgaagctatgcaccaccgagtgaagcgatgtggaacattggaaagagtgggcttccttagacagacctgggcttgaatccctgctccactacctaccagctgtgtgaccttatacaagttacttaatgtttctgagcatcaggatataatctataaaatagggagaatcacctctacctcatacagattctgcaaagattaaacgaggagaggagattgaaacaatggaggatctttgtgtggcaaacacactctttgccctcaatttattcaagcatctggcaaaagcaagccccacccagaacctcttcctctccccatggagcatctcgtccaccatggccatggtctacatgggctccaggggcagcaccgaagaccagatggccaaggtgcttcagtttaatgaagtgggagccaatgcagttacccccatgactccagagaactttaccagctgtgggttcatgcagcagatccagaagggtagttatcctgatgcgattttgcaggcacaagctgcagataaaatccattcatccttccgctctctcagctctgcaatcaatgcatccacagggaattatttactggaaagtgtcaataagctgtttggtgagaagtctgcgagcttccgggaagaatatattcgactctgtcagaaatattactcctcagaaccccaggcagtagacttcctagaatgt

SEQ ID NO: 3811 - DNA, 751 bp, Homo sapiens
ttgcctgcagagcctgaggtcagggaaggtctcagatggttcataccttggtgtatacatgagtttcataggcctgggattaaggattatccctgcaatcttgcctggcattgactttctacctggtggggtggcagaagaagggggtcttctagtcctcccagtaatgaacaccccagtataggaagtcttttttagtaaggctgtggtatgtgtggtgcatatagggaaggggttctgggataggggctgggtgaaactccaaaccttcaaacaatgagtcaaagtcactttagaagcaggaaagcagaaagaagattgaccgtcttaccagatgcaacaagattgaaacaatggaggatctttgtgtggcaaacacactctttgccctcaatttattcaagcatctggcaaaagcaagccccacccagaacctcttcctctccccatggagcatctcgtccaccatggccatggtctacatgggctccaggggcagcaccgaagaccagatggccaaggtgcttcagtttaatgaagtgggagccaatgcagttacccccatgactccagagaactttaccagctgtgggttcatgcagcagatccagaagggtagttatcctgatgcgattttgcaggcacaagctgcagataaaatccattcatccttccgctctctcagctctgcaatcaatgcatccacagggaattatttactggaaagtgtcaataagctgtttggtgagaa

SEQ ID NO: 3812 - DNA, 2155 bp, Homo sapiens
gtaacaactctcagaggagcattgcccgtcagacagcaactcagagaataaccagagaacaaccagcatttcttgcactacaacttgcttaagctcttacacttcatagtgaagctatgcaccaccgagtgaagcgatgtggaacattggaaagagtgggcttccttagacagacctgggcttgaatccctgctccactacctaccagctgtgtgaccttatacaagttacttaatgtttctgagcatcaggatataatctataaaatagggagaatcacctctacctcatacagattctgcaaagattaaacgaggagaggagattgaaacaatggaggatctttgtgtggcaaacacactctttgccctcaatttattcaagcatctggcaaaagcaagccccacccagaacctcttcctctccccatggagcatctcgtccaccatggccatggtctacatgggctccaggggcagcaccgaagaccagatggccaaggtgcttcagtttaatgaagtgggagccaatgcagttacccccatgactccagagaactttaccagctgtgggttcatgcagcagatccagaagggtagttatcctgatgcgattttgcaggcacaagctgcagataaaatccattcatccttccgctctctcagctctgcaatcaatgcatccacagggaattatttactggaaagtgtcaataagctgtttggtgagaagtctgcgagcttccgggaagaatatattcgactctgtcagaaatattactcctcagaaccccaggcagtagacttcctagaatgtgcagaagaagctagaaaaaagattaattcctgggtcaagactcaaaccaaaggcaaaatcccaaacttgttacctgaaggttctgtagatggggataccaggatggtcctggtgaatgctgtctacttcaaaggaaagtggaaaactccatttgagaagaaactaaatgggctttatcctttccgtgtaaactcggctcagcgcacacctgtacagatgatgtacttgcgtgaaaagctaaacattggatacatagaagacctaaaggctcagattctagaactcccatatgctggagatgttagcatgttcttgttgcttccagatgaaattgccgatgtgtccactggcttggagctgctggaaagtgaaataacctatgacaaactcaacaagtggaccagcaaagacaaaatggctgaagatgaagttgaggtatacataccccagttcaaattagaagagcattatgaactcagatccattctgagaagcatgggcatggaggacgccttcaacaagggacgggccaatttctcagggatgtcggagaggaatgacctgtttctttctgaagtgttccaccaagccatggtggatgtgaatgaggagggcactgaagcagccgctggcacaggaggtgttatgacagggagaactggacatggaggcccacagtttgtggcagatcatccttttctttttcttattatgcataagataaccaactgcattttatttttcggcagattttcctcaccctaaaactaagcgtgctgcttctgcaaaagatttttgtagatgagctgtgtgcctcagaattgctatttcaaattgccaaaaatttagagatgttttctacatatttctgctcttctgaacaacttctgctacccactaaataaaaacacagaaataattagacaattgtctattataacatgacaaccctattaatcatttggtcttctaaaatgggatcatgcccatttagattttccttactatcagtttatttttataacattaacttttactttgttatttattattttatataatggtgagtttttaaattattgctcactgcctatttaatgtagctaataaagttatagaagcagatgatctgttaatttcctatctaataaatgcctttaattgttctcataatgaagaataagtaggtatccctccatgcccttctgtaataaatatctggaaaaaacattaaacaataggcaaatatatgttatgtgcatttctagaaatacataacacatatatatgtctgtatcttatattcaattgcaagtatataataaataaacctgcttcc

SEQ ID NO: 3813 - DNA, 3190 bp, Homo sapiens
ggcccacagaggagcacagctgtgtttggctgcagggccaagagcgctgtcaagaagacccacacgcccccctccagcagctgaattcctgcagctcagcagccgccgccagagcaggacgaaccgccaatcgcaaggcacctctgagaacttcaggatgcagatgtctccagccctcacctgcctagtcctgggcctggcccttgtctttggtgaagggtctgctgtgcaccatcccccatcctacgtggcccacctggcctcagacttcggggtgagggtgtttcagcaggtggcgcaggcctccaaggaccgcaacgtggttttctcaccctatggggtggcctcggtgttggccatgctccagctgacaacaggaggagaaacccagcagcagattcaagcagctatgggattcaagattgatgacaagggcatggcccccgccctccggcatctgtacaaggagctcatggggccatggaacaaggatgagatcagcaccacagacgcgatcttcgtccagcgggatctgaagctggtccagggcttcatgccccacttcttcaggctgttccggagcacggtcaagcaagtggacttttcagaggtggagagagccagattcatcatcaatgactgggtgaagacacacacaaaaggtatgatcagcaacttgcttgggaaaggagccgtggaccagctgacacggctggtgctggtgaatgccctctacttcaacggccagtggaagactcccttccccgactccagcacccaccgccgcctcttccacaaatcagacggcagcactgtctctgtgcccatgatggctcagaccaacaagttcaactatactgagttcaccacgcccgatggccattactacgacatcctggaactgccctaccacggggacaccctcagcatgttcattgctgccccttatgaaaaagaggtgcctctctctgccctcaccaacattctgagtgcccagctcatcagccactggaaaggcaacatgaccaggctgccccgcctcctggttctgcccaagttctccctggagactgaagtcgacctcaggaagcccctagagaacctgggaatgaccgacatgttcagacagtttcaggctgacttcacgagtctttcagaccaagagcctctccacgtcgcgcaggcgctgcagaaagtgaagatcgaggtgaacgagagtggcacggtggcctcctcatccacagctgtcatagtctcagcccgcatggcccccgaggagatcatcatggacagacccttcctctttgtggtccggcacaaccccacaggaacagtccttttcatgggccaagtgatggaaccctgaccctggggaaagacgccttcatctgggacaaaactggagatgcatcgggaaagaagaaactccgaagaaaagaattttagtgttaatgactctttctgaaggaagagaagacatttgccttttgttaaaagatggtaaaccagatctgtctccaagaccttggcctctccttggaggacctttaggtcaaactccctagtctccacctgagaccctgggagagaagtttgaagcacaactcccttaaggtctccaaaccagacggtgacgcctgcgggaccatctggggcacctgcttccacccgtctctctgcccactcgggtctgcagacctggttcccactgaggccctttgcaggatggaactacggggcttacaggagcttttgtgtgcctggtagaaactatttctgttccagtcacattgccatcactcttgtactgcctgccaccgcggaggaggctggtgacaggccaaaggccagtggaagaaacaccctttcatctcagagtccactgtggcactggccacccctccccagtacaggggtgctgcaggtggcagagtgaatgtcccccatcatgtggcccaactctcctggcctggccatctccctccccagaaacagtgtgcatgggttattttggagtgtaggtgacttgtttactcattgaagcagatttctgcttccttttatttttataggaatagaggaagaaatgtcagatgcgtgcccagctcttcaccccccaatctcttggtggggaggggtgtacctaaatatttatcatatccttgcccttgagtgcttgttagagagaaagagaactactaaggaaaataatattatttaaactcgctcctagtgtttctttgtggtctgtgtcaccgtatctcaggaagtccagccacttgactggcacacacccctccggacatccagcgtgacggagcccacactgccaccttgtggccgcctgagaccctcgcgccccccgcgcccctctttttccccttgatggaaattgaccatacaatttcatcctccttcaggggatcaaaaggacggagtggggggacagagactcagatgaggacagagtggtttccaatgtgttcaatagatttaggagcagaaatgcaaggggctgcatgacctaccaggacagaactttccccaattacagggtgactcacagccgcattggtgactcacttcaatgtgtcatttccggctgctgtgtgtgagcagtggacacgtgaggggggggtgggtgagagagacaggcagctcggattcaactaccttagataatatttctgaaaacctaccagccagagggtagggcacaaagatggatgtaatgcactttgggaggccaaggcgggaggattgcttgagcccaggagttcaagaccagcctgggcaacataccaagacccccgtctctttaaaaatatatatattttaaatatacttaaatatatatttctaatatctttaaatatatatatatattttaaagaccaatttatgggagaattgcacacagatgtgaaatgaatgtaatctaatagaagcctaatcagcccaccatgttctccactgaaaaatcctctttctttggggtttttctttctttcttttttgattttgcactggacggtgacgtcagccatgtacaggatccacaggggtggtgtcaaatgctattgaaattgtgttgaattgtatgctttttcacttttgataaataaacatgtaaaaatgtttcaaaaaaataataaaataaataaatacgaagaatatgtcaggacagtca

SEQ ID NO: 3814 - DNA, 3135 bp, Homo sapiens
aggagcacagctgtgtttggctgcagggccaagagcgctgtcaagaagacccacacgcccccctccagcagctgaattcctgcagctcagcagccgccgccagagcaggacgaaccgccaatcgcaaggcacctctgagaacttcaggatgcagatgtctccagccctcacctgcctagtcctgggcctggcccttgtctttggtgaagggtctgctgtgcaccatcccccatcctacgtggcgcaggcctccaaggaccgcaacgtggttttctcaccctatggggtggcctcggtgttggccatgctccagctgacaacaggaggagaaacccagcagcagattcaagcagctatgggattcaagattgatgacaagggcatggcccccgccctccggcatctgtacaaggagctcatggggccatggaacaaggatgagatcagcaccacagacgcgatcttcgtccagcgggatctgaagctggtccagggcttcatgccccacttcttcaggctgttccggagcacggtcaagcaagtggacttttcagaggtggagagagccagattcatcatcaatgactgggtgaagacacacacaaaaggtatgatcagcaacttgcttgggaaaggagccgtggaccagctgacacggctggtgctggtgaatgccctctacttcaacggccagtggaagactcccttccccgactccagcacccaccgccgcctcttccacaaatcagacggcagcactgtctctgtgcccatgatggctcagaccaacaagttcaactatactgagttcaccacgcccgatggccattactacgacatcctggaactgccctaccacggggacaccctcagcatgttcattgctgccccttatgaaaaagaggtgcctctctctgccctcaccaacattctgagtgcccagctcatcagccactggaaaggcaacatgaccaggctgccccgcctcctggttctgcccaagttctccctggagactgaagtcgacctcaggaagcccctagagaacctgggaatgaccgacatgttcagacagtttcaggctgacttcacgagtctttcagaccaagagcctctccacgtcgcgcaggcgctgcagaaagtgaagatcgaggtgaacgagagtggcacggtggcctcctcatccacagctgtcatagtctcagcccgcatggcccccgaggagatcatcatggacagacccttcctctttgtggtccggcacaaccccacaggaacagtccttttcatgggccaagtgatggaaccctgaccctggggaaagacgccttcatctgggacaaaactggagatgcatcgggaaagaagaaactccgaagaaaagaattttagtgttaatgactctttctgaaggaagagaagacatttgccttttgttaaaagatggtaaaccagatctgtctccaagaccttggcctctccttggaggacctttaggtcaaactccctagtctccacctgagaccctgggagagaagtttgaagcacaactcccttaaggtctccaaaccagacggtgacgcctgcgggaccatctggggcacctgcttccacccgtctctctgcccactcgggtctgcagacctggttcccactgaggccctttgcaggatggaactacggggcttacaggagcttttgtgtgcctggtagaaactatttctgttccagtcacattgccatcactcttgtactgcctgccaccgcggaggaggctggtgacaggccaaaggccagtggaagaaacaccctttcatctcagagtccactgtggcactggccacccctccccagtacaggggtgctgcaggtggcagagtgaatgtcccccatcatgtggcccaactctcctggcctggccatctccctccccagaaacagtgtgcatgggttattttggagtgtaggtgacttgtttactcattgaagcagatttctgcttccttttatttttataggaatagaggaagaaatgtcagatgcgtgcccagctcttcaccccccaatctcttggtggggaggggtgtacctaaatatttatcatatccttgcccttgagtgcttgttagagagaaagagaactactaaggaaaataatattatttaaactcgctcctagtgtttctttgtggtctgtgtcaccgtatctcaggaagtccagccacttgactggcacacacccctccggacatccagcgtgacggagcccacactgccaccttgtggccgcctgagaccctcgcgccccccgcgcccctctttttccccttgatggaaattgaccatacaatttcatcctccttcaggggatcaaaaggacggagtggggggacagagactcagatgaggacagagtggtttccaatgtgttcaatagatttaggagcagaaatgcaaggggctgcatgacctaccaggacagaactttccccaattacagggtgactcacagccgcattggtgactcacttcaatgtgtcatttccggctgctgtgtgtgagcagtggacacgtgaggggggggtgggtgagagagacaggcagctcggattcaactaccttagataatatttctgaaaacctaccagccagagggtagggcacaaagatggatgtaatgcactttgggaggccaaggcgggaggattgcttgagcccaggagttcaagaccagcctgggcaacataccaagacccccgtctctttaaaaatatatatattttaaatatacttaaatatatatttctaatatctttaaatatatatatatattttaaagaccaatttatgggagaattgcacacagatgtgaaatgaatgtaatctaatagaagcctaatcagcccaccatgttctccactgaaaaatcctctttctttggggtttttctttctttcttttttgattttgcactggacggtgacgtcagccatgtacaggatccacaggggtggtgtcaaatgctattgaaattgtgttgaattgtatgctttttcacttttgataaataaacatgtaaaaatgtttcaaaaaaataataaaataaataaatacgaagaatatgtcaggacagtc

SEQ ID NO: 3815 - DNA, 1326 bp, Homo sapiens
cacagctgtgtttggctgcagggccaagagcgctgtcaagaagacccacacgcccccctccagcagctgaattcctgcagctcagcagccgccgcctcttccacaaatcagacggcagcactgtctctgtgcccatgatggctcagaccaacaagttcaactatactgagttcaccacgcccgatggccattactacgacatcctggaactgccctaccacggggacaccctcagcatgttcattgctgccccttatgaaaaagaggtgcctctctctgccctcaccaacattctgagtgcccagctcatcagccactggaaaggcaacatgaccaggctgccccgcctcctggttctgcccaagttctccctggagactgaagtcgacctcaggaagcccctagagaacctgggaatgaccgacatgttcagacagtttcaggctgacttcacgagtctttcagaccaagagcctctccacgtcgcgcaggcgctgcagaaagtgaagatcgaggtgaacgagagtggcacggtggcctcctcatccacagctgtcatagtctcagcccgcatggcccccgaggagatcatcatggacagacccttcctctttgtggtccggcacaaccccacaggaacagtccttttcatgggccaagtgatggaaccctgaccctggggaaagacgccttcatctgggacaaaactggagatgcatcgggaaagaagaaactccgaagaaaagaattttagtgttaatgactctttctgaaggaagagaagacatttgccttttgttaaaagatggtaaaccagatctgtctccaagaccttggcctctccttggaggacctttaggtcaaactccctagtctccacctgagaccctgggagagaagtttgaagcacaactcccttaaggtctccaaaccagacggtgacgcctgcgggaccatctggggcacctgcttccacccgtctctctgcccactcgggtctgcagacctggttcccactgaggccctttgcaggatggaactacggggcttacaggagcttttgtgtgcctggtagaaactatttctgttccagtcacattgccatcactcttgtactgcctgccaccgcggaggaggctggtgacaggccaaaggccagtggaagaaacaccctttcatctcagagtccactgtggcactggccacccctccccagtacaggggtgctgcaggtggcagagtgaatgtcccccatcatgtggcccaactctcctggcctggccatctccctccccagaaacagtgtgcatgggttattttggagtg

SEQ ID NO: 3816 - DNA, 2114 bp, Homo sapiens
gtagttaggagtctggagtcgtgagccggagtcagaactgcgtctcgcgacccaggcgcgggtttccagaggacagccaacaagcgatgctgccgccgccgtttcctgattggttgtgggtggctacctcttcgttctgattggccgctagtgagcaagatgctgagcaagggtctgaagcggaaacgggaggaggaggaggagaaggaacctctggcagtcgactcctggtggctagatcctggccacacagcggtggcacaggcacccccggccgtggcctctagctccctctttgacctctcagtgctcaagctccaccacagcctgcagcagagtgagccggacctgcggcacctggtgctggtcgtgaacactctgcggcgcatccaggcgtccatggcacccgcggctgccctgccacctgtgcctagcccacctgcagcccccagtgtggctgacaacttactggcaagctcggacgctgccctttcagcctccatggccagcctcctggaggacctcagccacattgagggcctgagtcaggctccccaacccttggcagacgaggggccaccaggccgtagcatcgggggagcagcgcccagcctgggtgccttggacctgctgggcccagccactggctgtctactggacgatgggcttgagggcctgtttgaggatattgacacctctatgtatgacaatgaactttgggcaccagcctctgagggcctcaaaccaggccctgaggatgggccgggcaaggaggaagctccggagctggacgaggccgaattggactacctcatggatgtgctggtgggcacacaggcactggagcgaccgccggggccagggcgctgagccctcgtgctggaatggttgtctggtatctgaactgagcctgctggctggaccaactgtcctcgaaaagacacagctggcttccctagtacagagaacagggcttgggccactttggagagacagaatctagtcctgggcaacttcacatccgtcctcctgtctcagggctggcagggggagcctggaattaccccctagtgatggaatgacagggtctggtggggactgaattccctggccctggggtcatagcttgggctgttccttctctgatacgggaagagaccccaatcagatttttcaaattaaagccagtcctgggaaatctcaaatccgtgtgctgctttgtctctgggcaaatgtgaaggcgagataaaaacatcaaacattttattgggcgtaggctgtgtacgaggcacagtttctaagcacgtcactgtgttaactcatttaatcctataacagccctacaagatcggtagtattatcatccctattttacaggtgagaaaaccaaggttccaagattatcacttgaggtgggttttaaattatgaacttttttttttttttttttgagatagggtctcgctctgtcacccaggttgaagtacagtggtctgatcatggctcactacagcctcaaactcctgggctcaagcgatcctcctaccaggccactttttttttttctttcttttttttttaagacagattcttactctgtcgcccaggctggagtgcagtggcgtgacttcggctcactgcaacctccacctcccaggttcaaacgattctcctgcctcggcctcccaattagctgggaccgactaattttttatattttttgtagagacagggtttcaccgtgttagccaggatggtcttcatcttctgacctcgtgatctgcctgcctcagcctcccaaagtgctgggattacaggcgtgagccactgtgcctggcctttttttttttttcttaaattttatttcttttctttgctagcaggaagtcaaggcaactttttaaaaatgaaagcaagtcctcgcctggagtctacctgtatttattgaggagcgaaggggagattgctttcagaatggtcccgaaataaaaacacaaaacctggaccctggacagatcctctccaaggagccctgagagtcggctctccaggaaaatgggggaggaaagggggacaacagcccatttttaaaaataaaattcactcctggtctt

SEQ ID NO: 3817 - DNA, 4200 bp, Homo sapiens
ggtcgggggatccctccgccgccagcgcgtggtcccggccccctccacccgccgtctcggccgcggccagcagcccctgccccccgggggacgctgacggccgcccggcgcgccgccctagcagacggacagggggcgctgcgcgcggcctggggcaacccgggccacaggggcaggaaagtgagggcccaggtcggcccgggcgtgcaggggccccgggttcgcagcggcggccgcggcagcgatagcggcactagcagcagcgggagtgccgggttgagccgggaagccgatggcggcggctgcggcggctccgattcctcgctgactgcccgtccgccctcctgcatcgagcgccatgttaccgacccaagctggggccgcggcggctctgggccggggctcggccctggggggcagcctgaaccggaccccgacggggcggccgggcggcggcggcgggacacgcggggctaacgggggccgggtccccgggaatggcgcggggctcgggcccggccgcctggagcgggaggctgcggcagcggcggcaaccaccccggcgcccaccgcgggggccctctacagcggcagcgagggcgactcggagtcgggcgaggaggaggagctgggcgccgagcggcgcggcctgaagcggagcctgagcgagatggagatcggtatggtggtcggtgggcccgaggcgtcggcagcggccaccgggggctacgggccggtgagcggcgcggtgagcggggccaagccgggtaagaagacccggggccgcgtgaagatcaagatggagttcatcgacaacaagctgcggcgctacacgaccttcagcaagaggaagacgggcatcatgaagaaggcctatgagctgtccacgctgacagggacacaggtgctgttgctggtggccagtgagacaggccatgtgtatacctttgccacccgaaaactgcagcccatgatcaccagtgagaccggcaaggcactgattcagacctgcctcaactcgccagactctccaccccgttcagaccccacaacagaccagagaatgagtgccactggctttgaagagacagatctcacctaccaggtgtcggagtctgacagcagtggggagaccaaggacacactgaagccggcgttcacagtcaccaacctgccgggtacaacctccaccatccaaacagcacctagcacctctaccaccatgcaagtcagcagcggcccctcctttcccatcaccaactacctggcaccagtgtctgctagtgtcagccccagtgctgtcagcagtgccaatgggactgtgctgaagagtacaggcagcggccctgtctcctctgggggccttatgcagctgcctaccagcttcaccctcatgcctggtggggcagtggcccagcaggtcccagtgcaggccattcaagtgcaccaggccccacagcaagcgtctccctcccgtgacagcagcacagacctcacgcagacctcctccagcgggacagtgacgctgcccgccaccatcatgacgtcatccgtgcccacaactgtgggtggccacatgatgtaccctagcccgcatgcggtgatgtatgcccccacctcgggcctgggtgatggcagcctcaccgtgctgaatgccttctcccaggcaccatccaccatgcaggtgtcacacagccaggtccaggagccaggtggcgtcccccaggtgttcctgacagcatcatctgggacagtgcagatccctgtttcagcagttcagctccaccagatggctgtgatagggcagcaggccgggagcagcagcaacctcaccgagctacaggtggtgaacctggacaccgcccacagcaccaagagtgaatgatccgcccgccgccctggacagatggcccaagggatggcaccacttatttattgttgccttttcacgttttctttacacacacgttgacgggccgcaggagggaggcggggaggaggaacgggcagccacaggactgagccctctcactccagccaaagaaatgggcctgcctgcctccacccgtcctccctcagcctccccttcttcccgccccacctcccatttctgttgctggaggggctgtcctccttcctgggaccccctcgccagcttggctcgatgtttgccatgagtattagcttacccaatgggaccgtgccccacctccccacacacaggccttctgtggggctgggcaccgtgtcctcctctgaggaagcagttggggccctcttgccagcctccttgctgaccccaggtcagccctgtgtctgtcacaggctgggtcaaaagagccctggctctgcccctcagggggccagctggggagatgggggcttcttcctcacactgctgtcctctcccccttcagctcctgagtagctgggcctgtgcactgggcaggttcctggggccgcctgccctgccttgccgctccccttggacctccaggggctcctgggttggagggaaccaccagcgttcccttctcccccttgtcttcccccctctcctcccagctgctttacttaaagttgattttgaactttttatttgaggagacgaagtgaaaacaaatctataaatatatatttttaaaatatttaacttttttttatggcgtttttctcgtccccctccctgcccaaactccccttccctggggagccctcaggctccccagaactggctgggcccctggggacagagccaccccatgagctcggggtccaccagtgtgtgggggagattctgggtttgcccagtcctgggttgtttccaggagaaagccgggggaggggccctcaggccattccccaacggggtggggagggtgacccacagctctgggcctctttttgccctttagggctgttgctagggagagggaagagggagaccaaatgtcggggttggggtgggagggcgtcaggcagaggcaactgacttcatttgtgccacacgcatgggcattgcagccttgcgctgtcccaggcatgcagctgcctggggcccaagttgcagtgagcagggtggggtctgggagggggtgagaggcaggaatgggggtcagaagaagtgggagcagcttcttgggctgagtgcagccaaaggggagccagaaatgggcagttctcccagggagtgagcagctactgtaacttttttaaattaagacaaaaagccttgaagaaaatgactttatttttctaagtgtaacctcagtatttatgtaatttgtacaggggccatgccccacccccctcctccccctttggggtagaccttgagggtgggccagcataggggggagggtcttttaccctgtgtcagagcctaccttcaccacctatatccagaaggggagctttttcagaaacagggcagcagtggggtgaaattttcttaacccctaagactgccttcagtaggaacaagctggcttctgtgattaggtgaagggatgggggaagattttatgcacagcctagttatcaaggggatgatttgccgacatgtttgagaaccccctaacctctaaccctcattgctgtcttgccccagtttggggtgccaagatggaagtcacctttctgggctttctcctggagatagctggggcttatgggtggctttcaaggctggggcatggcaaatcaggggccagagagcaggggagcttgggactcaggtctgtaactgcccagccccttttctctgctcttgtttcactccaccatcactcactcactccccactcccccacccatggggaggagacctttgatgaattcttcctctccttcccacaaaagacagacccagtgagtgaatcaggcaaagtgcttataatgtgtgttgtgtgagcgtggccttgggaggacatgcgtgtgtcagggatgagttgaggtgatatttttatgtgcagcgacccttggtgtttcccttcctcggtggctctggggtatgtgtgtgtgggtgtgtgcgcctgagtgagtgtgtgtgcttgaatgtgagtgtgtatgtcagtggtttctacttcccctgggatgctgacccaggaatagtggacatggtcacagtcctatgtacagagctttcttttgtattaaaaaaaaatactctttcaataaatgtatcatttttgtgcacag

SEQ ID NO: 3818 - DNA, 1312 bp, Homo sapiens
aaaggcgcagaggtgggagtgaccggcgccagagaggaagagggcccttgctgagtgaaggggcctatgagctgtccacgctgacagggacacaggtgctgttgctggtggccagtgagacaggccatgtgtatacctttgccacccgaaaactgcagcccatgatcaccagtgagaccggcaaggcactgattcagacctgcctcaactcgccagactctccaccccgttcagaccccacaacagaccagagaatgagtgccactggctttgaagagacagatctcacctaccaggtgtcggagtctgacagcagtggggagaccaaggacacactgaagccggcgttcacagtcaccaacctgccgggtacaacctccaccatccaaacagcacctagcacctctaccaccatgcaagtcagcagcggcccctcctttcccatcaccaactacctggcaccagtgtctgctagtgtcagccccagtgctgtcagcagtgccaatgggactgtgctgaagagtacaggcagcggccctgtctcctctgggggccttatgcagctgcctaccagcttcaccctcatgcctggtggggcagtggcccagcaggtcccagtgcaggccattcaagtgcaccaggccccacagcaagcgtctccctcccgtgacagcagcacagacctcacgcagacctcctccagcgggacagtgacgctgcccgccaccatcatgacgtcatccgtgcccacaactgtgggtggccacatgatgtaccctagcccgcatgcggtgatgtatgcccccacctcgggcctgggtgatggcagcctcaccgtgctgaatgccttctcccaggcaccatccaccatgcaggtgtcacacagccaggtccaggagccaggtggcgtcccccaggtgttcctgacagcatcatctgggacagtgcagatccctgtttcagcagttcagctccaccagatggctgtgatagggcagcaggccgggagcagcagcaacctcaccgagctacaggtggtgaacctggacaccgcccacagcaccaagagtgaatgatccgcccgccgccctggacagatggcccaagggatggcaccacttatttattgttgccttttcacgttttctttacacacacgttgacgggccgcaggagggaggcggggaggaggaacgggcagccacaggactgagccctctcactccagccaaagaaatgggcctgcctgcctccacccgtcctccctcagcctccccttcttcccgccccacctcccatttctgttgctgga

SEQ ID NO: 3819 - DNA, 2915 bp, Homo sapiens
cgccgtaggaggaggtggaggaggaggcggctcgggagagcgagcagcgagctggctggatcgccgagcgcgagtgagggagccgagccgcccgccgccgccgcctccgcctcccctccgcgaacaggagcccgggccggggcccggcacgccgccccagcccgtccctcggcgtcaggccgcgagggtagcgcgcgcgagcgagcgagggggagggagagcgagcgagcgccgggaggaggcggccggaccgagcgggcgcccgcgcgtgtggcgtgaggggaagccgcttgcccgcccccttcgccttcccttctctccccctccccgctccccccccgaccgcggagcagcaccatgtcggcgccggcggccaaagtcagtaaaaaggagctcaactccaaccacgacggggccgacgagacctcagaaaaagaacagcaagaagcgattgaacacattgatgaagtacaaaatgaaatagacagacttaatgaacaagccagtgaggagattttgaaagtagaacagaaatataacaaactccgccaaccattttttcagaagaggtcagaattgatcgccaaaatcccaaatttttgggtaacaacatttgtcaaccatccacaagtgtctgcactgcttggggaggaagatgaagaggcactgcattatttgaccagagttgaagtgacagaatttgaagatattaaatcaggttacagaatagatttttattttgatgaaaatccttactttgaaaataaagttctctccaaagaatttcatctgaatgagagtggtgatccatcttcgaagtccaccgaaatcaaatggaaatctggaaaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccaaacccattacagtactacttggttcccgatatggatgatgaagaaggagaaggagaagaagatgatgatgatgatgaagaggaggaaggattagaagatattgacgaagaaggggatgaggatgaaggtgaagaagatgaagatgatgatgaaggggaggaaggagaggaggatgaaggagaagatgactaaatagaacactgatggattccaaccttcctttttttaaattttctccagtccctgggagcaagttgcagtcttttttttttttttttttttttttccctcttgtgctcagtcgccctgttcttgaggtctcttttctctactccatggttctcaatttatttggggggaaataccttgagcagaatacaatgggaaaagagtctctacccctttctgttcgaagttcatttttatcccttcctgtctgaacaaaaactgtatggaatcaacaccaccgagctctgtgggaaaaaagaaaaacctgctcccttcgctctgctggaagctggagggtgctaggcccctgtgtagtagtgcatagaattctagcttttttcctcctttctctgtatattgggctcagagagtacactgtgtctctatgtgaatatggacagttagcatttaccaacatgtatctgtctactttctcttgtttaaaaaaagaaaaaaaaacttaaaaaaatggggttatagaaggtcagcaaagggtgggtttgagatgtttgggtgggttaagtgggcattttgacaacatggcttctcctttggcatgtttaattgtgatatttgacagacatccttgcagtttaagatgacacttttaaaataaattctctcctaatgatgacttgagccctgccactcaatgggagaatcagcagaacctgtaggatcttatttggaattgacattctctattgtaattttgttcctgtttatttttaaattttctttttgtttcactggaaaggaaagatgatgctcagttttaaacgttaaaagtgtacaagttgctttgttacaataaaactaaatgtgtacacaaaggatttgatgcttttctctcagcataggtatgcttactatgaccttccaagtttgacttgtataacatcactgtcaaactttgtcaccctaacttcgtattttttgatacgcactttgcaggatgacctcagggctatgtggattgagtaatgggatttgaatcaatgtattaatatctccatagctgggaaacgtgggttcaatttgccattggtttctgaaagtattcacatcatttgggataccagatagctcaatactctctgagtacattgtgcccttgatttttatctccaagtggcagtttttaaaattggccttttacctggatataaattaattgtgcctgccaccaccatccaacagacctggtgctctaatgccaagttatacacgggacagttgctggcatgtcttcattggctatataaaatgtggccaagaagataggctctcagtaagaagtctgatggtgagcagtaactgtccctgctttctggtataaagctctcaaatgtgaccatgtgaatctgggtgggataatggactcagctctgtctgctcaatgccattgtgcagagaagcaccctaatgcataagctttttaatgctgtaaaatatagtcgctgaaattaaatgccactttttcagaggtgaattaatggacagtctggtgaacttcaaaagctttttgatgtataaaacttgataaatggaactattccatcaataggcaaaagtgtaacaacctatctagatggatagtatgtaatttctgcacaggtctctgtttagtaaatacatcactgtataccgatcaggaatcttgctccaataaaggaacataaagattt

SEQ ID NO: 3820 - DNA, 1029 bp, Homo sapiens
gatgcctcgctcccatcagccgccgccgccgccacatgaaaaagaacagcaagaagcgattgaacacattgatgaagtacaaaatgaaatagacagacttaatgaacaagccagtgaggagattttgaaagtagaacagaaatataacaaactccgccaaccattttttcagaagaggtcagaattgatcgccaaaatcccaaatttttgggtaacaacatttgtcaaccatccacaagtgtctgcactgcttggggaggaagatgaagaggcactgcattatttgaccagagttgaagtgacagaatttgaagatattaaatcaggttacagaatagatttttattttgatgaaaatccttactttgaaaataaagttctctccaaagaatttcatctgaatgagagtggtgatccatcttcgaagtccaccgaaatcaaatggaaatctggaaaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccaaacccattacagtactacttggttcccgatatggatgatgaagaaggagaaggagaagaagatgatgatgatgatgaagaggaggaaggattagaagatattgacgaagaaggggatgaggatgaaggtgaagaagatgaagatgatgatgaaggggaggaaggagaggaggatgaaggagaagatgactaaatagaacactgatggattccaaccttcctttttttaaattttctccagtccctgggagcaagttgcagtcttttttttttttttttttttttttccctcttgtgctcagtcgccctgttcttgaggtctcttttctctactccatggttctcaatttatttggggggaaataccttgagcagaatacaatgggaaaagagtctctacccctttctgttcgaagttcattt

SEQ ID NO: 3821 - DNA, 1279 bp, Homo sapiens
atgatgcctcgctcccatcagccgccgccgccgccacatgaaaaagaacagcaagaagcgattgaacacattgatgaagtacaaaatgaaatagacagacttaatgaacaagccagtgaggagattttgaaagtagaacagaaatataacaaactccgccaaccattttttcagaagaggtcagaattgatcgccaaaatcccaaatttttgggtaacaacatttgtcaaccatccacaagtgtctgcactgcttggggaggaagatgaagaggcactgcattatttgaccagagttgaagtgacagaatttgaagatattaaatcaggttacagaatagatttttattttgatgaaaatccttactttgaaaataaagttctctccaaagaatttcatctgaatgagagtggtgatccatcttcgaagtccaccgaaatcaaatggaaatctggaaaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccaaacccattacagtactacttggttcccgatatggatgatgaagaaggagaaggagaagaagatgatgatgatgatgaagaggaggaaggattagaagatattgacgaagaaggggatgaggatgaaggtgaagaagatgaagatgatgatgaaggggaggaaggagaggaggatgaaggagaagatgactaaatagaacactgatggattccaaccttcctttttttaaattttctccagtccctgggagcaagttgcagtcttttttttttttttttttttttttccctcttgtgctcagtcgccctgttcttgaggtctcttttctctactccatggttctcaatttatttggggggaaataccttgagcagaatacaatgggaaaagagtctctacccctttctgttcgaagttcatttttatcccttcctgtctgaacaaaaactgtatggaatcaacaccaccgagctctgtgggaaaaaagaaaaacctgctcccttcgctctgctggaagctggagggtgctaggcccctgtgtagtagtgcatagaattctagcttttttcctcctttctctgtatattgggctcagagagtacactgtgtctctatgtgaatatggacagttagcatttaccaacatgtatctgtctactttctcttgttt

SEQ ID NO: 3822 - DNA, 2850 bp, Homo sapiens
gtgcccctgcagagcgaggcagagagcaactaaaagaaatttctcctgattggagggtgggtgggatgaggctgggggagggggccggggtgtgtgtcccactgtcatgtaaatatcccttccaggcagggcggctccagtgcagatttaagccgctggcacctggggcagtctcagtgttcagcctgcttccggacgggcgaggagactcgtggtctggttctgggacttccctaacagcatggcccctaaacgccagtctccactcccgcctcaaaagaagaaaccaagaccacctcctgctctgggaccggaggagacatcggcctctgcaggcttgccgaagaagggagaaaaagaacagcaagaagcgattgaacacattgatgaagtacaaaatgaaatagacagacttaatgaacaagccagtgaggagattttgaaagtagaacagaaatataacaaactccgccaaccattttttcagaagaggtcagaattgatcgccaaaatcccaaatttttgggtaacaacatttgtcaaccatccacaagtgtctgcactgcttggggaggaagatgaagaggcactgcattatttgaccagagttgaagtgacagaatttgaagatattaaatcaggttacagaatagatttttattttgatgaaaatccttactttgaaaataaagttctctccaaagaatttcatctgaatgagagtggtgatccatcttcgaagtccaccgaaatcaaatggaaatctggaaaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccaaacccattacagtactacttggttcccgatatggatgatgaagaaggagaaggagaagaagatgatgatgatgatgaagaggaggaaggattagaagatattgacgaagaaggggatgaggatgaaggtgaagaagatgaagatgatgatgaaggggaggaaggagaggaggatgaaggagaagatgactaaatagaacactgatggattccaaccttcctttttttaaattttctccagtccctgggagcaagttgcagtcttttttttttttttttttttttttccctcttgtgctcagtcgccctgttcttgaggtctcttttctctactccatggttctcaatttatttggggggaaataccttgagcagaatacaatgggaaaagagtctctacccctttctgttcgaagttcatttttatcccttcctgtctgaacaaaaactgtatggaatcaacaccaccgagctctgtgggaaaaaagaaaaacctgctcccttcgctctgctggaagctggagggtgctaggcccctgtgtagtagtgcatagaattctagcttttttcctcctttctctgtatattgggctcagagagtacactgtgtctctatgtgaatatggacagttagcatttaccaacatgtatctgtctactttctcttgtttaaaaaaagaaaaaaaaacttaaaaaaatggggttatagaaggtcagcaaagggtgggtttgagatgtttgggtgggttaagtgggcattttgacaacatggcttctcctttggcatgtttaattgtgatatttgacagacatccttgcagtttaagatgacacttttaaaataaattctctcctaatgatgacttgagccctgccactcaatgggagaatcagcagaacctgtaggatcttatttggaattgacattctctattgtaattttgttcctgtttatttttaaattttctttttgtttcactggaaaggaaagatgatgctcagttttaaacgttaaaagtgtacaagttgctttgttacaataaaactaaatgtgtacacaaaggatttgatgcttttctctcagcataggtatgcttactatgaccttccaagtttgacttgtataacatcactgtcaaactttgtcaccctaacttcgtattttttgatacgcactttgcaggatgacctcagggctatgtggattgagtaatgggatttgaatcaatgtattaatatctccatagctgggaaacgtgggttcaatttgccattggtttctgaaagtattcacatcatttgggataccagatagctcaatactctctgagtacattgtgcccttgatttttatctccaagtggcagtttttaaaattggccttttacctggatataaattaattgtgcctgccaccaccatccaacagacctggtgctctaatgccaagttatacacgggacagttgctggcatgtcttcattggctatataaaatgtggccaagaagataggctctcagtaagaagtctgatggtgagcagtaactgtccctgctttctggtataaagctctcaaatgtgaccatgtgaatctgggtgggataatggactcagctctgtctgctcaatgccattgtgcagagaagcaccctaatgcataagctttttaatgctgtaaaatatagtcgctgaaattaaatgccactttttcagaggtgaattaatggacagtctggtgaacttcaaaagctttttgatgtataaaacttgataaatggaactattccatcaataggcaaaagtgtaacaacctatctagatggatagtatgtaatttctgcacaggtctctgtttagtaaatacatcactgtataccgatcaggaatcttgctccaataaaggaacataaagattttttttggactgg

SEQ ID NO: 3823 - DNA, 962 bp, Homo sapiens
aagaagcactgaggaggagtcctacctcagggctcagtgtggacctgttggcacttttactgggtctcagtcccttttcctccacatgggatgcagagacctcctgcccagcttgaaacctaccttgctggaaaaagaacagcaagaagcgattgaacacattgatgaagtacaaaatgaaatagacagacttaatgaacaagccagtgaggagattttgaaagtagaacagaaatataacaaactccgccaaccattttttcagaagaggtcagaattgatcgccaaaatcccaaatttttgggtaacaacatttgtcaaccatccacaagtgtctgcactgcttggggaggaagatgaagaggcactgcattatttgaccagagttgaagtgacagaatttgaagatattaaatcaggttacagaatagatttttattttgatgaaaatccttactttgaaaataaagttctctccaaagaatttcatctgaatgagagtggtgatccatcttcgaagtccaccgaaatcaaatggaaatctggaaaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccaaacccattacagtactacttggttcccgatatggatgatgaagaaggagaaggagaagaagatgatgatgatgatgaagaggaggaaggattagaagatattgacgaagaaggggatgaggatgaaggtgaagaagatgaagatgatgatgaaggggaggaaggagaggaggatgaaggagaagatgactaaatagaacactgatggattccaaccttcctttttttaaattttctccagtccctgggagcaagttgcagtc

SEQ ID NO: 3824 - DNA, 235 bp, Homo sapiens
actgaggaatgttccaagcttaggcagggcggctccagtgcagatttaagccgctggcacctggggcagtctcagtgttcagcctgcttccggacgggcgaggagactcgtggtctggttctgggacttccctaacagcatggcccctaaacgccagtctccactcccgcctcaaaagaagaaaccaagaccacctcctgctctgggaccggaggagacatcggcctctgcaggc

SEQ ID NO: 3825 - DNA, 2415 bp, Homo sapiens
gcaggcaggctcctgcagtaactcttgagctggctcagggagcgcacttccttctcagccagcgcgtcgccccctgcatccgtggcctccactggagctgggcaggaccctacccagtgaatctggagaaaacaaacttgggagacagacgaaagcttagggcacattggaggacagcgcagctgtggctcccatttttggagatgcagtcgaatttgagctcacagggaggtgtggttgcctcctggggatggaaaggcttcctttctccacctctgtaactggtgcttctgagaagtaaatggtatttggatcctgacctcagacgcgaatttgggtcttctgtgcttaggagcagaaagagcccaggaggggcctgttcctttacttcttgggggaaacgcaatgcgtggcctgacttctcatgacgggaaaggctactccaccttctctgtactcctggaggggagtcttgttcacatgtttaccagcggccaggacaaggaagagaaaagaaatgagccgtcagactgctacagcattacctaccggtacctcgaagtgtccaccatcccagagggtgcctgccctgactggcacaactgcatccaacaatgacttggcgagtctttttgagtgtccagtctgctttgactatgtgttaccgcccattcttcaatgtcagagtggccatcttgtttgtagcaactgtcgcccaaagctcacatgttgtccaacttgccggggccctttgggatccattcgcaacttggctatggagaaagtggctaattcagtacttttcccctgtaaatatgcgtcttctggatgtgaaataactctgccacacacagaaaaagcagaccatgaagagctctgtgagtttaggccttattcctgtccgtgccctggtgcttcctgtaaatggcaaggctctctggatgctgtaatgccccatctgatgcatcagcataagtccattacaaccctacagggagaggatatagtttttcttgctacagacattaatcttcctggtgctgttgactgggtgatgatgcagtcctgttttggctttcacttcatgttagtcttagagaaacaggaaaaatacgatggtcaccagcagttcttcgcaatcgtacagctgataggaacacgcaagcaagctgaaaattttgcttaccgacttgagctaaatggtcataggcgacgattgacttgggaagcgactcctcgatctattcatgaaggaattgcaacagccattatgaatagcgactgtctagtctttgacaccagcattgcacagctttttgcagaaaatggcaatttaggcatcaatgtaactatttccatgtgttgaaatggcaatcaaacattttctggccagtgtttaaaacttcagtttcacagaaaataaggcacccatctgtctgccaacctaaaactctttcggtaggtggaagctagacacatgaaggtaaataaaaagaaaggctgttaaatacaggaaacagttgcatgtagtaacactaatatatttaaaaataagtcaacagtaaaccactgaaaaaatatatgtatatacacccaagatgggcatcttttgtattaagaaaggaagcattgtaaaataattctgagttttgtgtttgttgtagattgattgtattgttgaaaaagtttgtttttgcgtgggagtgtgtgcctgcgtgggtgtgtgcgtgtttgggtttttttcctttaactgacaagccatcttgagtggtcatgggccactgcttttccctttgtgagtcaatacatagtgctgctgtgtgctttttttgtgtgtatttgctaatttttattaattttagtttttcattaaataaatttgacttttctgtaattcaggtttttcctttttttgtaccattttaaagttagtatcttttgatatgcatatttgtttatggtaaaaaatttataacgtgttcaatattttcttttcccccattaatcagttcattagaaatattttaaaatcagctattttgtgaagccatgagttccagaaagtaaaggtgacatcggaaaaataatcaaaagctatttaaagcatctataaggtgctctctttctgtcttctacagatgagtcacacctttgagcttaatctttgaaaggttagagaataaattgatttttataaatactgcaaatcaggcttttgtttcctttttcagatatcttggacaaatcacatattttaaaatttgttcttgtatttattggttttgcagaagaaggcatcgtcatgcacagtatttgtaattaaaagcaaatcatttgtttaaaaaggcagtttgcaaaaaatgtttttggtcttttataattctcattaaaagaatatctggcaaattaaaaaaa

SEQ ID NO: 3826 - DNA, 3352 bp, Homo sapiens
tttcacccccaagacaaatagtggcctgccattttccagcccaggtagcttcctgggaaaagttgcttgttttatctttgactcagcctggctagttacattgtcgattatttcttccagatgatatttacctgttaaataatgtttattactctgctgatgaatgttttcagcaacgctggagaaccctaggctgcaaggggttcttcacctgttgactccatcccccacccccagtatggcatatatctctgccgtgctatcatctttattctttcctttttcattgtctcttcctgactgtcctcctttgttcattatgtctgacacatattgtggattgaaagtagaacagaaagatatactttctctaccagactaaaaagttttgagatggccctccatttctcccatgcctcacttcaccttagttgtgtttttatttatttttatattttcgccaccttcactagcgagtacatcccctcactcttgaggtgggcactgatcagtaggaaataagattaatacctggctggtgataatttggggggaagacttaattagatagagatggataatgggatggcagcagacctttccccttgtgacccttcccctcatttccaaaatacacctctagagtagataattgcttaccattaagaagagttaatggaaggtgatactctgattctttggcattggaactacattcaatccgcggtatcctcggattagttctaggacccccttctccataccaaaacctgaggatgctcaagtccctgatagaaaatggtgtcatatttgtatgtgcatattctcttgtataatttaagtgatctctggattacttaatacaatgtaaacaatatgtaaatagttgttatagactgtattttaaaaattttgtattctttataaatttttctgaatattttcaatccatggctggtgaagtcctcggatgcagaccgtgtggatacagagtgccgattttatacaggagttcacctgtaactccctgtacctatcaacagctgactccaaattagaaagaaatagagtaagggagcctcagggagagtcctagcaaaacggattcgattaaacttcagttccttgtatagtttctttagttgtttatggtccattttctattttagcatttattattctatgtagtctatccaaagacgattaagggagttccacatgttttccggaacattttgaaaagagagcttatccagtgtacagatcctaataaagtgcacattcagtgtaattttatttttttaatatcttttttaatcctatttttcttcctcttttgctcagtaaattttgtatgaaactttaaaaggacttatggcatgtaaacattatttataaagtaagtcatggttataattatttttctcctgcctccttatgtatttatttcagaaatgagccgtcagactgctacagcattacctaccggtacctcgaagtgtccaccatcccagagggtgcctgccctgactggcacaactgcatccaacaatgacttggcgagtctttttgagtgtccagtctgctttgactatgtgttaccgcccattcttcaatgtcagagtggccatcttgtttgtagcaactgtcgcccaaagctcacatgttgtccaacttgccggggccctttgggatccattcgcaacttggctatggagaaagtggctaattcagtacttttcccctgtaaatatgcgtcttctggatgtgaaataactctgccacacacagaaaaagcagaccatgaagagctctgtgagtttaggccttattcctgtccgtgccctggtgcttcctgtaaatggcaaggctctctggatgctgtaatgccccatctgatgcatcagcataagtccattacaaccctacagggagaggatatagtttttcttgctacagacattaatcttcctggtgctgttgactgggtgatgatgcagtcctgttttggctttcacttcatgttagtcttagagaaacaggaaaaatacgatggtcaccagcagttcttcgcaatcgtacagctgataggaacacgcaagcaagctgaaaattttgcttaccgacttgagctaaatggtcataggcgacgattgacttgggaagcgactcctcgatctattcatgaaggaattgcaacagccattatgaatagcgactgtctagtctttgacaccagcattgcacagctttttgcagaaaatggcaatttaggcatcaatgtaactatttccatgtgttgaaatggcaatcaaacattttctggccagtgtttaaaacttcagtttcacagaaaataaggcacccatctgtctgccaacctaaaactctttcggtaggtggaagctagacacatgaaggtaaataaaaagaaaggctgttaaatacaggaaacagttgcatgtagtaacactaatatatttaaaaataagtcaacagtaaaccactgaaaaaatatatgtatatacacccaagatgggcatcttttgtattaagaaaggaagcattgtaaaataattctgagttttgtgtttgttgtagattgattgtattgttgaaaaagtttgtttttgcgtgggagtgtgtgcctgcgtgggtgtgtgcgtgtttgggtttttttcctttaactgacaagccatcttgagtggtcatgggccactgcttttccctttgtgagtcaatacatagtgctgctgtgtgctttttttgtgtgtatttgctaatttttattaattttagtttttcattaaataaatttgacttttctgtaattcaggtttttcctttttttgtaccattttaaagttagtatcttttgatatgcatatttgtttatggtaaaaaatttataacgtgttcaatattttcttttcccccattaatcagttcattagaaatattttaaaatcagctattttgtgaagccatgagttccagaaagtaaaggtgacatcggaaaaataatcaaaagctatttaaagcatctataaggtgctctctttctgtcttctacagatgagtcacacctttgagcttaatctttgaaaggttagagaataaattgatttttataaatactgcaaatcaggcttttgtttcctttttcagatatcttggacaaatcacatattttaaaatttgttcttgtatttattggttttgcagaagaaggcatcgtcatgcacagtatttgtaattaaaagcaaatcatttgtttaaaaaggcagtttgcaaaaaatgtttttggtcttttataattctcattaaaagaatatctggcaaattaaaaaaa

SEQ ID NO: 3827 - DNA, 2147 bp, Homo sapiens
cagtgtgtggtatttagcgggggcgcgcggcgggctcgaggacgcgcgaaacggcggcggcggcggcggccaggggggagccggggcggccgttgcggggcgcgctctcgagaggcggcggcggcccagggtgtcccgtcggtctcggcgccgggaagaggcggtggcgctgcccgcggtggcgggggttggcgacggagcgcgttggtgccaggaccggggtccgaggcgcgctctccgcccacagaaatgagccgtcagactgctacagcattacctaccggtacctcgaagtgtccaccatcccagagggtgcctgccctgactggcacaactgcatccaacaatgacttggcgagtctttttgagtgtccagtctgctttgactatgtgttaccgcccattcttcaatgtcagagtggccatcttgtttgtagcaactgtcgcccaaagctcacatgttgtccaacttgccggggccctttgggatccattcgcaacttggctatggagaaagtggctaattcagtacttttcccctgtaaatatgcgtcttctggatgtgaaataactctgccacacacagaaaaagcagaccatgaagagctctgtgagtttaggccttattcctgtccgtgccctggtgcttcctgtaaatggcaaggctctctggatgctgtaatgccccatctgatgcatcagcataagtccattacaaccctacagggagaggatatagtttttcttgctacagacattaatcttcctggtgctgttgactgggtgatgatgcagtcctgttttggctttcacttcatgttagtcttagagaaacaggaaaaatacgatggtcaccagcagttcttcgcaatcgtacagctgataggaacacgcaagcaagctgaaaattttgcttaccgacttgagctaaatggtcataggcgacgattgacttgggaagcgactcctcgatctattcatgaaggaattgcaacagccattatgaatagcgactgtctagtctttgacaccagcattgcacagctttttgcagaaaatggcaatttaggcatcaatgtaactatttccatgtgttgaaatggcaatcaaacattttctggccagtgtttaaaacttcagtttcacagaaaataaggcacccatctgtctgccaacctaaaactctttcggtaggtggaagctagacacatgaaggtaaataaaaagaaaggctgttaaatacaggaaacagttgcatgtagtaacactaatatatttaaaaataagtcaacagtaaaccactgaaaaaatatatgtatatacacccaagatgggcatcttttgtattaagaaaggaagcattgtaaaataattctgagttttgtgtttgttgtagattgattgtattgttgaaaaagtttgtttttgcgtgggagtgtgtgcctgcgtgggtgtgtgcgtgtttgggtttttttcctttaactgacaagccatcttgagtggtcatgggccactgcttttccctttgtgagtcaatacatagtgctgctgtgtgctttttttgtgtgtatttgctaatttttattaattttagtttttcattaaataaatttgacttttctgtaattcaggtttttcctttttttgtaccattttaaagttagtatcttttgatatgcatatttgtttatggtaaaaaatttataacgtgttcaatattttcttttcccccattaatcagttcattagaaatattttaaaatcagctattttgtgaagccatgagttccagaaagtaaaggtgacatcggaaaaataatcaaaagctatttaaagcatctataaggtgctctctttctgtcttctacagatgagtcacacctttgagcttaatctttgaaaggttagagaataaattgatttttataaatactgcaaatcaggcttttgtttcctttttcagatatcttggacaaatcacatattttaaaatttgttcttgtatttattggttttgcagaagaaggcatcgtcatgcacagtatttgtaattaaaagcaaatcatttgtttaaaaaggcagtttgcaaaaaatgtttttggtcttttataattctcattaaaagaatatctggcaaattaaaaaaa

SEQ ID NO: 3828 - DNA, 1038 bp, Homo sapiens
gtgactgggctcctgggtagagttcaaggttggagtgaagcggcttccttgcggttgtgtgggtgtcccaacctgggtcgagataccccgcggttcaaaggctcccccgcagtgctttttaaattgacatatgcagtgataacctgctttagcctcaggctcactcacccgcccagaccctggagtgcccacgaccctccggctgtccacctcagcaatggcccaggacaagagcctatcgctgtcatgacctttgacctcaccaagatcacaaaaacctcctcctcctttgaggttcgaacctgggacccagagggagtgattttttatggggataccaaccctaaggatgactggtttatgctgggacttcgagacggcaggcctgagatccaactgcacaatcactgggcccagcttacggtgggtgctggaccacggctggatgatgggagatggcaccaggtggaagtcaagatggagggggactctgtgctgctggaggtggatggggaggaggtgctgcgcctgagacaggtctctgggcccctgaccagcaaacgccatcccatcatgaggattgcgcttggggggctgctcttccccgcttccaaccttcggttgccgctggttcctgccctggatggctgcctgcgccgggattcctggctggacaaacaggccgagatctcagcatctgcccccactagcctcagaagctgtgatgtagaatcaaatcccgggatatttctccctccagggactcaggcagaattcaatctccgagacattccccagcctcatgcagagccctgggccttctctttggacctgggactcaagcaggcagcaggctcaggccacctccttgctcttgggacaccagagaacccatcttggctcagtctccacctccaagatcaagagaagactcttccacctctttttgcctgaatggcctttgggcacaaggtcagaggctggatgtggaccaggccctgaacagaagccatgagatctggactcacagctgccccc

SEQ ID NO: 3829 - DNA, 1263 bp, Homo sapiens
cgccgagtggacagtggctgattatggagagcagaggcccactggctacctcgcgcctgctgctgttgctgctgttgctactactgcgtcacacccgccagggatgggccctgagacctgttctccccacccagagtgcccacgaccctccggctgtccacctcagcaatggcccaggacaagagcctatcgctgtcatgacctttgacctcaccaagatcacaaaaacctcctcctcctttgaggttcgaacctgggacccagagggagtgattttttatggggataccaaccctaaggatgactggtttatgctgggacttcgagacggcaggcctgagatccaactgcacaatcactgggcccagcttacggtgggtgctggaccacggctggatgatgggagatggcaccaggtggaagtcaagatggagggggactctgtgctgctggaggtggatggggaggaggtgctgcgcctgagacaggtctctgggcccctgaccagcaaacgccatcccatcatgaggattgcgcttggggggctgctcttccccgcttccaaccttcggttgccgctggttcctgccctggatggctgcctgcgccgggattcctggctggacaaacaggccgagatctcagcatctgcccccactagcctcagaagctgtgatgtagaatcaaatcccgggatatttctccctccagggactcaggcagaattcaatctccgagacattccccagcctcatgcagagccctgggccttctctttggacctgggactcaagcaggcagcaggctcaggccacctccttgctcttgggacaccagagaacccatcttggctcagtctccacctccaagatcaaaaggtggtgttgtcttctgggtcggggccagggctggatctgcccctggtcttgggactccctcttcagctgaagctgagtatgtccagggtggtcttgagccaagggtcgaagatgaaggcccttgccctgcctcccttaggcctggctcccctccttaacctctgggccaagcctcaagggcgtctcttcctgggggctttaccaggagaagactcttccacctctttttgcctgaatggcctttgggcacaaggtcagaggctggatgtggaccaggccctgaacagaagccatgagatctggactcacagctgcccccagagcccaggcaatggcactgacgcttcccattaaagctccacctaagaaccccctttgaaagtta

SEQ ID NO: 3830 - DNA, 1069 bp, Homo sapiens
aagagttgtctgagccgccgagtggacagtggctgattatggagagcagaggcccactggctacctcgcgcctgctgctgttgctgctgttgctactactgcgtcacacccgccagggatgggccctgagacctgttctccccacccagagtgcccacgaccctccggctgtccacctcagcaatggcccaggacaagagcctatcgctgtcatgacctttgacctcaccaagatcacaaaaacctcctcctcctttgaggttcgaacctgggacccagagggagtgattttttatggggataccaaccctaaggatgactggtttatgctgggacttcgagacggcaggcctgagatccaactgcacaatcactgggcccagcttacggtgggtgctggaccacggctggatgatgggagatggcaccaggtggaagtcaagatggagggggactctgtgctgctggaggtggatggggaggaggtgctgcgcctgagacaggtctctgggcccctgaccagcaaacgccatcccatcatgaggattgcgcttggggggctgctcttccccgcttccaaccttcggttgccgctggttcctgccctggatggctgcctgcgccgggattcctggctggacaaacaggccgagatctcagcatctgcccccactagcctcagaagctgtgatgtagaatcaaatcccgggatatttctccctccagggactcaggcagaattcaatctccgagacattccccagcctcatgcagagccctgggccttctctttggacctgggactcaagcaggcagcaggctcaggccacctccttgctcttgggacaccagagaacccatcttggctcagtctccacctccaagatcaagagaagactcttccacctctttttgcctgaatggcctttgggcacaaggtcagaggctggatgtggaccaggccctgaacagaagccatgagatctggactcacagctgcccccagagcccaggcaatggcactgacgcttcccattaaagctccacctaagaaccccctttgaaagtt

SEQ ID NO: 3831 - DNA, 907 bp, Homo sapiens
aagagttgtctgagccgccgagtggacagtggctgattatggagagcagaggcccactggctacctcgcgcctgctgctgttgctgctgttgctactactgcgtcacacccgccagggatgggccctgagacctgttctccccacccagagtgcccacgaccctccggctgtccacctcagcaatggcccaggacaagagcctatcgctgtcatgacctttgacctcaccaagatcacaaaaacctcctcctcctttgaggttcgaacctgggacccagagggagtgattttttatggggataccaaccctaaggatgactggtttatgctgggacttcgagacggcaggcctgagatccaactgcacaatcactgggcccagcttacggtgggtgctggaccacggctggatgatgggagatggcaccagctggttcctgccctggatggctgcctgcgccgggattcctggctggacaaacaggccgagatctcagcatctgcccccactagcctcagaagctgtgatgtagaatcaaatcccgggatatttctccctccagggactcaggcagaattcaatctccgagacattccccagcctcatgcagagccctgggccttctctttggacctgggactcaagcaggcagcaggctcaggccacctccttgctcttgggacaccagagaacccatcttggctcagtctccacctccaagatcaagagaagactcttccacctctttttgcctgaatggcctttgggcacaaggtcagaggctggatgtggaccaggccctgaacagaagccatgagatctggactcacagctgcccccagagcccaggcaatggcactgacgcttcccattaaagctccacctaagaaccccctttgaaagtt

SEQ ID NO: 3832 - DNA, 932 bp, Homo sapiens
aagagttgtctgagccgccgagtggacagtggctgattatggagagcagaggcccactggctacctcgcgcctgctgctgttgctgctgttgctactactgcgtcacacccgccagggatgggccctgagacctgttctccccacccagagtgcccacgaccctccggctgtccacctcagcaatggcccaggacaagagcctatcgctgtcatgacctttgacctcaccaagatcacaaaaacctcctcctcctttgaggttcgaacctgggacccagagggagtgattttttatggggataccaaccctaaggatgactggtttatgctgggacttcgagacggcaggcctgagatccaactgcacaatcactgggcccagcttacggtgggtgctggaccacggctggatgatgggagatggcaccaggtggaagtcaagatggagggggactctgtgctgctggaggtggatggggaggaggtgctgcgcctgagacaggtctctgggcccctgaccagcaaacgccatcccatcatgaggattgcgcttggggggctgctcttccccgcttccaaccttcggttgccgctggttcctgccctggatggctgcctgcgccgggattcctggctggacaaacaggccgagatctcagcatctgcccccactagcctcagaagctgtgatgtagaatcaaatcccgggatatttctccctccagggactcaggcagaattcaatctccgaggagaagactcttccacctctttttgcctgaatggcctttgggcacaaggtcagaggctggatgtggaccaggccctgaacagaagccatgagatctggactcacagctgcccccagagcccaggcaatggcactgacgcttcccattaaagctccacctaagaaccccctttgaaagtt

SEQ ID NO: 3833 - DNA, 610 bp, Homo sapiens
aagagttgtctgagccgccgagtggacagtggctgattatggagagcagaggcccactggctacctcgcgcctgctgctgttgctgctgttgctactactgcgtcacacccgccagggatgggccctgagacctgttctccccacccagagtgcccacgaccctccggctgtccacctcagcaatggcccaggacaagagcctatcgctgtcatgacctttgacctcaccaagatcacaaaaacctcctcctcctttgaggttcgaacctgggacccagagggagtgattttttatggggataccaaccctaaggatgactggtttatgctgggacttcgagacggcaggcctgagatccaactgcacaatcactgggcccagcttacggtgggtgctggaccacggctggatgatgggagatggcaccaggagaagactcttccacctctttttgcctgaatggcctttgggcacaaggtcagaggctggatgtggaccaggccctgaacagaagccatgagatctggactcacagctgcccccagagcccaggcaatggcactgacgcttcccattaaagctccacctaagaaccccctttgaaagtt

SEQ ID NO: 3834 - DNA, 1196 bp, Homo sapiens
ccgagtggacagtggctgattatggagagcagaggcccactggctacctcgcgcctgctgctgttgctgctgttgctactactgcgtcacacccgccagggatgggccctgagacctgttctccccacccagagtgcccacgaccctccggctgtccacctcagcaatggcccaggacaagagcctatcgctgtcatgacctttgacctcaccaagatcacaaaaacctcctcctcctttgaggttcgaacctgggacccagagggagtgattttttatggggataccaaccctaaggatgactggtttatgctgggacttcgagacggcaggcctgagatccaactgcacaatcactgggcccagcttacggtgggtgctggaccacggctggatgatgggagatggcaccaggtggaagtcaagatggagggggactctgtgctgctggaggtggatggggaggaggtgctgcgcctgagacaggtctctgggcccctgaccagcaaacgccatcccatcatgaggattgcgcttggggggctgctcttccccgcttccaaccttcggttgccggccgagatctcagcatctgcccccactagcctcagaagctgtgatgtagaatcaaatcccgggatatttctccctccagggactcaggcagaattcaatctccgagacattccccagcctcatgcagagccctgggccttctctttggacctgggactcaagcaggcagcaggctcaggccacctccttgctcttgggacaccagagaacccatcttggctcagtctccacctccaagatcaaaaggtggtgttgtcttctgggtcggggccagggctggatctgcccctggtcttgggactccctcttcagctgaagctgagtatgtccagggtggtcttgagccaagggtcgaagatgaaggcccttgccctgcctcccttaggcctggctcccctccttaacctctgggccaagcctcaagggcgtctcttcctgggggctttaccaggagaagactcttccacctctttttgcctgaatggcctttgggcacaaggtcagaggctggatgtggaccaggccctgaacagaagccatgagatctggactcacagctgcccccagagcccaggcaatggcactgacgcttcccattaaagctccacctaagaaccccc

SEQ ID NO: 3835 - DNA, 1599 bp, Homo sapiens
gggtaaggcgacatttcctgcccccggggccagggtgagaggagagatgatgagttgctgagtgtgcacacctttccggaacacatacacacaccctgctctgggatcccttgtgaggctgccctcatggagttccccctggcccagatatgtccccaagcaccttccagatcacagacatgacccgcaggagctgccagaacctgggctacactgcggcatctccccaggccccggaggctgcctccaacacagggaatgctgagagggcagaggaggtgcctggagaaggaagcctgttcctgcaggccgagacccgggcttggttccagaagacccaggcccactggctcctgcagcacggggcagcccctgcctggttccatggcttcatcacccggagggaggcagagaggctgctggagcccaagcctcaggggtgctacttggtgcggttcagcgagagcgcggtgaccttcgtgctgacttacaggagccggacttgctgccgccacttcctgctggcccagctcagggacgggcgccacgtggtgctgggcgaggacagcgcccacgcgcggctgcaggacctgctgctgcactacaccgcgcacccgctcagcccctacggggagacgctcaccgagcccctcgcccgacagactcctgagcctgcaggactttccctgaggaccgaagaatcaaactttggaagcaaaagccaggacccaaacccccagtacagcccaatcatcaaacaggggcaagccccagtcccgatgcagaaagagggggccggggagaaggagccctcccagctgctcaggcccaagcctcccatccccgccaaacctcagctgcccccagaagtctacacaatccctgttccacgacaccgcccggccccacgccccaagccctccaatcctatctacaatgagcctgatgaacccatagctttctatgccatgggccggggcagccctggggaagcccccagcaacatctatgtggaagtggaagatgagggcctacccgccacccttgggcaccctgtcctacggaagagctggtccaggcctgtcccaggaggccagaatacaggtggctcccagctgcattctgagaactctgtgattgggcaaggccctcccctgccccaccagcccccacccgcctggagacacaccctcccccacaatctttctagacaggtgcttcaggacagaggacaggcatggcttccccttgggcctcctcagtaggcggtctggcctgacccccaacaaagaagcctggaggtcagagaagcaaatgcggagcctgctccctcctaagaagatcccaagaatccaatggctcagtccttggtgatctaagacagcaaagaagtgtgcaaggagggccctgttagctcccactgtcctggtttctcctcctggagtctaatttccttggccctctgagccttttgagtctgggccctggtccaatgctgctgttgtctgaggaatggtttggtgagaacagatgttagaacttgtttgttgattcttgtctggctaataaatcatcaccaactgccttctcctacaggga

SEQ ID NO: 3836 - DNA, 1658 bp, Homo sapiens
cgtgagtcctcgccagaactaaggctgtgggtaaggcgacatttcctgcccccggggccagggtgagaggagagatgatgagttgctgagtgtgcacacctttccggaacacatacacacaccctgctctgggatcccttgtgaggctgccctcatggagttccccctggcccagatatgtccccaagggagtcacgaagcccccatcccaaccttcagcaccttccagatcacagacatgacccgcaggagctgccagaacctgggctacactgcggcatctccccaggccccggaggctgcctccaacacagggaatgctgagagggcagaggaggtgcctggagaaggaagcctgttcctgcaggccgagacccgggcttggttccagaagacccaggcccactggctcctgcagcacggggcagcccctgcctggttccatggcttcatcacccggagggaggcagagaggctgctggagcccaagcctcaggggtgctacttggtgcggttcagcgagagcgcggtgaccttcgtgctgacttacaggagccggacttgctgccgccacttcctgctggcccagctcagggacgggcgccacgtggtgctgggcgaggacagcgcccacgcgcggctgcaggacctgctgctgcactacaccgcgcacccgctcagcccctacggggagacgctcaccgagcccctcgcccgacagactcctgagcctgcaggactttccctgaggaccgaagaatcaaactttggaagcaaaagccaggacccaaacccccagtacagcccaatcatcaaacaggggcaagccccagtcccgatgcagaaagagggggccggggagaaggagccctcccagctgctcaggcccaagcctcccatccccgccaaacctcagctgcccccagaagtctacacaatccctgttccacgacaccgcccggccccacgccccaagccctccaatcctatctacaatgagcctgatgaacccatagctttctatgccatgggccggggcagccctggggaagcccccagcaacatctatgtggaagtggaagatgagggcctacccgccacccttgggcaccctgtcctacggaagagctggtccaggcctgtcccaggaggccagaatacaggtggctcccagctgcattctgagaactctgtgattgggcaaggccctcccctgccccaccagcccccacccgcctggagacacaccctcccccacaatctttctagacaggtgcttcaggacagaggacaggcatggcttccccttgggcctcctcagtaggcggtctggcctgacccccaacaaagaagcctggaggtcagagaagcaaatgcggagcctgctccctcctaagaagatcccaagaatccaatggctcagtccttggtgatctaagacagcaaagaagtgtgcaaggagggccctgttagctcccactgtcctggtttctcctcctggagtctaatttccttggccctctgagccttttgagtctgggccctggtccaatgctgctgttgtctgaggaatggtttggtgagaacagatgttagaacttgtttgttgattcttgtctggctaataaatcatcaccaactgccttctcctacaggga

SEQ ID NO: 3837 - DNA, 1673 bp, Homo sapiens
agaactaaggctgtgggtaaggcgacatttcctgcccccggggccagggtgagaggagagatgatgagttgctgagtgtgcacacctttccggaacacatacacacaccctgctctgggatcccttgtgaggctgccctcatggagttccccctggcccagatatgtccccaagggagtcacgaagcccccatcccaaccttcagcaccttccagatcacagacatgacccgcaggagctgccagaacctgggctacactgcggcatctccccaggccccggaggctgcctccaacacagggaatgctgagagggcagaggaggtgcctggagaaggaagcctgttcctgcaggccgagacccgggcttggttccagaagacccaggcccactggctcctgcagcacggggcagcccctgcctggttccatggcttcatcacccggagggttcggccccctctctccgtcacccacagggaggcagagaggctgctggagcccaagcctcaggggtgctacttggtgcggttcagcgagagcgcggtgaccttcgtgctgacttacaggagccggacttgctgccgccacttcctgctggcccagctcagggacgggcgccacgtggtgctgggcgaggacagcgcccacgcgcggctgcaggacctgctgctgcactacaccgcgcacccgctcagcccctacggggagacgctcaccgagcccctcgcccgacagactcctgagcctgcaggactttccctgaggaccgaagaatcaaactttggaagcaaaagccaggacccaaacccccagtacagcccaatcatcaaacaggggcaagccccagtcccgatgcagaaagagggggccggggagaaggagccctcccagctgctcaggcccaagcctcccatccccgccaaacctcagctgcccccagaagtctacacaatccctgttccacgacaccgcccggccccacgccccaagccctccaatcctatctacaatgagcctgatgaacccatagctttctatgccatgggccggggcagccctggggaagcccccagcaacatctatgtggaagtggaagatgagggcctacccgccacccttgggcaccctgtcctacggaagagctggtccaggcctgtcccaggaggccagaatacaggtggctcccagctgcattctgagaactctgtgattgggcaaggccctcccctgccccaccagcccccacccgcctggagacacaccctcccccacaatctttctagacaggtgcttcaggacagaggacaggcatggcttccccttgggcctcctcagtaggcggtctggcctgacccccaacaaagaagcctggaggtcagagaagcaaatgcggagcctgctccctcctaagaagatcccaagaatccaatggctcagtccttggtgatctaagacagcaaagaagtgtgcaaggagggccctgttagctcccactgtcctggtttctcctcctggagtctaatttccttggccctctgagccttttgagtctgggccctggtccaatgctgctgttgtctgaggaatggtttggtgagaacagatgttagaacttgtttgttgattcttgtctggctaataaatcatcaccaactgccttctcctacaggg

SEQ ID NO: 3838 - DNA, 5356 bp, Homo sapiens
cacaaatctgtgattacctggcgggtgaaccgctccggtggcggggagagcgggctcccagcgctgggtaggggccgggttccggcgagcgccatcccggagcgtcagtttcccagtttgggaagtgaggagaacctgcctcgcccttccccgccaaggcttagggaagtgtggctgtccagctgggctgagtcgcccaagaaggacgtgacaggtgccgacgccaccgccgagcccatgatcctggaacagtacgtggtggtgtccaactataagaagcaggagaactcggagctgagcctccaggccggggaggtggtggatgtcatcgagaagaacgagagcggctggtggttcgtgagcacttctgaggagcagggctgggtccctgccacctacctggaggcccagaatggtactcgggatgactccgacatcaacacctctaagactggagaagaggagaagtatgtcaccgtgcagccttacaccagccaaagcaaggacgagattggctttgagaagggcgtcacagtggaggtgatccggaagaatctggaaggctggtggtatatcagatacctgggcaaagagggctgggcgccagcatcctacctgaagaaggccaaggatgacctgccaacccggaagaagaacctggccggcccagtggagatcattgggaacatcatggagatcagcaacctgctgaacaagaaggcgtctggggacaaggaaactccaccagccgaaggcgagggccatgaggcccccattgccaagaaggagatcagcctgcccatcctctgcaatgcctccaatggcagtgccgtgggcgttcctgacaggactgtctccaggctggcccagggctctccagctgtggccaggattgcccctcagcgggcccagatcagctccccgaacctacggacaagacctccaccacgcagagaatccagcctggggttccaactgccaaagccaccagagcccccttctgttgaggtggagtactacaccattgccgaattccagtcgtgcatttccgatggcatcagctttcggggtggacagaaggcagaggtcattgataagaactcaggtggctggtggtacgtgcagatcggtgagaaggagggctgggcccccgcatcatacatcgataagcgcaagaagcccaacctgagccgccgcacaagcacgctgacccggcccaaggtgcccccgccagcaccccccagcaagcccaaggaggccgaggagggccctacgggggccagtgagagccaggactccccgcggaagctcaagtatgaggagcctgagtatgacatccctgcattcggctttgactcagagcctgagctgagcgaggagcccgtggaggacagagcctcaggggagaggcggcctgcccagccccaccggccctcgccggcctcttctctgcagcgggcccgcttcaaggtgggtgagtcttcagaggatgtggccctggaagaggagaccatctatgagaatgagggcttccggccatatgcagaggacaccctgtcagccagaggctcctccggggacagcgactccccaggcagctcctcgctgtccctgaccaggaaaaactcccccaaatcaggctcccccaagtcatcatcactcctaaagctcaaggcagagaagaatgcccaggcagaaatggggaagaaccactcctcagcctccttttcctcatccatcaccatcaacaccacttgctgctcctcctcttcctcctcctcctcttccttgtccaaaaccagtggcgacctgaagccccgctctgcttcggacgcaggcatccgcggcactcccaaggtcagggcaaagaaggatgctgatgcgaacgctgggctgacctcctgtccccgggccaagccatcggtccggcccaagccattcctaaaccgagcagagtcgcagagccaagagaagatggacatcagcactttacggcgccagctgagacccacaggccagctccgtggagggctcaagggctccaagagtgaggattcggagctgcccccgcagacggcctccgaggctcccagtgaggggtctaggagaagctcatccgacctcatcaccctcccagccaccactcccccatgtcccaccaagaaggaatgggaagggccagccacctcgtacatgacatgcagcgcctaccagaaggtccaggactcggagatcagcttccccgcgggcgtggaggtgcaggtgctggagaagcaggagagcgggtggtggtatgtgaggtttggggagctggagggctgggccccttcccactatttggtgctggatgagaacgagcaacctgacccctctggcaaagagctggacacagtgcccgccaagggcaggcagaacgaaggcaaatcagacagcctggagaagatcgagaggcgcgtccaagcactgaacaccgtcaaccagagcaagaaggccacgccccccatcccctccaaacctcccgggggcttcggcaagacctcaggcactccagcggtgaagatgaggaacggagtgcggcaggtggcggtcaggccccagtcggtgtttgtgtccccgccacccaaggacaacaacctgtcctgcgccctgcggaggaatgagtcactcacggccactgatggcctccgaggcgtccgacggaactcctcctttagcactgctcgctccgctgccgccgaggccaagggccgcctggccgaacgggctgccagccagggttcagactcacccctactgcccgcccagcgcaacagcatacccgtgtcccctgtgcgccccaagcccatcgagaagtctcagttcatccacaataacctcaaagatgtgtacgtctctatcgcagactacgagggggatgaggagacagcaggcttccaggagggggtgtccatggaggttctggagaggaaccctaatggctggtggtactgccagatcctggatggtgtgaagcccttcaaaggctgggtgccttccaactaccttgagaaaaagaactagcagagggcctgggctcttccagcctcagtgtgcctctctggccgcccactggatgagcggtgagacgaacaaaagggaaaggaaaaaatgggggtggggggtggggggtggacaacattcaacactgcagaatgggtgacctcaaagatgccccctgtccaagccatcccacagctggaaggtaggggatgggggtgcccacactgagtgaggaagggaatggaccagggagtcccaggcctgggacccagagccaagaaagctgagatatcctgtgcaccatagggacttcaccaatggattacatgccatctgggacaggccatgtgggagaccccagttgtgcctttgctacagatctggaaaagacaaggtcatgggggcctccagtgtcctgcccctgcttggcccagttttgattgctggcatcttgccaccccaggtatccctggtattgtcctaagctgtatttgtgaattgtgctggtttcctgggcattgccacgcctaccacaggtgggtacattagaagccaccactggctttcaggcttgggggtgtcttctgagctcaagcctgcttctgggccaggccattgtcactgttagttgaagaaaaagcagttcccaggtgccagcaaagaccatctttcataactgtcactgtcttggccttgagaagagagcccgctctccgtggggcaccccatggaggacacagtaccagagtttacagagagggtgggcgaagccaccggtctcttcctaatctgcacagactattttgggtatttctgggcgggcagttcctttgcatgtttcgggagaggtttgttgatttggggcttatatgtcaggcctttggtttgcgtcttattttaggggttgtttgggggcctgggtggtcggcctcacatgggaaggggatgggtagtggatggggtttctgttgtatcttgtgggcgggtgattttgcttttgtttttgtttcacattcttccccctccacaagccaaagtcgtttcatttggtttccactgtgtggactgtgctggagcttggcgcctgccagaaaaatttggggctaggcaagccccaggttgcagacatggtgaagcagagaaactgttcttctggttcctgcacaacctcagaggggcaaaaaccctccccaggaaggaggagggtgttcaggagccagacttttggagagaaggcagctcccagcctgctgggtgaccgccattctgcgtgtgttccccagctgggcagggctggaagccttacgtatgaagcatggagaagcagccattgtccccactatgggcagaggggggacccggctggccccttgggtcagactggagccaacaccgccagccaccccctctggcctgctggcaatgccacaggtgcccaagaagatggaggatccctgtgccaggagccaacctggtcttcccgagggtcagtgccccagtgaagacagaagcgagagaataaagttccctgtaggtcctctgtcacctttgggttgtgtttttcaattgttgacatttcagaggggaccctccagaagcccagccggcttcccccaaggactcccccttcgctgggagtggatttccacacgtgcctttgatttcggacagattgggcctcacagccaccgattcagctgccagggtccctggactgggggttggtgttttctatagaggaggaaaggccctccctcaccctgctccccacccaggcagggcagcatgggacccagtgtctcagtgccttcaaaacccacccccacccctaccctaccccaccacaccccatcccagaggccttgcctgggcaaccctaagcccctgtccctcgccatacactgatgcctggcagctagagcaaatggctcgtgttctttgtcgaaggcctgtggtgagattgttttgtttccttttgttttgtgagtttgtttaaaattgaaattagttattttcttctgctggacagtattaaatagagcaggatgttgagttaatctgctagattgcagtactaatggtagtggtttagtgtcttcatgttaatattatttgtacttatttgaacaataatgataaagaagtggttcattattttttaattaatgcactttaaataaggtagaatggaaaaaacccagagagcaaagtgcattacttaaagatgcagtatatacttttctcatttttaaacagcacatatttattaagagaaaaaaagtaatttatgactatttaaaataaaatttaaaagtag

SEQ ID NO: 3839 - DNA, 11245 bp, Homo sapiens
ccgggagtccgggcagcgttcggcgcgccgggccggggtggcgggcggccccgggaccccggcagctggagaaggagccggagcccggccgggatgagaaggtgacgccgccgggggcgccactcgctttgtgggggaagatgctcgcctactgcgtgcaggatgccaccgtggtggacgtggagaagcggaggaacccctccaagcactacgtatacataatcaatgtgacctggtctgactccacctcccagactatctaccggaggtacagcaagttctttgacctgcagatgcagcttttggataagtttcccattgaaggtggccagaaggaccccaagcaaaggatcatccccttcctcccaggcaagatcctcttccgcagaagccacatccgggacgtagctgtgaagagactgaagcccatcgatgaatactgccgggcacttgtccggctgcccccccacatctcacagtgtgacgaagtcttccggttcttcgaggctcgacccgaggatgtcaaccctccaaaagaggactatggcagttccaagaggaaatcagtgtggctgtccagctgggctgagtcgcccaagaaggacgtgacaggtgccgacgccaccgccgagcccatgatcctggaacagtacgtggtggtgtccaactataagaagcaggagaactcggagctgagcctccaggccggggaggtggtggatgtcatcgagaagaacgagagcggctggtggttcgtgagcacttctgaggagcagggctgggtccctgccacctacctggaggcccagaatggtactcgggatgactccgacatcaacacctctaagactggagaagaggagaagtatgtcaccgtgcagccttacaccagccaaagcaaggacgagattggctttgagaagggcgtcacagtggaggtgatccggaagaatctggaaggctggtggtatatcagatacctgggcaaagagggctgggcgccagcatcctacctgaagaaggccaaggatgacctgccaacccggaagaagaacctggccggcccagtggagatcattgggaacatcatggagatcagcaacctgctgaacaagaaggcgtctggggacaaggaaactccaccagccgaaggcgagggccatgaggcccccattgccaagaaggagatcagcctgcccatcctctgcaatgcctccaatggcagtgccgtgggcgttcctgacaggactgtctccaggctggcccagggctctccagctgtggccaggattgcccctcagcgggcccagatcagctccccgaacctacggacaagacctccaccacgcagagaatccagcctggggttccaactgccaaagccaccagagcccccttctgttgaggtggagtactacaccattgccgaattccagtcgtgcatttccgatggcatcagctttcggggtggacagaaggcagaggtcattgataagaactcaggtggctggtggtacgtgcagatcggtgagaaggagggctgggcccccgcatcatacatcgataagcgcaagaagcccaacctgagccgccgcacaagcacgctgacccggcccaaggtgcccccgccagcaccccccagcaagcccaaggaggccgaggagggccctacgggggccagtgagagccaggactccccgcggaagctcaagtatgaggagcctgagtatgacatccctgcattcggctttgactcagagcctgagctgagcgaggagcccgtggaggacagagcctcaggggagaggcggcctgcccagccccaccggccctcgccggcctcttctctgcagcgggcccgcttcaaggtgggtgagtcttcagaggatgtggccctggaagaggagaccatctatgagaatgagggcttccggccatatgcagaggacaccctgtcagccagaggctcctccggggacagcgactccccaggcagctcctcgctgtccctgaccaggaaaaactcccccaaatcaggctcccccaagtcatcatcactcctaaagctcaaggcagagaagaatgcccaggcagaaatggggaagaaccactcctcagcctccttttcctcatccatcaccatcaacaccacttgctgctcctcctcttcctcctcctcctcttccttgtccaaaaccagtggcgacctgaagccccgctctgcttcggacgcaggcatccgcggcactcccaaggtcagggcaaagaaggatgctgatgcgaacgctgggctgacctcctgtccccgggccaagccatcggtccggcccaagccattcctaaaccgagcagagtcgcagagccaagagaagatggacatcagcactttacggcgccagctgagacccacaggccagctccgtggagggctcaagggctccaagagtgaggattcggagctgcccccgcagacggcctccgaggctcccagtgaggggtctaggagaagctcatccgacctcatcaccctcccagccaccactcccccatgtcccaccaagaaggaatgggaagggccagccacctcgtacatgacatgcagcgcctaccagaaggtccaggactcggagatcagcttccccgcgggcgtggaggtgcaggtgctggagaagcaggagagcgggtggtggtatgtgaggtttggggagctggagggctgggccccttcccactatttggtgctggatgagaacgagcaacctgacccctctggcaaagagctggacacagtgcccgccaagggcaggcagaacgaaggcaaatcagacagcctggagaagatcgagaggcgcgtccaagcactgaacaccgtcaaccagagcaagaaggccacgccccccatcccctccaaacctcccgggggcttcggcaagacctcaggcactccagcggtgaagatgaggaacggagtgcggcaggtggcggtcaggccccagtcggtgtttgtgtccccgccacccaaggacaacaacctgtcctgcgccctgcggaggaatgagtcactcacggccactgatggcctccgaggcgtccgacggaactcctcctttagcactgctcgctccgctgccgccgaggccaagggccgcctggccgaacgggctgccagccagggttcagactcacccctactgcccgcccagcgcaacagcatacccgtgtcccctgtgcgccccaagcccatcgagaagtctcagttcatccacaataacctcaaagatgtgtacgtctctatcgcagactacgagggggatgaggagacagcaggcttccaggagggggtgtccatggaggttctggagaggaaccctaatggctggtggtactgccagatcctggatggtgtgaagcccttcaaaggctgggtgccttccaactaccttgagaaaaagaactagcagagggcctgggctcttccagcctcagtgtgcctctctggccgcccactggatgagcggtgagacgaacaaaagggaaaggaaaaaatgggggtggggggtggggggtggacaacattcaacactgcagaatgggtgacctcaaagatgccccctgtccaagccatcccacagctggaaggtaggggatgggggtgcccacactgagtgaggaagggaatggaccagggagtcccaggcctgggacccagagccaagaaagctgagatatcctgtgcaccatagggacttcaccaatggattacatgccatctgggacaggccatgtgggagaccccagttgtgcctttgctacagatctggaaaagacaaggtcatgggggcctccagtgtcctgcccctgcttggcccagttttgattgctggcatcttgccaccccaggtatccctggtattgtcctaagctgtatttgtgaattgtgctggtttcctgggcattgccacgcctaccacaggtgggtacattagaagccaccactggctttcaggcttgggggtgtcttctgagctcaagcctgcttctgggccaggccattgtcactgttagttgaagaaaaagcagttcccaggtgccagcaaagaccatctttcataactgtcactgtcttggccttgagaagagagcccgctctccgtggggcaccccatggaggacacagtaccagagtttacagagagggtgggcgaagccaccggtctcttcctaatctgcacagactattttgggtatttctgggcgggcagttcctttgcatgtttcgggagaggtttgttgatttggggcttatatgtcaggcctttggtttgcgtcttattttaggggttgtttgggggcctgggtggtcggcctcacatgggaaggggatgggtagtggatggggtttctgttgtatcttgtgggcgggtgattttgcttttgtttttgtttcacattcttccccctccacaagccaaagtcgtttcatttggtttccactgtgtggactgtgctggagcttggcgcctgccagaaaaatttggggctaggcaagccccaggttgcagacatggtgaagcagagaaactgttcttctggttcctgcacaacctcagaggggcaaaaaccctccccaggaaggaggagggtgttcaggagccagacttttggagagaaggcagctcccagcctgctgggtgaccgccattctgcgtgtgttccccagctgggcagggctggaagccttacgtatgaagcatggagaagcagccattgtccccactatgggcagaggggggacccggctggccccttgggtcagactggagccaacaccgccagccaccccctctggcctgctggcaatgccacaggtgcccaagaagatggaggatccctgtgccaggagccaacctggtcttcccgagggtcagtgccccagtgaagacagaagcgagagaataaagttccctgtaggtcctctgtcacctttgggttgtgtttttcaattgttgacatttcagaggggaccctccagaagcccagccggcttcccccaaggactcccccttcgctgggagtggatttccacacgtgcctttgatttcggacagattgggcctcacagccaccgattcagctgccagggtccctggactgggggttggtgttttctatagaggaggaaaggccctccctcaccctgctccccacccaggcagggcagcatgggacccagtgtctcagtgccttcaaaacccacccccacccctaccctaccccaccacaccccatcccagaggccttgcctgggcaaccctaagcccctgtccctcgccatacactgatgcctggcagctagagcaaatggctcgtgttctttgtcgaaggcctgtggtgagattgttttgtttccttttgttttgtgagtttgtttaaaattgaaattagttattttcttctgctggacagtattaaatagagcaggatgttgagttaatctgctagattgcagtactaatggtagtggtttagtgtcttcatgttaatattatttgtacttatttgaacaataatgataaagaagtggttcattattttttaattaatgcactttaaataaggtagaatggaaaaaacccagagagcaaagtgcattacttaaagatgcagtatatacttttctcatttttaaacagcacatatttattaagagaaaaaaagtaatttatgactatttaaaataaaatttaaaagtagagtgactgtcaggtaaagaaccttcaatgtagctatcttccagggggagggccctgcagcctcgctcctcagatgtctgcactgagccagttcagtcactagtgcgccagccaggccaggagggagtgcagagcatgtctgccaagcacagagcatctcagttggactggaccacagtgctcccgagagcctgcctttcctgcccttccccaccacctgcactgccccccacattctcccagccccccccaaggaccccctctccttgacccccagtgctgtaagtaatagagtcattaaaatgcaggactgaaagagacctcagaggtctctatcccatcccttcctgttactgcggcccaaggacaggaaacaacttttccaaaatcccacagctagttaatgacagatctccccactacattaatcccgtgctcctcctcactgccattatagtttattgtgtggtcatgtttacattgtgacatccagccccaaggatggctgggagttgctcaggcatccaggaaaagtggggaatgctgccatctggtgacagcatgtagatttgggcagtgaacagggattgccatgccccagtcttcgcacctcgccccctcaccccctaactcacagcacaaaccctgcaaacccaaagagaatattaatacttgaagcaagaagggtgcatgccagtccttctccgacatggccagggggtaccaggccttgtgcgcctggcctcctagccctagccagggcgagagggcctttcccttgagctactgagctgctttgtgatgctgaaggatactgccggcagcaggcagaggagggagggggcctagggctctgacccatctggaggaaaaccagatcggactaaaaaaggaaaaagaaaaacaaaatctccgcagtgtccaaacctagtttcccatgagttgcgactgaaaatgtgaaacgacactgtattgctgtatactgcaactttaaccataatgagcccttctgaggtcattattgaggttcatataatgcccgaagatgcagcatttggtgctttgttttcctttccgtttcaagacctttttcttttattgcaaggggaaaaaaatgtcatctccccccacctcatccctctttgtgacagcagacctggctgtgttgcccctctcctcctcactattctcaccaggccatgggactttgggggcagtgagagagagctggaaaggggcaaccctgagcagcaggtgtgccccatgccctgtgggtttcccctatgtccaatgactgtagacgggctgtcttgccaggcctcagccccgtctaccctaagcctggccccaaaggtttctctttcttcctccttgattttccatcttgacgaaggcattatatagaatcattttaatcactttcagatgttagagcagcgtattttacaggcatttatatccattgctttcctcagcaaggcatgttactacttttatcatctaaggaaaaaagacaagggaattccagtcaggcattattttcctattactagtgtttgcagaataggtgtaggactatttaagtttagaccttggtttggtagttcttgtttttaataaggggaaaaagataaaataacccctatttttcctgttattgtatttaactaatatattatttctttaaggttactcacttcccctacccctccaaataccttgcattctcaatcaaaaatggaaacaatctgagagacaggaaaagtgcaatattaccaagatggatgccagggctcattggggacaatggagggaataccagtggcgctcagagagcaagaggcagggagcggggtgctgaaggaatcctagctgtggaacaggtgggtgggttggtggagtttgatcttgtggcgttctcctctcccccttctttgggaagatgataggggtccctgccagatccacccagaagaaagggattcaggcatggggcccttgacctctaggccccagtccctggagcagaggcaggccctcgggagctgttccttgttttgatttctgttgtggtgcagccagctgctcagagagacctggcctaaaaatgactcccagcagccctctctcaccccagtgtcctgatatttgggctgtgatccttctggtgtatgtttgaatctttctaaaactgggtgccctcagttcagtttctaggcaggaagcctagaagtcaccagatctttttgggggatgtgagaaccttgagccgcgcacaccctggtgagacaccaattcccacaagcctgcagcagggcctggggctgagcctgggctgcccattcatctcagcgacttcagcctgagaagtgagccctgcctgggctccacacccagagagtccatacaaattctgctccgggaagagtcggggggtctattcaagtttctctgcagacaaaacttcccacaacaggtaccaatctggcctccttcctcagcaccggtagagaaagcaacagaatgggaagtttcctctgggttggagcctcagagctctgcccctcaaggtgacagggacgtccctgtggcttgttccctccacctccagtactgtatgcttgctacttcaaccccctatttggtgaatttctgcacagacacagatctctgtgcctggaatgggactgtgccctgtgcgggtctctcccttggcgtatatccatctagatatttagtctttgagaatctcaaagcagagctctctgggaagagaactgtccacattgctaaataattaagattccctcacttttttgagggccatgtgttgtgagagagagagagagagagagagtgtgtgtgtgtgtgtgtgtgtgtgtgtgtctgtgtatgcaagtgttggtaacttcccacttgaactaaataacatggggttagagaaaaaaaaataccaggcaagctgtctccattgaacaagtccttggcaatgggcaggtcccaagggactcacagcttctggcagcaagtgtgtcattcacacacatcattctggctggagagtgcaatgtgtcatttttttttctttttgtaattattttattaagtatttagttggaaatttcacactggcattaacaggtctagcataagtggcctaggcagtcatcccaggctccaaaatgaagatgtgcaaaagagatgccactgggaatagaaacactgagttggttcagttaggtcatcccctgcagacgtgtcatcgagcaggctgactcccacccctcagccatgccatgggtatgagaagccccttataatgaaagctgccagccctttcgtccttgtttcagagggtgggtcaggtggttggggtgagaacttgctcacggtgcacccaacaagacctgcaggtgcatataagtttagtcccaactgcagggccagaccaaacacttcctgggaagtgtgtggagggctgtgctagaccttcctgagtttctggctaaatcatcagccctgtttggtgcagtctcatgtctctgtggttcccaagctgcatgatcagagccagtgagaagacaggatcagtgacccacagctttggggaaaaacagccccactgttaacttccctcctgcaaacctgggtccccaggccataaggtgggcacactggtgcttacagactgggtggagagccctaccttccaaggtcttgatcccagcctgcctataaggttgggattagcatgcaatcccccttccccaatcctgtctttttaaaatctcaagtttgcacttaaccttgacaacagcaccctctcctactccagtcctagaactcagtggccttagagaatggggtcccctgcactgaaggtccccgccttgctcccagttccatcctggccaataggctgcgcctcaagaggtgaaagagaaaaaagggagggagggaggaagaattatttagaacaaaaggatggctcgagcacgttagaggcaagtgagaggcacgttggtgagaagagcatgtgcatgtttggggtagctggggcctactgtcccttcattagggaaggaggcttccagaagcggatgtcttctagaaagaaaaattgtgtgaaggctgaaaaggggcttggagttttgtctttgttgattagaaagaaggaagaagtcagctctgagtgtttcaggaagaagagagcaggtagaaagggaatttagtgatttaacacccaagggtccagccatagcaggttggaaaatcctccaaatttggccacagaaactggctaggaaaaaactgccactcattgggccacacgctgggtccccatcagttctcaatgaatggtcattgatttacttagcagagagaagtcaccagccacaaaccaatctttgagtttgcaggccctgattccagaatatatgcatccagctcccgggttctcagctggttttgcccacttccctttgactgtccaatccaaagccagtctctcaagttgtatggctcaaagagcagtgaccacaatgggtcatacagtagggacccacctccacaaattagaaccagagttcagactccattgggcacatctgggaggaaggcaacctcctttgtcgtcttgttggtaccagtcattctcaagtatctctgacacctgtggtggttcagtttgctgagcctgccacctggtatgaattagactgggtgtgatgaacattcatccatggatataccctaccattttgcgttgccttataaccaaggcacactccccataagagtttactgcagagaaagaacagcaaaacagccaccctccttgaatttacaactcattatctgcaacaggttttctttaaatccaagacacaggatgggaaatgggtttccccaccaggtactcagaggtctgcaggaagtgactcccgggcaaggcagacttcagtaatccctgaagcgtgagcatgtggactgcatggctgggtggggactggtggatgtctctggagctccagaaccttggagaattcctcatggaattcccctcccagctcttagtgggctctgtggggtcaggaggagcccttcctccaggttttccttctttcctcctcagcagagaaactggagaaaggacattaaactcagtgcagtcgatttgagtgctgaaatatttccagaatcaatggtggtgctaaactatctccatgtttctagcatttttaatagtggagttggtttgtttttaatctcatcacaaaaatgcagtgcccttggggaagggaccagccccttggcctgccactttccaggtgtcctttatcactttgacgggactctttggtctgcagaaaatgctctgtcttggcatgcttctagactgtaagatttgggttttgttttgtattttatgtttacatgcatcttatatttccctgaaaactaaataaagttttgggcctttttaaccg

SEQ ID NO: 3840 - DNA, 11468 bp, Homo sapiens
gcgagcgggcgagcgcagcgcggcggccgcgcgggagtgaaggggcgcgcggcaggccggcggggagtcccccggggcgcacggagcccgcgcgccctccgggaccctcccccgtccctgggccggacctgtgggcgccgggagtccgggcagcgttcggcgcgccgggccggggtggcgggcggccccgggaccccggcagctggagaaggagccggagcccggccgggatgagaaggtgacgccgccgggggcgccactcgctttgtgggggaagatgctcgcctactgcgtgcaggatgccaccgtggtggacgtggagaagcggaggaacccctccaagcactacgtatacataatcaatgtgacctggtctgactccacctcccagactatctaccggaggtacagcaagttctttgacctgcagatgcagcttttggataagtttcccattgaaggtggccagaaggaccccaagcaaaggatcatccccttcctcccaggcaagatcctcttccgcagaagccacatccgggacgtagctgtgaagagactgaagcccatcgatgaatactgccgggcacttgtccggctgcccccccacatctcacagtgtgacgaagtcttccggttcttcgaggctcgacccgaggatgtcaaccctccaaaagaggactatggcagttccaagaggaaatcagtgtggctgtccagctgggctgagtcgcccaagaaggacgtgacaggtgccgacgccaccgccgagcccatgatcctggaacagtacgtggtggtgtccaactataagaagcaggagaactcggagctgagcctccaggccggggaggtggtggatgtcatcgagaagaacgagagcggctggtggttcgtgagcacttctgaggagcagggctgggtccctgccacctacctggaggcccagaatggtactcgggatgactccgacatcaacacctctaagactggagaagtgtccaagagacgcaaggcccatctgcggcgcctggatcgccggtggaccctgggcgggatggtcaacaggcagcacagccgagaggagaagtatgtcaccgtgcagccttacaccagccaaagcaaggacgagattggctttgagaagggcgtcacagtggaggtgatccggaagaatctggaaggctggtggtatatcagatacctgggcaaagagggctgggcgccagcatcctacctgaagaaggccaaggatgacctgccaacccggaagaagaacctggccggcccagtggagatcattgggaacatcatggagatcagcaacctgctgaacaagaaggcgtctggggacaaggaaactccaccagccgaaggcgagggccatgaggcccccattgccaagaaggagatcagcctgcccatcctctgcaatgcctccaatggcagtgccgtgggcgttcctgacaggactgtctccaggctggcccagggctctccagctgtggccaggattgcccctcagcgggcccagatcagctccccgaacctacggacaagacctccaccacgcagagaatccagcctggggttccaactgccaaagccaccagagcccccttctgttgaggtggagtactacaccattgccgaattccagtcgtgcatttccgatggcatcagctttcggggtggacagaaggcagaggtcattgataagaactcaggtggctggtggtacgtgcagatcggtgagaaggagggctgggcccccgcatcatacatcgataagcgcaagaagcccaacctgagccgccgcacaagcacgctgacccggcccaaggtgcccccgccagcaccccccagcaagcccaaggaggccgaggagggccctacgggggccagtgagagccaggactccccgcggaagctcaagtatgaggagcctgagtatgacatccctgcattcggctttgactcagagcctgagctgagcgaggagcccgtggaggacagagcctcaggggagaggcggcctgcccagccccaccggccctcgccggcctcttctctgcagcgggcccgcttcaaggtgggtgagtcttcagaggatgtggccctggaagaggagaccatctatgagaatgagggcttccggccatatgcagaggacaccctgtcagccagaggctcctccggggacagcgactccccaggcagctcctcgctgtccctgaccaggaaaaactcccccaaatcaggctcccccaagtcatcatcactcctaaagctcaaggcagagaagaatgcccaggcagaaatggggaagaaccactcctcagcctccttttcctcatccatcaccatcaacaccacttgctgctcctcctcttcctcctcctcctcttccttgtccaaaaccagtggcgacctgaagccccgctctgcttcggacgcaggcatccgcggcactcccaaggtcagggcaaagaaggatgctgatgcgaacgctgggctgacctcctgtccccgggccaagccatcggtccggcccaagccattcctaaaccgagcagagtcgcagagccaagagaagatggacatcagcactttacggcgccagctgagacccacaggccagctccgtggagggctcaagggctccaagagtgaggattcggagctgcccccgcagacggcctccgaggctcccagtgaggggtctaggagaagctcatccgacctcatcaccctcccagccaccactcccccatgtcccaccaagaaggaatgggaagggccagccacctcgtacatgacatgcagcgcctaccagaaggtccaggactcggagatcagcttccccgcgggcgtggaggtgcaggtgctggagaagcaggagagcgggtggtggtatgtgaggtttggggagctggagggctgggccccttcccactatttggtgctggatgagaacgagcaacctgacccctctggcaaagagctggacacagtgcccgccaagggcaggcagaacgaaggcaaatcagacagcctggagaagatcgagaggcgcgtccaagcactgaacaccgtcaaccagagcaagaaggccacgccccccatcccctccaaacctcccgggggcttcggcaagacctcaggcactccagcggtgaagatgaggaacggagtgcggcaggtggcggtcaggccccagtcggtgtttgtgtccccgccacccaaggacaacaacctgtcctgcgccctgcggaggaatgagtcactcacggccactgatggcctccgaggcgtccgacggaactcctcctttagcactgctcgctccgctgccgccgaggccaagggccgcctggccgaacgggctgccagccagggttcagactcacccctactgcccgcccagcgcaacagcatacccgtgtcccctgtgcgccccaagcccatcgagaagtctcagttcatccacaataacctcaaagatgtgtacgtctctatcgcagactacgagggggatgaggagacagcaggcttccaggagggggtgtccatggaggttctggagaggaaccctaatggctggtggtactgccagatcctggatggtgtgaagcccttcaaaggctgggtgccttccaactaccttgagaaaaagaactagcagagggcctgggctcttccagcctcagtgtgcctctctggccgcccactggatgagcggtgagacgaacaaaagggaaaggaaaaaatgggggtggggggtggggggtggacaacattcaacactgcagaatgggtgacctcaaagatgccccctgtccaagccatcccacagctggaaggtaggggatgggggtgcccacactgagtgaggaagggaatggaccagggagtcccaggcctgggacccagagccaagaaagctgagatatcctgtgcaccatagggacttcaccaatggattacatgccatctgggacaggccatgtgggagaccccagttgtgcctttgctacagatctggaaaagacaaggtcatgggggcctccagtgtcctgcccctgcttggcccagttttgattgctggcatcttgccaccccaggtatccctggtattgtcctaagctgtatttgtgaattgtgctggtttcctgggcattgccacgcctaccacaggtgggtacattagaagccaccactggctttcaggcttgggggtgtcttctgagctcaagcctgcttctgggccaggccattgtcactgttagttgaagaaaaagcagttcccaggtgccagcaaagaccatctttcataactgtcactgtcttggccttgagaagagagcccgctctccgtggggcaccccatggaggacacagtaccagagtttacagagagggtgggcgaagccaccggtctcttcctaatctgcacagactattttgggtatttctgggcgggcagttcctttgcatgtttcgggagaggtttgttgatttggggcttatatgtcaggcctttggtttgcgtcttattttaggggttgtttgggggcctgggtggtcggcctcacatgggaaggggatgggtagtggatggggtttctgttgtatcttgtgggcgggtgattttgcttttgtttttgtttcacattcttccccctccacaagccaaagtcgtttcatttggtttccactgtgtggactgtgctggagcttggcgcctgccagaaaaatttggggctaggcaagccccaggttgcagacatggtgaagcagagaaactgttcttctggttcctgcacaacctcagaggggcaaaaaccctccccaggaaggaggagggtgttcaggagccagacttttggagagaaggcagctcccagcctgctgggtgaccgccattctgcgtgtgttccccagctgggcagggctggaagccttacgtatgaagcatggagaagcagccattgtccccactatgggcagaggggggacccggctggccccttgggtcagactggagccaacaccgccagccaccccctctggcctgctggcaatgccacaggtgcccaagaagatggaggatccctgtgccaggagccaacctggtcttcccgagggtcagtgccccagtgaagacagaagcgagagaataaagttccctgtaggtcctctgtcacctttgggttgtgtttttcaattgttgacatttcagaggggaccctccagaagcccagccggcttcccccaaggactcccccttcgctgggagtggatttccacacgtgcctttgatttcggacagattgggcctcacagccaccgattcagctgccagggtccctggactgggggttggtgttttctatagaggaggaaaggccctccctcaccctgctccccacccaggcagggcagcatgggacccagtgtctcagtgccttcaaaacccacccccacccctaccctaccccaccacaccccatcccagaggccttgcctgggcaaccctaagcccctgtccctcgccatacactgatgcctggcagctagagcaaatggctcgtgttctttgtcgaaggcctgtggtgagattgttttgtttccttttgttttgtgagtttgtttaaaattgaaattagttattttcttctgctggacagtattaaatagagcaggatgttgagttaatctgctagattgcagtactaatggtagtggtttagtgtcttcatgttaatattatttgtacttatttgaacaataatgataaagaagtggttcattattttttaattaatgcactttaaataaggtagaatggaaaaaacccagagagcaaagtgcattacttaaagatgcagtatatacttttctcatttttaaacagcacatatttattaagagaaaaaaagtaatttatgactatttaaaataaaatttaaaagtagagtgactgtcaggtaaagaaccttcaatgtagctatcttccagggggagggccctgcagcctcgctcctcagatgtctgcactgagccagttcagtcactagtgcgccagccaggccaggagggagtgcagagcatgtctgccaagcacagagcatctcagttggactggaccacagtgctcccgagagcctgcctttcctgcccttccccaccacctgcactgccccccacattctcccagccccccccaaggaccccctctccttgacccccagtgctgtaagtaatagagtcattaaaatgcaggactgaaagagacctcagaggtctctatcccatcccttcctgttactgcggcccaaggacaggaaacaacttttccaaaatcccacagctagttaatgacagatctccccactacattaatcccgtgctcctcctcactgccattatagtttattgtgtggtcatgtttacattgtgacatccagccccaaggatggctgggagttgctcaggcatccaggaaaagtggggaatgctgccatctggtgacagcatgtagatttgggcagtgaacagggattgccatgccccagtcttcgcacctcgccccctcaccccctaactcacagcacaaaccctgcaaacccaaagagaatattaatacttgaagcaagaagggtgcatgccagtccttctccgacatggccagggggtaccaggccttgtgcgcctggcctcctagccctagccagggcgagagggcctttcccttgagctactgagctgctttgtgatgctgaaggatactgccggcagcaggcagaggagggagggggcctagggctctgacccatctggaggaaaaccagatcggactaaaaaaggaaaaagaaaaacaaaatctccgcagtgtccaaacctagtttcccatgagttgcgactgaaaatgtgaaacgacactgtattgctgtatactgcaactttaaccataatgagcccttctgaggtcattattgaggttcatataatgcccgaagatgcagcatttggtgctttgttttcctttccgtttcaagacctttttcttttattgcaaggggaaaaaaatgtcatctccccccacctcatccctctttgtgacagcagacctggctgtgttgcccctctcctcctcactattctcaccaggccatgggactttgggggcagtgagagagagctggaaaggggcaaccctgagcagcaggtgtgccccatgccctgtgggtttcccctatgtccaatgactgtagacgggctgtcttgccaggcctcagccccgtctaccctaagcctggccccaaaggtttctctttcttcctccttgattttccatcttgacgaaggcattatatagaatcattttaatcactttcagatgttagagcagcgtattttacaggcatttatatccattgctttcctcagcaaggcatgttactacttttatcatctaaggaaaaaagacaagggaattccagtcaggcattattttcctattactagtgtttgcagaataggtgtaggactatttaagtttagaccttggtttggtagttcttgtttttaataaggggaaaaagataaaataacccctatttttcctgttattgtatttaactaatatattatttctttaaggttactcacttcccctacccctccaaataccttgcattctcaatcaaaaatggaaacaatctgagagacaggaaaagtgcaatattaccaagatggatgccagggctcattggggacaatggagggaataccagtggcgctcagagagcaagaggcagggagcggggtgctgaaggaatcctagctgtggaacaggtgggtgggttggtggagtttgatcttgtggcgttctcctctcccccttctttgggaagatgataggggtccctgccagatccacccagaagaaagggattcaggcatggggcccttgacctctaggccccagtccctggagcagaggcaggccctcgggagctgttccttgttttgatttctgttgtggtgcagccagctgctcagagagacctggcctaaaaatgactcccagcagccctctctcaccccagtgtcctgatatttgggctgtgatccttctggtgtatgtttgaatctttctaaaactgggtgccctcagttcagtttctaggcaggaagcctagaagtcaccagatctttttgggggatgtgagaaccttgagccgcgcacaccctggtgagacaccaattcccacaagcctgcagcagggcctggggctgagcctgggctgcccattcatctcagcgacttcagcctgagaagtgagccctgcctgggctccacacccagagagtccatacaaattctgctccgggaagagtcggggggtctattcaagtttctctgcagacaaaacttcccacaacaggtaccaatctggcctccttcctcagcaccggtagagaaagcaacagaatgggaagtttcctctgggttggagcctcagagctctgcccctcaaggtgacagggacgtccctgtggcttgttccctccacctccagtactgtatgcttgctacttcaaccccctatttggtgaatttctgcacagacacagatctctgtgcctggaatgggactgtgccctgtgcgggtctctcccttggcgtatatccatctagatatttagtctttgagaatctcaaagcagagctctctgggaagagaactgtccacattgctaaataattaagattccctcacttttttgagggccatgtgttgtgagagagagagagagagagagagtgtgtgtgtgtgtgtgtgtgtgtgtgtgtctgtgtatgcaagtgttggtaacttcccacttgaactaaataacatggggttagagaaaaaaaaataccaggcaagctgtctccattgaacaagtccttggcaatgggcaggtcccaagggactcacagcttctggcagcaagtgtgtcattcacacacatcattctggctggagagtgcaatgtgtcatttttttttctttttgtaattattttattaagtatttagttggaaatttcacactggcattaacaggtctagcataagtggcctaggcagtcatcccaggctccaaaatgaagatgtgcaaaagagatgccactgggaatagaaacactgagttggttcagttaggtcatcccctgcagacgtgtcatcgagcaggctgactcccacccctcagccatgccatgggtatgagaagccccttataatgaaagctgccagccctttcgtccttgtttcagagggtgggtcaggtggttggggtgagaacttgctcacggtgcacccaacaagacctgcaggtgcatataagtttagtcccaactgcagggccagaccaaacacttcctgggaagtgtgtggagggctgtgctagaccttcctgagtttctggctaaatcatcagccctgtttggtgcagtctcatgtctctgtggttcccaagctgcatgatcagagccagtgagaagacaggatcagtgacccacagctttggggaaaaacagccccactgttaacttccctcctgcaaacctgggtccccaggccataaggtgggcacactggtgcttacagactgggtggagagccctaccttccaaggtcttgatcccagcctgcctataaggttgggattagcatgcaatcccccttccccaatcctgtctttttaaaatctcaagtttgcacttaaccttgacaacagcaccctctcctactccagtcctagaactcagtggccttagagaatggggtcccctgcactgaaggtccccgccttgctcccagttccatcctggccaataggctgcgcctcaagaggtgaaagagaaaaaagggagggagggaggaagaattatttagaacaaaaggatggctcgagcacgttagaggcaagtgagaggcacgttggtgagaagagcatgtgcatgtttggggtagctggggcctactgtcccttcattagggaaggaggcttccagaagcggatgtcttctagaaagaaaaattgtgtgaaggctgaaaaggggcttggagttttgtctttgttgattagaaagaaggaagaagtcagctctgagtgtttcaggaagaagagagcaggtagaaagggaatttagtgatttaacacccaagggtccagccatagcaggttggaaaatcctccaaatttggccacagaaactggctaggaaaaaactgccactcattgggccacacgctgggtccccatcagttctcaatgaatggtcattgatttacttagcagagagaagtcaccagccacaaaccaatctttgagtttgcaggccctgattccagaatatatgcatccagctcccgggttctcagctggttttgcccacttccctttgactgtccaatccaaagccagtctctcaagttgtatggctcaaagagcagtgaccacaatgggtcatacagtagggacccacctccacaaattagaaccagagttcagactccattgggcacatctgggaggaaggcaacctcctttgtcgtcttgttggtaccagtcattctcaagtatctctgacacctgtggtggttcagtttgctgagcctgccacctggtatgaattagactgggtgtgatgaacattcatccatggatataccctaccattttgcgttgccttataaccaaggcacactccccataagagtttactgcagagaaagaacagcaaaacagccaccctccttgaatttacaactcattatctgcaacaggttttctttaaatccaagacacaggatgggaaatgggtttccccaccaggtactcagaggtctgcaggaagtgactcccgggcaaggcagacttcagtaatccctgaagcgtgagcatgtggactgcatggctgggtggggactggtggatgtctctggagctccagaaccttggagaattcctcatggaattcccctcccagctcttagtgggctctgtggggtcaggaggagcccttcctccaggttttccttctttcctcctcagcagagaaactggagaaaggacattaaactcagtgcagtcgatttgagtgctgaaatatttccagaatcaatggtggtgctaaactatctccatgtttctagcatttttaatagtggagttggtttgtttttaatctcatcacaaaaatgcagtgcccttggggaagggaccagccccttggcctgccactttccaggtgtcctttatcactttgacgggactctttggtctgcagaaaatgctctgtcttggcatgcttctagactgtaagatttgggttttgttttgtattttatgtttacatgcatcttatatttccctgaaaactaaataaagttttgggcctttttaaccgaa

SEQ ID NO: 3841 - DNA, 3251 bp, Homo sapiens
gttctttgacctgcagatgcagcttttggataagtttcccattgaaggtggccagaaggaccccaagcaaaggatcatccccttcctcccaggcaagatcctcttccgcagaagccacatccgggacgtagctgtgaagagactgaagcccatcgatgaatactgccgggcacttgtccggctgcccccccacatctcacagtgtgacgaagtcttccggttcttcgaggctcgacccgaggatgtcaaccctccaaaagaggactatggcagttccaagaggaaatcagtgtggctgtccagctgggctgagtcgcccaagaaggacgtgacaggtgccgacgccaccgccgagcccatgatcctggaacagtacgtggtggtgtccaactataagaagcaggagaactcggagctgagcctccaggccggggaggtggtggatgtcatcgagaagaacgagagcggctggtggttcgtgagcacttctgaggagcagggctgggtccctgccacctacctggaggcccagaatggtactcgggatgactccgacatcaacacctctaagactggagaagaggagaagtatgtcaccgtgcagccttacaccagccaaagcaaggacgagattggctttgagaagggcgtcacagtggaggtgatccggaagaatctggaaggctggtggtatatcagatacctgggcaaagagggctgggcgccagcatcctacctgaagaaggccaaggatgacctgccaacccggaagaagaacctggccggcccagtggagatcattgggaacatcatggagatcagcaacctgctgaacaagaaggcgtctggggacaaggaaactccaccagccgaaggcgagggccatgaggcccccattgccaagaaggagatcagcctgcccatcctctgcaatgcctccaatggcagtgccgtgggcgttcctgacaggactgtctccaggctggcccagggctctccagctgtggccaggattgcccctcagcgggcccagatcagctccccgaacctacggacaagacctccaccacgcagagaatccagcctggggttccaactgccaaagccaccagagcccccttctgttgaggtggagtactacaccattgccgaattccagtcgtgcatttccgatggcatcagctttcggggtggacagaaggcagaggtcattgataagaactcaggtggctggtggtacgtgcagatcggtgagaaggagggctgggcccccgcatcatacatcgataagcgcaagaagcccaacctgagccgccgcacaagcacgctgacccggcccaaggtgcccccgccagcaccccccagcaagcccaaggaggccgaggagggccctacgggggccagtgagagccaggactccccgcggaagctcaagtatgaggagcctgagtatgacatccctgcattcggctttgactcagagcctgagctgagcgaggagcccgtggaggacagagcctcaggggagaggcggcctgcccagccccaccggccctcgccggcctcttctctgcagcgggcccgcttcaaggtgggtgagtcttcagaggatgtggccctggaagaggagaccatctatgagaatgagggcttccggccatatgcagaggacaccctgtcagccagaggctcctccggggacagcgactccccaggcagctcctcgctgtccctgaccaggaaaaactcccccaaatcaggctcccccaagtcatcatcactcctaaagctcaaggcagagaagaatgcccaggcagaaatggggaagaaccactcctcagcctccttttcctcatccatcaccatcaacaccacttgctgctcctcctcttcctcctcctcctcttccttgtccaaaaccagtggcgacctgaagccccgctctgcttcggacgcaggcatccgcggcactcccaaggtcagggcaaagaaggatgctgatgcgaacgctgggctgacctcctgtccccgggccaagccatcggtccggcccaagccattcctaaaccgagcagagtcgcagagccaagagaagatggacatcagcactttacggcgccagctgagacccacaggccagctccgtggagggctcaagggctccaagagtgaggattcggagctgcccccgcagacggcctccgaggctcccagtgaggggtctaggagaagctcatccgacctcatcaccctcccagccaccactcccccatgtcccaccaagaaggaatgggaagggccagccacctcgtacatgacatgcagcgcctaccagaaggtccaggactcggagatcagcttccccgcgggcgtggaggtgcaggtgctggagaagcaggagagcgggtggtggtatgtgaggtttggggagctggagggctgggccccttcccactatttggtgctggatgagaacgagcaacctgacccctctggcaaagagctggacacagtgcccgccaagggcaggcagaacgaaggcaaatcagacagcctggagaagatcgagaggcgcgtccaagcactgaacaccgtcaaccagagcaagaaggccacgccccccatcccctccaaacctcccgggggcttcggcaagacctcaggcactccagcggtgaagatgaggaacggagtgcggcaggtggcggtcaggccccagtcggtgtttgtgtccccgccacccaaggacaacaacctgtcctgcgccctgcggaggaatgagtcactcacggccactgatggcctccgaggcgtccgacggaactcctcctttagcactgctcgctccgctgccgccgaggccaagggccgcctggccgaacgggctgccagccagggttcagactcacccctactgcccgcccagcgcaacagcatacccgtgtcccctgtgcgccccaagcccatcgagaagtctcagttcatccacaataacctcaaagatgtgtacgtctctatcgcagactacgagggggatgaggagacagcaggcttccaggagggggtgtccatggaggttctggagaggaaccctaatggctggtggtactgccagatcctggatggtgtgaagcccttcaaaggctgggtgccttccaactaccttgagaaaaagaactagcagagggcctgggctcttccagcctcagtgtgcctctctggccgcccactggatgagcggtgagacgaac

SEQ ID NO: 3842 - DNA, 1393 bp, Homo sapiens
acatgagcagcggcaccggggaccgaccgcagccagcccgagggcgcccctgcagctgcagccccgcgctcgcgcccggccctaaccatgtctatctgttgttgcttctttttcagggactatggcagttccaagaggaaatcaggtgccgacgccaccgccgagcccatgatcctggaacagtacgtggtggtgtccaactataagaagcaggagaactcggagctgagcctccaggccggggaggtggtggatgtcatcgagaagaacgagagcggctggtggttcgtgagcacttctgaggagcagggctgggtccctgccacctacctggaggcccagaatggtactcgggatgactccgacatcaacacctctaagactggagaagtgtccaagagacgcaaggcccatctgcggcgcctggatcgccggtggaccctgggcgggatggtcaacaggcagcacagccgagaggagaagtatgtcaccgtgcagccttacaccagccaaagcaaggacgagattggctttgagaagggcgtcacagtggaggtgatccggaagaatctggaaggctggtggtatatcagatacctgggcaaagagggctgggcgccagcatcctacctgaagaaggccaaggatgacctgccaacccggaagaagaacctggccggcccagtggagatcattgggaacatcatggagatcagcaacctgctgaacaagaaggcgtctggggacaaggaaactccaccagccgaaggcgagggccatgaggcccccattgccaagaaggagatcagcctgcccatcctctgcaatgcctccaatggcagtgccgtgggcgttcctgacaggactgtctccaggctggcccagggctctccagctgtggccaggattgcccctcagcgggcccagatcagctccccgaacctacggacaagacctccaccacgcagagaatccagcctgacggagtctcgctgtcgccaggctggagtgcagtggcacgacctcggctcactacaatctccacatcccaggttcaagagattctcctgcctcagcctcctgagtagttgggatcataggcacatgccaccacacccagctaattttttaatatttttaatagagacggggtttcaccatgttggccaagatggtctccatctcctcacctcgtgatctgccagcctcggctcccaaagtgctgggattgctggggtgagccgctgcgcccggccttcctctcctttttaacaatcctcgcctccctctttccctccttccttctctcctcccttcaacaaatccttaccaaggacctaccaggcatcaggccccgtgcagacagaaagctagagacagcccctgacttcaa

SEQ ID NO: 3843 - DNA, 3359 bp, Homo sapiens
gacaccacaaggactgggagtggaagatgccttctccagggggaaattaggtagactgaggcaacagatgcccgttacagctacaggcaagatcctcttccgcagaagccacatccgggacgtagctgtgaagagactgaagcccatcgatgaatactgccgggcacttgtccggctgcccccccacatctcacagtgtgacgaagtcttccggttcttcgaggctcgacccgaggatgtcaaccctccaaaagaggactatggcagttccaagaggaaatcaggtgccgacgccaccgccgagcccatgatcctggaacagtacgtggtggtgtccaactataagaagcaggagaactcggagctgagcctccaggccggggaggtggtggatgtcatcgagaagaacgagagcggctggtggttcgtgagcacttctgaggagcagggctgggtccctgccacctacctggaggcccagaatggtactcgggatgactccgacatcaacacctctaagactggagaagtgtccaagagacgcaaggcccatctgcggcgcctggatcgccggtggaccctgggcgggatggtcaacaggcagcacagccgagaggagaagtatgtcaccgtgcagccttacaccagccaaagcaaggacgagattggctttgagaagggcgtcacagtggaggtgatccggaagaatctggaaggctggtggtatatcagatacctgggcaaagagggctgggcgccagcatcctacctgaagaaggccaaggatgacctgccaacccggaagaagaacctggccggcccagtggagatcattgggaacatcatggagatcagcaacctgctgaacaagaaggcgtctggggacaaggaaactccaccagccgaaggcgagggccatgaggcccccattgccaagaaggagatcagcctgcccatcctctgcaatgcctccaatggcagtgccgtgggcgttcctgacaggactgtctccaggctggcccagggctctccagctgtggccaggattgcccctcagcgggcccagatcagctccccgaacctacggacaagacctccaccacgcagagaatccagcctggggttccaactgccaaagccaccagagcccccttctgttgaggtggagtactacaccattgccgaattccagtcgtgcatttccgatggcatcagctttcggggtggacagaaggcagaggtcattgataagaactcaggtggctggtggtacgtgcagatcggtgagaaggagggctgggcccccgcatcatacatcgataagcgcaagaagcccaacctgagccgccgcacaagcacgctgacccggcccaaggtgcccccgccagcaccccccagcaagcccaaggaggccgaggagggccctacgggggccagtgagagccaggactccccgcggaagctcaagtatgaggagcctgagtatgacatccctgcattcggctttgactcagagcctgagctgagcgaggagcccgtggaggacagagcctcaggggagaggcggcctgcccagccccaccggccctcgccggcctcttctctgcagcgggcccgcttcaaggtgggtgagtcttcagaggatgtggccctggaagaggagaccatctatgagaatgagggcttccggccatatgcagaggacaccctgtcagccagaggctcctccggggacagcgactccccaggcagctcctcgctgtccctgaccaggaaaaactcccccaaatcaggctcccccaagtcatcatcactcctaaagctcaaggcagagaagaatgcccaggcagaaatggggaagaaccactcctcagcctccttttcctcatccatcaccatcaacaccacttgctgctcctcctcttcctcctcctcctcttccttgtccaaaaccagtggcgacctgaagccccgctctgcttcggacgcaggcatccgcggcactcccaaggtcagggcaaagaaggatgctgatgcgaacgctgggctgacctcctgtccccgggccaagccatcggtccggcccaagccattcctaaaccgagcagagtcgcagagccaagagaagatggacatcagcactttacggcgccagctgagacccacaggccagctccgtggagggctcaagggctccaagagtgaggattcggagctgcccccgcagacggcctccgaggctcccagtgaggggtctaggagaagctcatccgacctcatcaccctcccagccaccactcccccatgtcccaccaagaaggaatgggaagggccagccacctcgtacatgacatgcagcgcctaccagaaggtccaggactcggagatcagcttccccgcgggcgtggaggtgcaggtgctggagaagcaggagagcgggtggtggtatgtgaggtttggggagctggagggctgggccccttcccactatttggtgctggatgagaacgagcaacctgacccctctggcaaagagctggacacagtgcccgccaagggcaggcagaacgaaggcaaatcagacagcctggagaagatcgagaggcgcgtccaagcactgaacaccgtcaaccagagcaagaaggccacgccccccatcccctccaaacctcccgggggcttcggcaagacctcaggcactccagcggtgaagatgaggaacggagtgcggcaggtggcggtcaggcccatcgagaagtctcagttcatccacaataacctcaaagatgtgtacgtctctatcgcagactacgagggggatgaggagacagcaggcttccaggagggggtgtccatggaggttctggagaggaaccctaatggctggtggtactgccagatcctggatggtgtgaagcccttcaaaggctgggtgccttccaactaccttgagaaaaagaactagcagagggcctgggctcttccagcctcagtgtgcctctctggccgcccactggatgagcggtatccctggtattgtcctaagctgtatttgtgaattgtgctggtttcctgggcattgccacgcctaccacagctgggcagggctggaagccttacgtatgaagcatggagaagcagccattgtccccactatgggcagaggggggacccggctggccccttgggtcagactggagccaacaccgccagccaccccctctggcctgctggcaatgccacaggtgcccaagaagatggaggatccctgtgccaggagccaacctggtcttcccgagggtcagtgccccagtgaagacagaagcgagagaataaagttccctgtaggtcctctgtca

SEQ ID NO: 3844 - DNA, 3039 bp, Homo sapiens
gagaagctctctcccgctctctcctctccctctcccgcccgagggagcagggctgccttttctctcgggtgccgacgccaccgccgagcccatgatcctggaacagtacgtggtggtgtccaactataagaagcaggagaactcggagctgagcctccaggccggggaggtggtggatgtcatcgagaagaacgagagcggctggtggttcgtgagcacttctgaggagcagggctgggtccctgccacctacctggaggcccagaatggtactcgggatgactccgacatcaacacctctaagactggagaagtgtccaagagacgcaaggcccatctgcggcgcctggatcgccggtggaccctgggcgggatggtcaacaggcagcacagccgagaggagaagtatgtcaccgtgcagccttacaccagccaaagcaaggacgagattggctttgagaagggcgtcacagtggaggtgatccggaagaatctggaaggctggtggtatatcagatacctgggcaaagagggctgggcgccagcatcctacctgaagaaggccaaggatgacctgccaacccggaagaagaacctggccggcccagtggagatcattgggaacatcatggagatcagcaacctgctgaacaagaaggcgtctggggacaaggaaactccaccagccgaaggcgagggccatgaggcccccattgccaagaaggagatcagcctgcccatcctctgcaatgcctccaatggcagtgccgtgggcgttcctgacaggactgtctccaggctggcccagggctctccagctgtggccaggattgcccctcagcgggcccagatcagctccccgaacctacggacaagacctccaccacgcagagaatccagcctggggttccaactgccaaagccaccagagcccccttctgttgaggtggagtactacaccattgccgaattccagtcgtgcatttccgatggcatcagctttcggggtggacagaaggcagaggtcattgataagaactcaggtggctggtggtacgtgcagatcggtgagaaggagggctgggcccccgcatcatacatcgataagcgcaagaagcccaacctgagccgccgcacaagcacgctgacccggcccaaggtgcccccgccagcaccccccagcaagcccaaggaggccgaggagggccctacgggggccagtgagagccaggactccccgcggaagctcaagtatgaggagcctgagtatgacatccctgcattcggctttgactcagagcctgagctgagcgaggagcccgtggaggacagagcctcaggggagaggcggcctgcccagccccaccggccctcgccggcctcttctctgcagcgggcccgcttcaaggtgggtgagtcttcagaggatgtggccctggaagaggagaccatctatgagaatgagggcttccggccatatgcagaggacaccctgtcagccagaggctcctccggggacagcgactccccaggcagctcctcgctgtccctgaccaggaaaaactcccccaaatcaggctcccccaagtcatcatcactcctaaagctcaaggcagagaagaatgcccaggcagaaatggggaagaaccactcctcagcctccttttcctcatccatcaccatcaacaccacttgctgctcctcctcttcctcctcctcctcttccttgtccaaaaccagtggcgacctgaagccccgctctgcttcggacgcaggcatccgcggcactcccaaggtcagggcaaagaaggatgctgatgcgaacgctgggctgacctcctgtccccgggccaagccatcggtccggcccaagccattcctaaaccgagcagagtcgcagagccaagagaagatggacatcagcactttacggcgccagctgagacccacaggccagctccgtggagggctcaagggctccaagagtgaggattcggagctgcccccgcagacggcctccgaggctcccagtgaggggtctaggagaagctcatccgacctcatcaccctcccagccaccactcccccatgtcccaccaagaaggaatgggaagggccagccacctcgtacatgacatgcagcgcctaccagaaggtccaggactcggagatcagcttccccgcgggcgtggaggtgcaggtgctggagaagcaggagagcgggtggtggtatgtgaggtttggggagctggagggctgggccccttcccactatttggtgctggatgagaacgagcaacctgacccctctggcaaagagctggacacagtgcccgccaagggcaggcagaacgaaggcaaatcagacagcctggagaagatcgagaggcgcgtccaagcactgaacaccgtcaaccagagcaagaaggccacgccccccatcccctccaaacctcccgggggcttcggcaagacctcaggcactccagcggtgaagatgaggaacggagtgcggcaggtggcggtcaggccccagtcggtgtttgtgtccccgccacccaaggacaacaacctgtcctgcgccctgcggaggaatgagtcactcacggccactgatggcctccgaggcgtccgacggaactcctcctttagcactgctcgctccgctgccgccgaggccaagggccgcctggccgaacgggctgccagccagggttcagactcacccctactgcccgcccagcgcaacagcatacccgtgtcccctgtgcgccccaagcccatcgagaagtctcagttcatccacaataacctcaaagatgtgtacgtctctatcgcagactacgagggggatgaggagacagcaggcttccaggagggggtgtccatggaggttctggagaggaaccctaatggctggtggtactgccagatcctggatggtgtgaagcccttcaaaggctgggtgccttccaactaccttgagaaaaagaactagcagagggcctgggctcttccagcctcagtgtgcctctctgg

SEQ ID NO: 3845 - DNA, 3117 bp, Homo sapiens
agacattacacatgaacgggtcgttcctgctccggctcctgtttcctgtagcgtccatcctgccagagactgtactgcttaggggtgccgacgccaccgccgagcccatgatcctggaacagtacgtggtggtgtccaactataagaagcaggagaactcggagctgagcctccaggccggggaggtggtggatgtcatcgagaagaacgagagcggctggtggttcgtgagcacttctgaggagcagggctgggtccctgccacctacctggaggcccagaatggtactcgggatgactccgacatcaacacctctaagactggagaagtgtccaagagacgcaaggcccatctgcggcgcctggatcgccggtggaccctgggcgggatggtcaacaggcagcacagccgagaggagaagtatgtcaccgtgcagccttacaccagccaaagcaaggacgagattggctttgagaagggcgtcacagtggaggtgatccggaagaatctggaaggctggtggtatatcagatacctgggcaaagagggctgggcgccagcatcctacctgaagaaggccaaggatgacctgccaacccggaagaagaacctggccggcccagtggagatcattgggaacatcatggagatcagcaacctgctgaacaagaaggcgtctggggacaaggaaactccaccagccgaaggcgagggccatgaggcccccattgccaagaaggagatcagcctgcccatcctctgcaatgcctccaatggcagtgccgtgggcgttcctgacaggactgtctccaggctggcccagggctctccagctgtggccaggattgcccctcagcgggcccagatcagctccccgaacctacggacaagacctccaccacgcagagaatccagcctggggttccaactgccaaagccaccagagcccccttctgttgaggtggagtactacaccattgccgaattccagtcgtgcatttccgatggcatcagctttcggggtggacagaaggcagaggtcattgataagaactcaggtggctggtggtacgtgcagatcggtgagaaggagggctgggcccccgcatcatacatcgataagcgcaagaagcccaacctgagccgccgcacaagcacgctgacccggcccaaggtgcccccgccagcaccccccagcaagcccaaggaggccgaggagggccctacgggggccagtgagagccaggactccccgcggaagctcaagtatgaggagcctgagtatgacatccctgcattcggctttgactcagagcctgagctgagcgaggagcccgtggaggacagagcctcaggggagaggcggcctgcccagccccaccggccctcgccggcctcttctctgcagcgggcccgcttcaaggtgggtgagtcttcagaggatgtggccctggaagaggagaccatctatgagaatgagggcttccggccatatgcagaggacaccctgtcagccagaggctcctccggggacagcgactccccaggcagctcctcgctgtccctgaccaggaaaaactcccccaaatcaggctcccccaagtcatcatcactcctaaagctcaaggcagagaagaatgcccaggcagaaatggggaagaaccactcctcagcctccttttcctcatccatcaccatcaacaccacttgctgctcctcctcttcctcctcctcctcttccttgtccaaaaccagtggcgacctgaagccccgctctgcttcggacgcaggcatccgcggcactcccaaggtcagggcaaagaaggatgctgatgcgaacgctgggctgacctcctgtccccgggccaagccatcggtccggcccaagccattcctaaaccgagcagagtcgcagagccaagagaagatggacatcagcactttacggcgccagctgagacccacaggccagctccgtggagggctcaagggctccaagagtgaggattcggagctgcccccgcagacggcctccgaggctcccagtgaggggtctaggagaagctcatccgacctcatcaccctcccagccaccactcccccatgtcccaccaagaaggaatgggaagggccagccacctcgtacatgacatgcagcgcctaccagaaggtccaggactcggagatcagcttccccgcgggcgtggaggtgcaggtgctggagaagcaggagagcgggtggtggtatgtgaggtttggggagctggagggctgggccccttcccactatttggtgctggatgagaacgagcaacctgacccctctggcaaagagctggacacagtgcccgccaagggcaggcagaacgaaggcaaatcagacagcctggagaagatcgagaggcgcgtccaagcactgaacaccgtcaaccagagcaagaaggccacgccccccatcccctccaaacctcccgggggcttcggcaagacctcaggcactccagcggtgaagatgaggaacggagtgcggcaggtggcggtcaggccccagtcggtgtttgtgtccccgccacccaaggacaacaacctgtcctgcgccctgcggaggaatgagtcactcacggccactgatggcctccgaggcgtccgacggaactcctcctttagcactgctcgctccgctgccgccgaggccaagggccgcctggccgaacgggctgccagccagggttcagactcacccctactgcccgcccagcgcaacagcatacccgtgtcccctgtgcgccccaagcccatcgagaagtctcagttcatccacaataacctcaaagatgtgtacgtctctatcgcagactacgagggggatgaggagacagcaggcttccaggagggggtgtccatggaggttctggagaggaaccctaatggctggtggtactgccagatcctggatggtgtgaagcccttcaaaggctgggtgccttccaactaccttgagaaaaagaactagcagagggcctgggctcttccagcctcagtgtgcctctctggccgcccactggatgagcggtgagacgaacaaaagggaaaggaaaaaatgggggtggggggtg

SEQ ID NO: 3846 - DNA, 780 bp, Homo sapiens
ggttagtgaggccggaagtgagtgtaataaagtttctccagggaggcagggcccggggagaaagttggagcggtaacctaagctggcagtggcgtgatccggcaccaaatcggcccgcggtgcggtgcggagactccatgaggccctgacggagtttcgctcttatcgtccaggctggagtgcaatggtgcgatctcggctcactgcaacctccgcctcctgagttcaagtgattctcctgcctcagcctcctgagtagctgggattacaggcgcccaccaccacgcccggctaatttttgtatttttagtagagacggggtttccccatgttggctaggctagcctcgaactcctgacctcaggacatgaacaagctgagtggaggcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcggtacatgggttgtgtggaggtcctccagtcaatgcgtgccctggacttcaacacccggactcaggtcaccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactg

SEQ ID NO: 3847 - DNA, 1692 bp, Homo sapiens
gtttctccagggaggcagggcccggggagaaagttggagcggtaacctaagctggcagtggcgtgatccggcaccaaatcggcccgcggtgcggtgcggagactccatgaggccctggacatgaacaagctgagtggaggcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcggtacatgggttgtgtggaggtcctccagtcaatgcgtgccctggacttcaacacccggactcaggtcaccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactgcaaacagatcatcgccaaccaccacatgcaatctatctcatttgcatccggcggggatccggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattgcctgtaggacagcctgttgggggagatccagaagtccgcaaacagatgccacctccaccaccctgtccaggcagagagctttttgatgatccctcctatgtcaacgtccagaacctagacaaggcccggcaagcagtgggtggtgctgggccccccaatcctgctatcaatggcagtgcaccccgggacctgtttgacatgaagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtgagatggggtttcgccatgttgcccaagctgttcttgaactcccgggctcaagtgatccgcctccctcggcctcccagagtgctgggattacaggcacggaccaccatgcccagcctccacatctttttttgcactgtgtatactcttctgagacatgccaacttcctccaggtcaagaaaggggtatatagctctcagcttcactctttcagggctgatgtcgcctttgccttttctcacttcactgacctgtctattcctacaactgtctctttctag

SEQ ID NO: 3848 - DNA, 2288 bp, Homo sapiens
gaagaggctccacgttgggcggggatggggcctgaaactgtctgggtctgagccccaagtacaatccactccggaatgagtctctgtcatcgctggaggaaggggcttctgggtccacccccccggaggagctgccttccccatcagcttcatccctggggcccatcctgcctcctctgcctggggacgatagtcccactaccctgtgctccttcttcccccggatgagcaacctgaggctggccaacccggctggggggcgcccagggtctaagggggagccaggaagggcagctgatgatggggaggggatcgtaggggcagccatgccagactcaggccccctacccctcctccaggacatgaacaagctgagtggaggcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcggtacatgggttgtgtggaggtcctccagtcaatgcgtgccctggacttcaacacccggactcaggtcaccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactgcaaacagatcatcgccaaccaccacatgcaatctatctcatttgcatccggcggggatccggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattgcctgtaggacagcctgttgggggagatccagaagtccgcaaacagatgccacctccaccaccctgtccagcaggcagagagctttttgatgatccctcctatgtcaacgtccagaacctagacaaggcccggcaagcagtgggtggtgctgggccccccaatcctgctatcaatggcagtgcaccccgggacctgtttgacatgaagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtggttcggactaaggatcaccgctttgaaagtgtcagtcaccttatcagctaccacatggacaatcacttgcccatcatctctgcgggcagcgaactgtgtctacagcaacctgtggagcggaaactgtgatctgccctagcgctctcttccagaagatgccctccaatcctttccaccctattccctaactctcgggacctcgtttgggagtgttctgtgggcttggccttgtgtcagagctgggagtagcatggactctgggtttcatatccagctgagtgagagggtttgagtcaaaagcctgggtgagaatcctgcctctccccaaacattaatcaccaaagtattaatgtacagagtggcccctcacctgggcctttcctgtgccaacctgatgccccttccccaagaaggtgagtgcttgtcatggaaaatgtcctgtggtgacaggcccagtggaacagtcacccttctgggcaagggggaacaaatcacacctctgggcttcagggtatcccagacccctctcaacacccgccccccccatgtttaaactttgtgcctttgaccatctcttaggtctaatgatattttatgcaaacagttcttggacccctgaattcaatgaca

SEQ ID NO: 3849 - DNA, 3472 bp, Homo sapiens
gaggctccacgttgggcggggatggggcctgaaactgtctgggtctgagctggggagcggaagccacttgtccctctccctccccaggacttctgtgactcctgggccacagaggtccaaccaggctaagggcctggggataccccctgcctggcccccttgcccaaactggcaggggggccaggctgggcagcagcccctctttcacctcaactatggatctcctgccccccaagcccaagtacaatccactccggaatgagtctctgtcatcgctggaggaaggggcttctgggtccacccccccggaggagctgccttccccatcagcttcatccctggggcccatcctgcctcctctgcctggggacgatagtcccactaccctgtgctccttcttcccccggatgagcaacctgaggctggccaacccggctggggggcgcccagggtctaagggggagccaggaagggcagctgatgatggggaggggatcgtaggggcagccatgccagactcaggccccctacccctcctccaggacatgaacaagctgagtggaggcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcggtacatgggttgtgtggaggtcctccagtcaatgcgtgccctggacttcaacacccggactcaggtcaccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactgcaaacagatcatcgccaaccaccacatgcaatctatctcatttgcatccggcggggatccggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattgcctgtaggacagcctgttgggggagatccagaagtccgcaaacagatgccacctccaccaccctgtccaggcagagagctttttgatgatccctcctatgtcaacgtccagaacctagacaaggcccggcaagcagtgggtggtgctgggccccccaatcctgctatcaatggcagtgcaccccgggacctgtttgacatgaagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtggttcggactaaggatcaccgctttgaaagtgtcagtcaccttatcagctaccacatggacaatcacttgcccatcatctctgcgggcagcgaactgtgtctacagcaacctgtggagcggaaactgtgatctgccctagcgctctcttccagaagatgccctccaatcctttccaccctattccctaactctcgggacctcgtttgggagtgttctgtgggcttggccttgtgtcagagctgggagtagcatggactctgggtttcatatccagctgagtgagagggtttgagtcaaaagcctgggtgagaatcctgcctctccccaaacattaatcaccaaagtattaatgtacagagtggcccctcacctgggcctttcctgtgccaacctgatgccccttccccaagaaggtgagtgcttgtcatggaaaatgtcctgtggtgacaggcccagtggaacagtcacccttctgggcaagggggaacaaatcacacctctgggcttcagggtatcccagacccctctcaacacccgccccccccatgtttaaactttgtgcctttgaccatctcttaggtctaatgatattttatgcaaacagttcttggacccctgaattcaatgacagggatgccaacaccttcttggcttctgggacctgtgttcttgctgagcaccctctccggtttgggttgggataacagaggcaggagtggcagctgtcccctctccctggggatatgcaacccttagagattgccccagagccccactcccggccaggcgggagatggacccctcccttgctcagtgcctcctggccggggcccctcaccccaaggggtctgtatatacatttcataaggcctgccctcccatgttgcatgcctatgtactctacgccaaagtgcagcccttcctcctgaagcctctgccctgcctccctttctgggagggcggggtgggggtgactgaatttgggcctcttgtacagttaactctcccaggtggattttgtggaggtgagaaaaggggcattgagactataaagcagtagacaatccccacataccatctgtagagttggaactgcattcttttaaagttttatatgcatatattttagggctgtagacttactttcctattttcttttccattgcttattcttgagcacaaaatgataatcaattattacatttatacatcacctttttgacttttccaagcccttttacagctcttggcattttcctcgcctaggcctgtgaggtaactgggatcgcaccttttataccagagacctgaggcagatgaaatttatttccatctaggactagaaaaacttgggtctcttaccgcgagactgagaggcagaagtcagcccgaatgcctgtcagtttcatggaggggaaacgcaaaacctgcagttcctgagtaccttctacaggcccggcccagcctaggcccggggtggccacaccacagcaagccggccccccctcttttggccttgtggataagggagagttgaccgttttcatcctggcctccttttgctgtttggatgtttccacgggtctcacttataccaaagggaaaactcttcattaaagtccgtatttcttcta

SEQ ID NO: 3850 - DNA, 2881 bp, Homo sapiens
agagaagaggctccacgttgggcggggatggggcctgaaactgtctgggtctgagctggggagcggaagccacttgtccctctccctccccaggacttctgtgactcctgggccacagaggtccaaccaggctaagggcctggggataccccctgcctggcccccttgcccaaactggcaggggggccaggctgggcagcagcccctctttcacctcaactatggatctcctgccccccaagcccaagtacaatccactccggaatgagtctctctctatcctggggaggagtaacctgaaatttgctggaatgccaatcactctcaccgtctccaccagcagcctcaacctcatggccgcagactgcaaacagatcatcgccaaccaccacatgcaatctatctcatttgcatccggcggggatccggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattgcctgtaggacagcctgttgggggagatccagaagtccgcaaacagatgccacctccaccaccctgtccaggcagagagctttttgatgatccctcctatgtcaacgtccagaacctagacaaggcccggcaagcagtgggtggtgctgggccccccaatcctgctatcaatggcagtgcaccccgggacctgtttgacatgaagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtggttcggactaaggatcaccgctttgaaagtgtcagtcaccttatcagctaccacatggacaatcacttgcccatcatctctgcgggcagcgaactgtgtctacagcaacctgtggagcggaaactgtgatctgccctagcgctctcttccagaagatgccctccaatcctttccaccctattccctaactctcgggacctcgtttgggagtgttctgtgggcttggccttgtgtcagagctgggagtagcatggactctgggtttcatatccagctgagtgagagggtttgagtcaaaagcctgggtgagaatcctgcctctccccaaacattaatcaccaaagtattaatgtacagagtggcccctcacctgggcctttcctgtgccaacctgatgccccttccccaagaaggtgagtgcttgtcatggaaaatgtcctgtggtgacaggcccagtggaacagtcacccttctgggcaagggggaacaaatcacacctctgggcttcagggtatcccagacccctctcaacacccgccccccccatgtttaaactttgtgcctttgaccatctcttaggtctaatgatattttatgcaaacagttcttggacccctgaattcaatgacagggatgccaacaccttcttggcttctgggacctgtgttcttgctgagcaccctctccggtttgggttgggataacagaggcaggagtggcagctgtcccctctccctggggatatgcaacccttagagattgccccagagccccactcccggccaggcgggagatggacccctcccttgctcagtgcctcctggccggggcccctcaccccaaggggtctgtatatacatttcataaggcctgccctcccatgttgcatgcctatgtactctacgccaaagtgcagcccttcctcctgaagcctctgccctgcctccctttctgggagggcggggtgggggtgactgaatttgggcctcttgtacagttaactctcccaggtggattttgtggaggtgagaaaaggggcattgagactataaagcagtagacaatccccacataccatctgtagagttggaactgcattcttttaaagttttatatgcatatattttagggctgtagacttactttcctattttcttttccattgcttattcttgagcacaaaatgataatcaattattacatttatacatcacctttttgacttttccaagcccttttacagctcttggcattttcctcgcctaggcctgtgaggtaactgggatcgcaccttttataccagagacctgaggcagatgaaatttatttccatctaggactagaaaaacttgggtctcttaccgcgagactgagaggcagaagtcagcccgaatgcctgtcagtttcatggaggggaaacgcaaaacctgcagttcctgagtaccttctacaggcccggcccagcctaggcccggggtggccacaccacagcaagccggccccccctcttttggccttgtggataagggagagttgaccgttttcatcctggcctccttttgctgtttggatgtttccacgggtctcacttataccaaagggaaaactcttcattaaagtccgtatttcttcta

SEQ ID NO: 3851 - DNA, 3059 bp, Homo sapiens
gagtgtaataaagtttctccagggaggcagggcccggggagaaagttggagcggtaacctaagctggcagtggcgtgatccggcaccaaatcggcccgcggtgcggtgcggagactccatgaggccctggacatgaacaagctgagtggaggcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcggtacatgggttgtgtggaggtcctccagtcaatgcgtgccctggacttcaacacccggactcaggtcaccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactgcaaacagatcatcgccaaccaccacatgcaatctatctcatttgcatccggcggggatccggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattgcctgtaggacagcctgttgggggagatccagaagtccgcaaacagatgccacctccaccaccctgtccaggcagagagctttttgatgatccctcctatgtcaacgtccagaacctagacaaggcccggcaagcagtgggtggtgctgggccccccaatcctgctatcaatggcagtgcaccccgggacctgtttgacatgaagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtggttcggactaaggatcaccgctttgaaagtgtcagtcaccttatcagctaccacatggacaatcacttgcccatcatctctgcgggcagcgaactgtgtctacagcaacctgtggagcggaaactgtgatctgccctagcgctctcttccagaagatgccctccaatcctttccaccctattccctaactctcgggacctcgtttgggagtgttctgtgggcttggccttgtgtcagagctgggagtagcatggactctgggtttcatatccagctgagtgagagggtttgagtcaaaagcctgggtgagaatcctgcctctccccaaacattaatcaccaaagtattaatgtacagagtggcccctcacctgggcctttcctgtgccaacctgatgccccttccccaagaaggtgagtgcttgtcatggaaaatgtcctgtggtgacaggcccagtggaacagtcacccttctgggcaagggggaacaaatcacacctctgggcttcagggtatcccagacccctctcaacacccgccccccccatgtttaaactttgtgcctttgaccatctcttaggtctaatgatattttatgcaaacagttcttggacccctgaattcaatgacagggatgccaacaccttcttggcttctgggacctgtgttcttgctgagcaccctctccggtttgggttgggataacagaggcaggagtggcagctgtcccctctccctggggatatgcaacccttagagattgccccagagccccactcccggccaggcgggagatggacccctcccttgctcagtgcctcctggccggggcccctcaccccaaggggtctgtatatacatttcataaggcctgccctcccatgttgcatgcctatgtactctacgccaaagtgcagcccttcctcctgaagcctctgccctgcctccctttctgggagggcggggtgggggtgactgaatttgggcctcttgtacagttaactctcccaggtggattttgtggaggtgagaaaaggggcattgagactataaagcagtagacaatccccacataccatctgtagagttggaactgcattcttttaaagttttatatgcatatattttagggctgtagacttactttcctattttcttttccattgcttattcttgagcacaaaatgataatcaattattacatttatacatcacctttttgacttttccaagcccttttacagctcttggcattttcctcgcctaggcctgtgaggtaactgggatcgcaccttttataccagagacctgaggcagatgaaatttatttccatctaggactagaaaaacttgggtctcttaccgcgagactgagaggcagaagtcagcccgaatgcctgtcagtttcatggaggggaaacgcaaaacctgcagttcctgagtaccttctacaggcccggcccagcctaggcccggggtggccacaccacagcaagccggccccccctcttttggccttgtggataagggagagttgaccgttttcatcctggcctccttttgctgtttggatgtttccacgggtctcacttataccaaagggaaaactcttcattaaagtccgtatttcttcta

SEQ ID NO: 3852 - DNA, 3062 bp, Homo sapiens
gagtgtaataaagtttctccagggaggcagggcccggggagaaagttggagcggtaacctaagctggcagtggcgtgatccggcaccaaatcggcccgcggtgcggtgcggagactccatgaggccctggacatgaacaagctgagtggaggcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcggtacatgggttgtgtggaggtcctccagtcaatgcgtgccctggacttcaacacccggactcaggtcaccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactgcaaacagatcatcgccaaccaccacatgcaatctatctcatttgcatccggcggggatccggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattgcctgtaggacagcctgttgggggagatccagaagtccgcaaacagatgccacctccaccaccctgtccagcaggcagagagctttttgatgatccctcctatgtcaacgtccagaacctagacaaggcccggcaagcagtgggtggtgctgggccccccaatcctgctatcaatggcagtgcaccccgggacctgtttgacatgaagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtggttcggactaaggatcaccgctttgaaagtgtcagtcaccttatcagctaccacatggacaatcacttgcccatcatctctgcgggcagcgaactgtgtctacagcaacctgtggagcggaaactgtgatctgccctagcgctctcttccagaagatgccctccaatcctttccaccctattccctaactctcgggacctcgtttgggagtgttctgtgggcttggccttgtgtcagagctgggagtagcatggactctgggtttcatatccagctgagtgagagggtttgagtcaaaagcctgggtgagaatcctgcctctccccaaacattaatcaccaaagtattaatgtacagagtggcccctcacctgggcctttcctgtgccaacctgatgccccttccccaagaaggtgagtgcttgtcatggaaaatgtcctgtggtgacaggcccagtggaacagtcacccttctgggcaagggggaacaaatcacacctctgggcttcagggtatcccagacccctctcaacacccgccccccccatgtttaaactttgtgcctttgaccatctcttaggtctaatgatattttatgcaaacagttcttggacccctgaattcaatgacagggatgccaacaccttcttggcttctgggacctgtgttcttgctgagcaccctctccggtttgggttgggataacagaggcaggagtggcagctgtcccctctccctggggatatgcaacccttagagattgccccagagccccactcccggccaggcgggagatggacccctcccttgctcagtgcctcctggccggggcccctcaccccaaggggtctgtatatacatttcataaggcctgccctcccatgttgcatgcctatgtactctacgccaaagtgcagcccttcctcctgaagcctctgccctgcctccctttctgggagggcggggtgggggtgactgaatttgggcctcttgtacagttaactctcccaggtggattttgtggaggtgagaaaaggggcattgagactataaagcagtagacaatccccacataccatctgtagagttggaactgcattcttttaaagttttatatgcatatattttagggctgtagacttactttcctattttcttttccattgcttattcttgagcacaaaatgataatcaattattacatttatacatcacctttttgacttttccaagcccttttacagctcttggcattttcctcgcctaggcctgtgaggtaactgggatcgcaccttttataccagagacctgaggcagatgaaatttatttccatctaggactagaaaaacttgggtctcttaccgcgagactgagaggcagaagtcagcccgaatgcctgtcagtttcatggaggggaaacgcaaaacctgcagttcctgagtaccttctacaggcccggcccagcctaggcccggggtggccacaccacagcaagccggccccccctcttttggccttgtggataagggagagttgaccgttttcatcctggcctccttttgctgtttggatgtttccacgggtctcacttataccaaagggaaaactcttcattaaagtccgtatttcttcta

SEQ ID NO: 3853 - DNA, 692 bp, Homo sapiens
gaaagttggagcggtaacctaagctggcagtggcgtgatccggcaccaaatcggcccgcggtgcggtgcggagactccatgaggccctggacatgaacaagctgagtggaggcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcggtacatgggttgtgtggaggtcctccagtcaatgcgtgccctggacttcaacacccggactcaggtcaccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactgcaaacaggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacagg

SEQ ID NO: 3854 - DNA, 780 bp, Homo sapiens
cccagttgagtgggaggcaggcaggcaggcgctgggtctgagtacccctctttccccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactgcaaacaggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattgcctgtaggacagcctgttgggggagatccagaagtccgcaaacagatgccacctccaccaccctgtccagcaggcagagagctttttgatgatccctcctatgtcaacgtccagaacctagacaaggcccggcaagcagtgggtggtgctgggcccccc

SEQ ID NO: 3855 - DNA, 550 bp, Homo sapiens
ggcaggcaggcgctgggtctgagtacccctctttccccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactgcaaacagatcatcgccaaccaccacatgcaatctatctcatttgcatccggcggggatccggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccc

SEQ ID NO: 3856 - DNA, 1305 bp, Homo sapiens
ggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattgcctgtaggacagcctgttgggggagatccagaagtccgcaaacagatgccacctccaccaccctgtccaggcagagagctttttgatgatccctcctatgtcaacgtccagaacctagacaaggcccggcaagcagtgggtggtgctgggccccccaatcctgctatcaatggcagtgcaccccgggacctgtttgacatgaagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtgagatggggtttcgccatgttgcccaagctgttcttgaactcccgggctcaagtgatccgcctccctcggcctcccagagtgctgggattacaggcacggaccaccatgcccagcctccacatctttttttgcactgtgtatactcttctgagacatgccaacttcctccaggtcaagaaaggggtatatagctctcagcttcactctttcagggctgatgtcgcctttgccttttctcacttcactgacctgtctattcctacaactgtctctttctagagaagcctcaatgatcaggattgacaggccacactctcccccaccatttttttctcctccttcaagcctcttgtctgtttcaccctcttccaccttggaggctgaggtcttatttgactcttcacctgaattgaccttcttccttcccaccctcccaggttcggactaaggatcaccgctttgaaagtgtcagtcaccttatcagctaccacatggacaatcacttgcccatcatctctgcgggcagcgaactgtgtctacagcaacctgtggagcggaaactgtgatctgccctagcgctctcttccagaagatgccctccaatcctttccaccctattccctaactctcgggacctcgtttgggagtgttctgtgggcttggccttgtgtcagagctgggagtagcatgga

SEQ ID NO: 3857 - DNA, 3481 bp, Homo sapiens
agagaagaggctccacgttgggcggggatggggcctgaaactgtctgggtctgagctggggagcggaagccacttgtccctctccctccccaggacttctgtgactcctgggccacagaggtccaaccaggctaagggcctggggataccccctgcctggcccccttgcccaaactggcaggggggccaggctgggcagcagcccctctttcacctcaactatggatctcctgccccccaagcccaagtacaatccactccggaatgagtctctgtcatcgctggaggaaggggcttctgggtccacccccccggaggagctgccttccccatcagcttcatccctggggcccatcctgcctcctctgcctggggacgatagtcccactaccctgtgctccttcttcccccggatgagcaacctgaggctggccaacccggctggggggcgcccagggtctaagggggagccaggaagggcagctgatgatggggaggggatcgtaggggcagccatgccagactcaggccccctacccctcctccaggacatgaacaagctgagtggaggcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcggtacatgggttgtgtggaggtcctccagtcaatgcgtgccctggacttcaacacccggactcaggtcaccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactgcaaacagatcatcgccaaccaccacatgcaatctatctcatttgcatccggcggggatccggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattgcctgtaggacagcctgttgggggagatccagaagtccgcaaacagatgccacctccaccaccctgtccagcaggcagagagctttttgatgatccctcctatgtcaacgtccagaacctagacaaggcccggcaagcagtgggtggtgctgggccccccaatcctgctatcaatggcagtgcaccccgggacctgtttgacatgaagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtggttcggactaaggatcaccgctttgaaagtgtcagtcaccttatcagctaccacatggacaatcacttgcccatcatctctgcgggcagcgaactgtgtctacagcaacctgtggagcggaaactgtgatctgccctagcgctctcttccagaagatgccctccaatcctttccaccctattccctaactctcgggacctcgtttgggagtgttctgtgggcttggccttgtgtcagagctgggagtagcatggactctgggtttcatatccagctgagtgagagggtttgagtcaaaagcctgggtgagaatcctgcctctccccaaacattaatcaccaaagtattaatgtacagagtggcccctcacctgggcctttcctgtgccaacctgatgccccttccccaagaaggtgagtgcttgtcatggaaaatgtcctgtggtgacaggcccagtggaacagtcacccttctgggcaagggggaacaaatcacacctctgggcttcagggtatcccagacccctctcaacacccgccccccccatgtttaaactttgtgcctttgaccatctcttaggtctaatgatattttatgcaaacagttcttggacccctgaattcaatgacagggatgccaacaccttcttggcttctgggacctgtgttcttgctgagcaccctctccggtttgggttgggataacagaggcaggagtggcagctgtcccctctccctggggatatgcaacccttagagattgccccagagccccactcccggccaggcgggagatggacccctcccttgctcagtgcctcctggccggggcccctcaccccaaggggtctgtatatacatttcataaggcctgccctcccatgttgcatgcctatgtactctacgccaaagtgcagcccttcctcctgaagcctctgccctgcctccctttctgggagggcggggtgggggtgactgaatttgggcctcttgtacagttaactctcccaggtggattttgtggaggtgagaaaaggggcattgagactataaagcagtagacaatccccacataccatctgtagagttggaactgcattcttttaaagttttatatgcatatattttagggctgtagacttactttcctattttcttttccattgcttattcttgagcacaaaatgataatcaattattacatttatacatcacctttttgacttttccaagcccttttacagctcttggcattttcctcgcctaggcctgtgaggtaactgggatcgcaccttttataccagagacctgaggcagatgaaatttatttccatctaggactagaaaaacttgggtctcttaccgcgagactgagaggcagaagtcagcccgaatgcctgtcagtttcatggaggggaaacgcaaaacctgcagttcctgagtaccttctacaggcccggcccagcctaggcccggggtggccacaccacagcaagccggccccccctcttttggccttgtggataagggagagttgaccgttttcatcctggcctccttttgctgtttggatgtttccacgggtctcacttataccaaagggaaaactcttcattaaagtccgtatttcttcta

SEQ ID NO: 3858 - DNA, 2490 bp, Homo sapiens
atgacgcagggtccgggcgggcgcgcgcccccggcgccccccgcgccccccgagcccgaggcgcccaccaccttctgcgcgttgctgccccgaatgccgcagtggaagttcgcggccccgggcggcttcctgggccgcggcccggcggcggcgcgggcggctggggcctcggggggcgcggacccccaacccgagccggcgggcccggggggcgtcccggcgctggcggccgccgtcctgggcgcctgcgagccccgctgcgccgcgccctgtcccctgcccgcgctcagccgctgtcggggcgcggggtcgcgggggtcgcggggcgggcggggggcggcggggtccggggacgccgccgccgccgccgagtggatccggaagggcagcttcatccacaaacccgcgcacggctggctacaccccgacgccagggtcctggggcccggggtctcctacgtcgtgcggtacatgggctgcatcgaggttctccgctctatgcgctccctggactttaacacgcgcacgcaggtgaccagggaagccatcaaccggctccatgaggccgtgcctggcgtccggggatcctggaagaaaaaggcccccaacaaggccctggcgtccgtcctgggcaagagcaaccttcgctttgccggcatgagcatctccatccacatctccactgatggcctcagcctctccgtgcctgccacgcgccaggtcatcgccaaccaccacatgccgtccatctccttcgcgtcaggcggagacacggacatgacggattacgtggcctacgtcgccaaggaccccatcaaccagagagcctgccacatcctggagtgctgtgagggcctggcacagagcatcatcagcaccgtgggccaagctttcgagctgcgcttcaagcagtacctgcacagcccgcccaaggtggcgctgcccccagaaaggctggcagggccggaggagtcggcctggggggacgaggaggactctttggagcacaattactacaacagcatcccggggaaggagccgccgctgggcgggctagtggactccaggctggccctgacacagccctgcgccctcacggccctcgaccagggcccatctccttctctaagagatgcctgcagcctgccatgggacgtggggtccaccggtacagctccaccgggggacggctacgtgcaggcggacgcccggggccccccggaccacgaggagcacctgtatgtcaacacccagggtctggacgcccccgagccggaggacagccccaaaaaggatctgtttgacatgcgaccctttgaggatgccctgaagttgcatgagtgctcagtggcggcaggcgtgacagcagcccctcttcccttggaggaccagtggcccagcccccctacccgccgggcccctgtggcccccacggaggaacagctgcgtcaggagccctggtaccacggccggatgagccgccgggcggcagagaggatgcttcgagctgacggggacttccttgtgcgagacagcgtcaccaaccccgggcagtatgtcctcaccggcatgcacgccgggcagcccaagcacctgctgctcgtggaccccgagggcgtggtacggacgaaggacgtgctgtttgagagcatcagccacctgatcgaccaccacctgcagaacgggcagcccatcgtggccgccgagagtgagctgcacctgcgtggcgtggtctcacgggagccctgagccaggtgaccgttctcagccctggctcctgcctgttctcagccccggctcctgcctgtcatggccttggggctctcagccctcctcctggatcctggtcaggccgaaccaccgctgcctctccttcctccgcatgagcctctggcatggtccttcctccagctggccccgggctgggcagagcctcctcctgccggggcccctgcccaccccctcctttgcctggagtgagggtgttcataccaaagacggaaccatttcgcctttaaagaaaatatatccagaagcagccgctgcctcggagccctggcccttgggtccccctctcgcctggctggttcggtctaacgccccggagagtcagggctcccaggaccctggggaggaggcggattccgggcctggctgggcttcctcttcccacctgaggactgggtgcacagttgtctttgaggggggacgcttaaggtgctttggggttctcaggccaggatacatgctggcgctgaagtgcaggcagccttgaggtcacctgggatctcggggtagccaggctgctccaagacagtggatatcgaggcagtcgtgaggcccctactccacctgggagcaggggaaggacgtggttgcctggcctgggctgcgcccagcagcttccccccagtcctgccctcccagctgtcgacccagatgggatgttcggatcggtttgtaattaaacctgggaatggccacaagagc

SEQ ID NO: 3859 - DNA, 2453 bp, Homo sapiens
agtcctgcgcgcccccgggcggagatggggagggcacccggcgttctgagcggaagtacggttgagccgatttccggggccactggtgtgacgtgtcccgcgcttggcgcagcaggaagcggcggcgaacgcggcctgaattcccggcgccggccccagctcctctgccgctgccgccatgctcgacttcttcaccattttctccaagggcgggcttgtgctctggtgcttccagggcgttagcgactcatgcaccggacccgttaacgcgttgattcgttccgtgctgctgcaggttggttttcagaagatcctgacactgacatatgtagacaaattgatagatgacgtgcatcggctgtttcgggacaagtaccgcacagagatccaacagcaaagtgctttaagtttattaaatggcacttttgatttccaaaatgacttcctgcggctccttcgtgaagcagaggagagcagtaagatccgtgctcccactaccatgaagaaatttgaagattctgaaaaggccaagaaacctgtgaggtccatgattgagacacggggggaaaagcccaaggaaaaagcaaagaatagcaaaaaaaagggggccaagaaggaaggttctgatggtcctttggctaccagcaaaccagtccctgcagaaaagtcaggtcttccagtgggtcctgagaacggagtagaactttccaaagaggagctgatccgcaggaagcgcgaggagttcattcagaagcatgggaggggtatggagaagtccaacaagtccacgaagtcagatgctccaaaggagaagggcaaaaaagcaccccgggtgtgggaactgggtggctgtgctaacaaagaagtgttggattacagtactcccaccaccaatggaacccctgaggctgccttgtctgaggacatcaacctgattcgagggactgggtctggggggcagcttcaggatctggactgcagcagctctgatgacgaaggggctgctcaaaactctaccaaacctagtgcgaccaagggaacactgggtggcatgtttggtatgctgaagggccttgtgggttcaaagagcttgagtcgtgaagacatggaatctgtgctggacaagatgcgtgatcatctcattgctaagaacgtggctgcagacattgccgtccagctctgtgaatctgttgccaacaagttggaagggaaggtgatggggacgttcagcacggtgacttccacagtaaagcaagccctacaggagtccctggtgcagattctgcagccacagcgtcgtgtagacatgctccgggacatcatggatgcccagcgtcgccagcgcccttatgtcgtcaccttctgcggcgttaatggagtggggaaatctactaatcttgccaagatttccttctggttgttagagaatggcttcagtgtcctcattgctgcctgtgatacatttcgtgctggggccgtggagcagctgcgtacacacacccggcgtttgagtgccctacaccctccagagaagcatggtggccgcaccatggtgcagttgtttgaaaagggctatggcaaggatgctgctggcattgccatggaagccattgcttttgcacgtaaccaaggctttgacgtggtgctggtggacacggcaggccgcatgcaagacaatgcccctctgatgactgccctggccaaactcattactgtcaatacacctgatttggtgctgtttgtaggagaagccttagtaggcaatgaagccgtggaccagctggtcaagttcaacagagccttggctgaccattctatggctcagacacctcggctcattgatggcattgttcttaccaaatttgataccattgatgacaaggtgggagctgctatttctatgacgtacatcacaagcaaacccatcgtctttgtgggcaccggccagacctactgtgacctacgcagcctcaatgccaaggctgtggtggctgccctcatgaaggcttaacgtggctcttgcccaataccaaatcgccgctttccccacaagcccttcttcctgtatcaagaatgtgctttagagtatgtgagcaacctgtcttcagtgtagtacaaaggcagagtgagggggcttgtggctccttccaaccccactccccgttcagcacagccgccatctgcaaggaaggcctaatcatgttacaatcactgcccactgaccctctcccagcgggcctcccccttcctactcaggcacccccttcactctgcctacagactcagtcttattacagctttgaccaatggttggaacccaacaccagagctttgctaataattagtgtggtcaagagccgtctgagcctaatgagtcccagctgcattaggttaagagactcttccagagccagcgccaggtcttgaatggcacctctccctaggatacacag

SEQ ID NO: 3860 - DNA, 4310 bp, Homo sapiens
gctgagcgcggagccgcccggtgattggtgggggcggaagggggccgggcgccagcgctgccttttctcctgccgggtagtttcgctttcctgcgcagagtctgcggaggggctcggctgcaccggggggatcgcgcctggcagaccccagaccgagcagaggcgacccagcgcgctcgggagaggctgcaccgccgcgcccccgcctagcccttccggatcctgcgcgcagaaaagtttcatttgctgtatgccatcctcgagagctgtctaggttaacgttcgcactctgtgtatataacctcgacagtcttggcacctaacgtgctgtgcgtagctgctcctttggttgaatccccaggcccttgttggggcacaaggtggcaggatgtctcagtggtacgaacttcagcagcttgactcaaaattcctggagcaggttcaccagctttatgatgacagttttcccatggaaatcagacagtacctggcacagtggttagaaaagcaagactgggagcacgctgccaatgatgtttcatttgccaccatccgttttcatgacctcctgtcacagctggatgatcaatatagtcgcttttctttggagaataacttcttgctacagcataacataaggaaaagcaagcgtaatcttcaggataattttcaggaagacccaatccagatgtctatgatcatttacagctgtctgaaggaagaaaggaaaattctggaaaacgcccagagatttaatcaggctcagtcggggaatattcagagcacagtgatgttagacaaacagaaagagcttgacagtaaagtcagaaatgtgaaggacaaggttatgtgtatagagcatgaaatcaagagcctggaagatttacaagatgaatatgacttcaaatgcaaaaccttgcagaacagagaacacgagaccaatggtgtggcaaagagtgatcagaaacaagaacagctgttactcaagaagatgtatttaatgcttgacaataagagaaaggaagtagttcacaaaataatagagttgctgaatgtcactgaacttacccagaatgccctgattaatgatgaactagtggagtggaagcggagacagcagagcgcctgtattggggggccgcccaatgcttgcttggatcagctgcagaactggttcactatagttgcggagagtctgcagcaagttcggcagcagcttaaaaagttggaggaattggaacagaaatacacctacgaacatgaccctatcacaaaaaacaaacaagtgttatgggaccgcaccttcagtcttttccagcagctcattcagagctcgtttgtggtggaaagacagccctgcatgccaacgcaccctcagaggccgctggtcttgaagacaggggtccagttcactgtgaagttgagactgttggtgaaattgcaagagctgaattataatttgaaagtcaaagtcttatttgataaagatgtgaatgagagaaatacagtaaaaggatttaggaagttcaacattttgggcacgcacacaaaagtgatgaacatggaggagtccaccaatggcagtctggcggctgaatttcggcacctgcaattgaaagaacagaaaaatgctggcaccagaacgaatgagggtcctctcatcgttactgaagagcttcactcccttagttttgaaacccaattgtgccagcctggtttggtaattgacctcgagacgacctctctgcccgttgtggtgatctccaacgtcagccagctcccgagcggttgggcctccatcctttggtacaacatgctggtggcggaacccaggaatctgtccttcttcctgactccaccatgtgcacgatgggctcagctttcagaagtgctgagttggcagttttcttctgtcaccaaaagaggtctcaatgtggaccagctgaacatgttgggagagaagcttcttggtcctaacgccagccccgatggtctcattccgtggacgaggttttgtaaggaaaatataaatgataaaaattttcccttctggctttggattgaaagcatcctagaactcattaaaaaacacctgctccctctctggaatgatgggtgcatcatgggcttcatcagcaaggagcgagagcgtgccctgttgaaggaccagcagccggggaccttcctgctgcggttcagtgagagctcccgggaaggggccatcacattcacatgggtggagcggtcccagaacggaggcgaacctgacttccatgcggttgaaccctacacgaagaaagaactttctgctgttactttccctgacatcattcgcaattacaaagtcatggctgctgagaatattcctgagaatcccctgaagtatctgtatccaaatattgacaaagaccatgcctttggaaagtattactccaggccaaaggaagcaccagagccaatggaacttgatggccctaaaggaactggatatatcaagactgagttgatttctgtgtctgaagttcacccttctagacttcagaccacagacaacctgctccccatgtctcctgaggagtttgacgaggtgtctcggatagtgggctctgtagaattcgacagtatgatgaacacagtatagagcatgaatttttttcatcttctctggcgacagttttccttctcatctgtgattccctcctgctactctgttccttcacatcctgtgtttctagggaaatgaaagaaaggccagcaaattcgctgcaacctgttgatagcaagtgaatttttctctaactcagaaacatcagttactctgaagggcatcatgcatcttactgaaggtaaaattgaaaggcattctctgaagagtgggtttcacaagtgaaaaacatccagatacacccaaagtatcaggacgagaatgagggtcctttgggaaaggagaagttaagcaacatctagcaaatgttatgcataaagtcagtgcccaactgttataggttgttggataaatcagtggttatttagggaactgcttgacgtaggaacggtaaatttctgtgggagaattcttacatgttttctttgctttaagtgtaactggcagttttccattggtttacctgtgaaatagttcaaagccaagtttatatacaattatatcagtcctctttcaaaggtagccatcatggatctggtagggggaaaatgtgtattttattacatctttcacattggctatttaaagacaaagacaaattctgtttcttgagaagagaatattagctttactgtttgttatggcttaatgacactagctaatatcaatagaaggatgtacatttccaaattcacaagttgtgtttgatatccaaagctgaatacattctgctttcatcttggtcacatacaattatttttacagttctcccaagggagttaggctattcacaaccactcattcaaaagttgaaattaaccatagatgtagataaactcagaaatttaattcatgtttcttaaatgggctactttgtcctttttgttattagggtggtatttagtctattagccacaaaattgggaaaggagtagaaaaagcagtaactgacaacttgaataatacaccagagataatatgagaatcagatcatttcaaaactcatttcctatgtaactgcattgagaactgcatatgtttcgctgatatatgtgtttttcacatttgcgaatggttccattctctctcctgtactttttccagacacttttttgagtggatgatgtttcgtgaagtatactgtatttttacctttttccttccttatcactgacacaaaaagtagattaagagatgggtttgacaaggttcttcccttttacatactgctgtctatgtggctgtatcttgtttttccactactgctaccacaactatattatcatgcaaatgctgtattcttctttggtggagataaagatttcttgagttttgttttaaaattaaagctaaagtatctgtattgcattaaatataatatgcacacagtgctttccgtggcactgcatacaatctgaggcctcctctctcagtttttatatagatggcgagaacctaagtttcagttgattttacaattgaaatgactaaaaaacaaagaagacaacattaaaacaatattgtttctaattgctgaggtttagctgtcagttctttttgccctttgggaattcggcatggtttcattttactgcactagccaagagactttacttttaagaagtattaaaattctaaaattcta

SEQ ID NO: 3861 - DNA, 2716 bp, Homo sapiens
tcgctttcctgcgcagagtctgcggaggggctcggctgcaccggggggatcgcgcctggcagaccccagaccgagcagaggcgacccagcgcgctcgggagaggctgcaccgccgcgcccccgcctagcccttccggatcctgcgcgcagaaaagtttcatttgctgtatgccatcctcgagagctgtctaggttaacgttcgcactctgtgtatataacctcgacagtcttggcacctaacgtgctgtgcgtagctgctcctttggttgaatccccaggcccttgttggggcacaaggtggcaggatgtctcagtggtacgaacttcagcagcttgactcaaaattcctggagcaggttcaccagctttatgatgacagttttcccatggaaatcagacagtacctggcacagtggttagaaaagcaagactgggagcacgctgccaatgatgtttcatttgccaccatccgttttcatgacctcctgtcacagctggatgatcaatatagtcgcttttctttggagaataacttcttgctacagcataacataaggaaaagcaagcgtaatcttcaggataattttcaggaagacccaatccagatgtctatgatcatttacagctgtctgaaggaagaaaggaaaattctggaaaacgcccagagatttaatcaggctcagtcggggaatattcagagcacagtgatgttagacaaacagaaagagcttgacagtaaagtcagaaatgtgaaggacaaggttatgtgtatagagcatgaaatcaagagcctggaagatttacaagatgaatatgacttcaaatgcaaaaccttgcagaacagagaacacgagaccaatggtgtggcaaagagtgatcagaaacaagaacagctgttactcaagaagatgtatttaatgcttgacaataagagaaaggaagtagttcacaaaataatagagttgctgaatgtcactgaacttacccagaatgccctgattaatgatgaactagtggagtggaagcggagacagcagagcgcctgtattggggggccgcccaatgcttgcttggatcagctgcagaactggttcactatagttgcggagagtctgcagcaagttcggcagcagcttaaaaagttggaggaattggaacagaaatacacctacgaacatgaccctatcacaaaaaacaaacaagtgttatgggaccgcaccttcagtcttttccagcagctcattcagagctcgtttgtggtggaaagacagccctgcatgccaacgcaccctcagaggccgctggtcttgaagacaggggtccagttcactgtgaagttgagactgttggtgaaattgcaagagctgaattataatttgaaagtcaaagtcttatttgataaagatgtgaatgagagaaatacagtaaaaggatttaggaagttcaacattttgggcacgcacacaaaagtgatgaacatggaggagtccaccaatggcagtctggcggctgaatttcggcacctgcaattgaaagaacagaaaaatgctggcaccagaacgaatgagggtcctctcatcgttactgaagagcttcactcccttagttttgaaacccaattgtgccagcctggtttggtaattgacctcgagacgacctctctgcccgttgtggtgatctccaacgtcagccagctcccgagcggttgggcctccatcctttggtacaacatgctggtggcggaacccaggaatctgtccttcttcctgactccaccatgtgcacgatgggctcagctttcagaagtgctgagttggcagttttcttctgtcaccaaaagaggtctcaatgtggaccagctgaacatgttgggagagaagcttcttggtcctaacgccagccccgatggtctcattccgtggacgaggttttgtaaggaaaatataaatgataaaaattttcccttctggctttggattgaaagcatcctagaactcattaaaaaacacctgctccctctctggaatgatgggtgcatcatgggcttcatcagcaaggagcgagagcgtgccctgttgaaggaccagcagccggggaccttcctgctgcggttcagtgagagctcccgggaaggggccatcacattcacatgggtggagcggtcccagaacggaggcgaacctgacttccatgcggttgaaccctacacgaagaaagaactttctgctgttactttccctgacatcattcgcaattacaaagtcatggctgctgagaatattcctgagaatcccctgaagtatctgtatccaaatattgacaaagaccatgcctttggaaagtattactccaggccaaaggaagcaccagagccaatggaacttgatggccctaaaggaactggatatatcaagactgagttgatttctgtgtctgaagtgtaagtgaacacagaagagtgacatgtttacaaacctcaagccagccttgctcctggctggggcctgttgaagatgcttgtattttacttttccattgtaattgctatcgccatcacagctgaacttgttgagatccccgtgttactgcctatcagcattttactactttaaaaaaaaaaaaaaagccaaaaaccaaatttgtatttaaggtatataaattttcccaaaactgataccctttgaaaaagtataaataaaatgagcaaaagttgat

SEQ ID NO: 3862 - DNA, 2723 bp, Homo sapiens
agcgctgccttttctcctgccgggtagtttcgctttcctgcgcagagtctgcggaggggctcggctgcaccggggggatcgcgcctggcagaccccagaccgagcagaggcgacccagcgcgctcgggagaggctgcaccgccgcgcccccgcctagcccttccggatcctgcgcgcagaaaagtttcatttgctgtatgccatcctcgagagctgtctaggttaacgttcgcactctgtgtatataacctcgacagtcttggcacctaacgtgctgtgcgtagctgctcctttggttgaatccccaggcccttgttggggcacaaggtggcagggatacaccagtgcacagaatcctccaccaacatccatcccttcaagtggtgaaaacagacaataatgaaaataaaatatgtggatgtctcagtggtacgaacttcagcagcttgactcaaaattcctggagcaggttcaccagctttatgatgacagttttcccatggaaatcagacagtacctggcacagtggttagaaaagcaagactgggagcacgctgccaatgatgtttcatttgccaccatccgttttcatgacctcctgtcacagctggatgatcaatatagtcgcttttctttggagaataacttcttgctacagcataacataaggaaaagcaagcgtaatcttcaggataattttcaggaagacccaatccagatgtctatgatcatttacagctgtctgaaggaagaaaggaaaattctggaaaacgcccagagatttaatcaggctcagtcggggaatattcagagcacagtgatgttagacaaacagaaagagcttgacagtaaagtcagaaatgtgaaggacaaggttatgtgtatagagcatgaaatcaagagcctggaagatttacaagatgaatatgacttcaaatgcaaaaccttgcagaacagagaacacgagaccaatggtgtggcaaagagtgatcagaaacaagaacagctgttactcaagaagatgtatttaatgcttgacaataagagaaaggaagtagttcacaaaataatagagttgctgaatgtcactgaacttacccagaatgccctgattaatgatgaactagtggagtggaagcggagacagcagagcgcctgtattggggggccgcccaatgcttgcttggatcagctgcagaactggttcactatagttgcggagagtctgcagcaagttcggcagcagcttaaaaagttggaggaattggaacagaaatacacctacgaacatgaccctatcacaaaaaacaaacaagtgttatgggaccgcaccttcagtcttttccagcagctcattcagagctcgtttgtggtggaaagacagccctgcatgccaacgcaccctcagaggccgctggtcttgaagacaggggtccagttcactgtgaagttgagactgttggtgaaattgcaagagctgaattataatttgaaagtcaaagtcttatttgataaagatgtgaatgagagaaatacagtaaaaggatttaggaagttcaacattttgggcacgcacacaaaagtgatgaacatggaggagtccaccaatggcagtctggcggctgaatttcggcacctgcaattgaaagaacagaaaaatgctggcaccagaacgaatgagggtcctctcatcgttactgaagagcttcactcccttagttttgaaacccaattgtgccagcctggtttggtaattgacctcgagacgacctctctgcccgttgtggtgatctccaacgtcagccagctcccgagcggttgggcctccatcctttggtacaacatgctggtggcggaacccaggaatctgtccttcttcctgactccaccatgtgcacgatgggctcagctttcagaagtgctgagttggcagttttcttctgtcaccaaaagaggtctcaatgtggaccagctgaacatgttgggagagaagcttcttggtcctaacgccagccccgatggtctcattccgtggacgaggttttgtaaggaaaatataaatgataaaaattttcccttctggctttggattgaaagcatcctagaactcattaaaaaacacctgctccctctctggaatgatgggtgcatcatgggcttcatcagcaaggagcgagagcgtgccctgttgaaggaccagcagccggggaccttcctgctgcggttcagtgagagctcccgggaaggggccatcacattcacatgggtggagcggtcccagaacggaggcgaacctgacttccatgcggttgaaccctacacgaagaaagaactttctgctgttactttccctgacatcattcgcaattacaaagtcatggctgctgagaatattcctgagaatcccctgaagtatctgtatccaaatattgacaaagaccatgcctttggaaagtattactccaggccaaaggaagcaccagagccaatggaacttgatggccctaaaggaactggatatatcaagactgagttgatttctgtgtctgaagtgtaagtgaacacagaagagtgacatgtttacaaacctcaagccagccttgctcctggctggggcctgttgaagatgcttgtattttacttttccattgtaattgctatcgccatcacagctgaacttgttgagatccccgtgttactgcctatcagcattttactacttt

SEQ ID NO: 3863 - DNA, 3097 bp, Homo sapiens
gtgcagttggacgccgggcgaggacgggccgtctgtgctgacccgcgaatagtgatcccagaggaagaacgcgtcctgagtattccaagtgcgagcagtgccacctgttctcggagatggcactgctcagcacgattgtccttgccagtcgtgctctggcagtgaagaggacttgtgaaatataattttcctctagaaggcactgcaccttcccatttaccgtcactttctcccgtttccacccctttccatcagtcacgttttcttcttttcgcagaaagtttcatttgctgtatgccatcctcgagagctgtctaggttaacgttcgcactctgtgtatataacctcgacagtcttggcacctaacgtgctgtgcgtagctgctcctttggttgaatccccaggcccttgttggggcacaaggtggcaggatgtctcagtggtacgaacttcagcagcttgactcaaaattcctggagcaggttcaccagctttatgatgacagttttcccatggaaatcagacagtacctggcacagtggttagaaaagcaagactgggagcacgctgccaatgatgtttcatttgccaccatccgttttcatgacctcctgtcacagctggatgatcaatatagtcgcttttctttggagaataacttcttgctacagcataacataaggaaaagcaagcgtaatcttcaggataattttcaggaagacccaatccagatgtctatgatcatttacagctgtctgaaggaagaaaggaaaattctggaaaacgcccagagatttaatcaggctcagtcggggaatattcagagcacagtgatgttagacaaacagaaagagcttgacagtaaagtcagaaatgtgaaggacaaggttatgtgtatagagcatgaaatcaagagcctggaagatttacaagatgaatatgacttcaaatgcaaaaccttgcagaacagagaacacgagaccaatggtgtggcaaagagtgatcagaaacaagaacagctgttactcaagaagatgtatttaatgcttgacaataagagaaaggaagtagttcacaaaataatagagttgctgaatgtcactgaacttacccagaatgccctgattaatgatgaactagtggagtggaagcggagacagcagagcgcctgtattggggggccgcccaatgcttgcttggatcagctgcagaactggttcactatagttgcggagagtctgcagcaagttcggcagcagcttaaaaagttggaggaattggaacagaaatacacctacgaacatgaccctatcacaaaaaacaaacaagtgttatgggaccgcaccttcagtcttttccagcagctcattcagagctcgtttgtggtggaaagacagccctgcatgccaacgcaccctcagaggccgctggtcttgaagacaggggtccagttcactgtgaagttgagactgttggtgaaattgcaagagctgaattataatttgaaagtcaaagtcttatttgataaagatgtgaatgagagaaatacagtaaaaggatttaggaagttcaacattttgggcacgcacacaaaagtgatgaacatggaggagtccaccaatggcagtctggcggctgaatttcggcacctgcaattgaaagaacagaaaaatgctggcaccagaacgaatgagggtcctctcatcgttactgaagagcttcactcccttagttttgaaacccaattgtgccagcctggtttggtaattgacctcgagacgacctctctgcccgttgtggtgatctccaacgtcagccagctcccgagcggttgggcctccatcctttggtacaacatgctggtggcggaacccaggaatctgtccttcttcctgactccaccatgtgcacgatgggctcagctttcagaagtgctgagttggcagttttcttctgtcaccaaaagaggtctcaatgtggaccagctgaacatgttgggagagaagcttcttggtcctaacgccagccccgatggtctcattccgtggacgaggttttgtaaggaaaatataaatgataaaaattttcccttctggctttggattgaaagcatcctagaactcattaaaaaacacctgctccctctctggaatgatgggtgcatcatgggcttcatcagcaaggagcgagagcgtgccctgttgaaggaccagcagccggggaccttcctgctgcggttcagtgagagctcccgggaaggggccatcacattcacatgggtggagcggtcccagaacggaggcgaacctgacttccatgcggttgaaccctacacgaagaaagaactttctgctgttactttccctgacatcattcgcaattacaaagtcatggctgctgagaatattcctgagaatcccctgaagtatctgtatccaaatattgacaaagaccatgcctttggaaagtattactccaggccaaaggaagcaccagagccaatggaacttgatggccctaaaggaactggatatatcaagactgagttgatttctgtgtctgaagttcacccttctagacttcagaccacagacaacctgctccccatgtctcctgaggagtttgacgaggtgtctcggatagtgggctctgtagaattcgacagtatgatgaacacagtatagagcatgaatttttttcatcttctctggcgacagttttccttctcatctgtgattccctcctgctactctgttccttcacatcctgtgtttctagggaaatgaaagaaaggccagcaaattcgctgcaacctgttgatagcaagtgaatttttctctaactcagaaacatcagttactctgaagggcatcatgcatcttactgaaggtaaaattgaaaggcattctctgaagagtgggtttcacaagtgaaaaacatccagatacacccaaagtatcaggacgagaatgagggtcctttgggaaaggagaagttaagcaacatctagcaaatgttatgcataaagtcagtgcccaactgttataggttgttggataaatcagtggttatttagggaactgcttgacgtaggaa

SEQ ID NO: 3864 - DNA, 736 bp, Homo sapiens
gggggccgggcgccagcgctgccttttctcctgccgggtagtttcgctttcctgcgcagagtctgcggaggggctcggctgcaccggggggatcgcgcctggcagaccccagaccgagcagaggcgacccagcgcgctcgggagaggctgcaccgccgcgcccccgcctagcccttccggatcctgcgcgcagagatgtctcagtggtacgaacttcagcagcttgactcaaaattcctggagcaggttcaccagctttatgatgacagttttcccatggaaatcagacagtacctggcacagtggttagaaaagcaagactgggagcacgctgccaatgatgtttcatttgccaccatccgttttcatgacctcctgtcacagctggatgatcaatatagtcgcttttctttggagaataacttcttgctacagcataacataaggaaaagcaagcgtaatcttcaggataattttcaggaagacccaatccagatgtctatgatcatttacagctgtctgaaggaagaaaggaaaattctggaaaacgcccagagatttaatcaggctcagtcggggaatattcagagcacagtgatgttagacaaacagaaagagcttgacagtaaagtcagaaatgtgaaggacaaggttatgtgtatagagcatgaaatcaagagcctggaagatttacaagatgaatatgacttcaaatgcaaaaccttgcagaacagag

SEQ ID NO: 3865 - DNA, 567 bp, Homo sapiens
gcagaccgagcctgaggacgcctatagaaactgccagaccccaacctctggttcaagggcagctacccaggctggctgagggtcacagcttaccagacaggacaagatctgagtcagtgcaagtgcaaactgtgtagatagcgaagtgaagcgggtaaaagagaccttttcaggacaaggaaagaaacggtggaagtgcaaggaaagtttcatttgctgtatgccatcctcgagagctgtctaggttaacgttcgcactctgtgtatataacctcgacagtcttggcacctaacgtgctgtgcgtagctgctcctttggttgaatccccaggcccttgttggggcacaaggtggcaggatgtctcagtggtacgaacttcagcagcttgactcaaaattcctggagcaggttcaccagctttatgatgacagttttcccatggaaatcagacagtacctggcacagtggttagaaaagcaagactgggagcacgctgccaatgatgtttcatttgccaccatccgttttcatgacctcctgtcacagctggatgatcaatatagtcg

SEQ ID NO: 3866 - DNA, 2594 bp, Homo sapiens
gattggtgggggcggaagggggccgggcgccagcgctgccttttctcctgccgggtagtttcgctttcctgcgcagagtctgcggaggggctcggctgcaccggggggatcgcgcctggcagaccccagaccgagcagaggcgacccagcgcgctcgggagaggctgcaccgccgcgcccccgcctagcccttccggatcctgcgcgcagaaaagtttcatttgctgtatgccatcctcgagagctgtctaggttaacgttcgcactctgtgtatataacctcgacagtcttggcacctaacgtgctgtgcgtagctgctcctttggttgaatccccaggcccttgttggggcacaaggtggcaggatgtctcagtggtacgaacttcagcagcttgactcaaaattcctggagcaggttcaccagctttatgatgacagttttcccatggaaatcagacagtacctggcacagtggttagaaaagcaagactgggagcacgctgccaatgatgtttcatttgccaccatccgttttcatgacctcctgtcacagctggatgatcaatatagtcgcttttctttggagaataacttcttgctacagcataacataaggaaaagcaagcgtaatcttcaggataattttcaggaagacccaatccagatgtctatgatcatttacagctgtctgaaggaagaaaggaaaattctggaaaacgcccagagatttaatcaggctcagtcggggaatattcagagcacagtgatgttagacaaacagaaagagcttgacagtaaagtcagaaatgtgaaggacaaggttatgtgtatagagcatgaaatcaagagcctggaagatttacaagatgaatatgacttcaaatgcaaaaccttgcagaacagaggaagtagttcacaaaataatagagttgctgaatgtcactgaacttacccagaatgccctgattaatgatgaactagtggagtggaagcggagacagcagagcgcctgtattggggggccgcccaatgcttgcttggatcagctgcagaactggttcactatagttgcggagagtctgcagcaagttcggcagcagcttaaaaagttggaggaattggaacagaaatacacctacgaacatgaccctatcacaaaaaacaaacaagtgttatgggaccgcaccttcagtcttttccagcagctcattcagagctcgtttgtggtggaaagacagccctgcatgccaacgcaccctcagaggccgctggtcttgaagacaggggtccagttcactgtgaagttgagactgttggtgaaattgcaagagctgaattataatttgaaagtcaaagtcttatttgataaagatgtgaatgagagaaatacagtaaaaggatttaggaagttcaacattttgggcacgcacacaaaagtgatgaacatggaggagtccaccaatggcagtctggcggctgaatttcggcacctgcaattgaaagaacagaaaaatgctggcaccagaacgaatgagggtcctctcatcgttactgaagagcttcactcccttagttttgaaacccaattgtgccagcctggtttggtaattgacctcgagacgacctctctgcccgttgtggtgatctccaacgtcagccagctcccgagcggttgggcctccatcctttggtacaacatgctggtggcggaacccaggaatctgtccttcttcctgactccaccatgtgcacgatgggctcagctttcagaagtgctgagttggcagttttcttctgtcaccaaaagaggtctcaatgtggaccagctgaacatgttgggagagaagcttcttggtcctaacgccagccccgatggtctcattccgtggacgaggttttgtaaggaaaatataaatgataaaaattttcccttctggctttggattgaaagcatcctagaactcattaaaaaacacctgctccctctctggaatgatgggtgcatcatgggcttcatcagcaaggagcgagagcgtgccctgttgaaggaccagcagccggggaccttcctgctgcggttcagtgagagctcccgggaaggggccatcacattcacatgggtggagcggtcccagaacggaggcgaacctgacttccatgcggttgaaccctacacgaagaaagaactttctgctgttactttccctgacatcattcgcaattacaaagtcatggctgctgagaatattcctgagaatcccctgaagtatctgtatccaaatattgacaaagaccatgcctttggaaagtattactccaggccaaaggaagcaccagagccaatggaacttgatggccctaaaggaactggatatatcaagactgagttgatttctgtgtctgaagtgtaagtgaacacagaagagtgacatgtttacaaacctcaagccagccttgctcctggctggggcctgttgaagatgcttgtattttacttttccattgtaattgctatcgccatcacagctgaacttgttgagatccccgtgttactgcctatcagcattttactactttaaaaaaaaaaaaaaa

SEQ ID NO: 3867 - DNA, 572 bp, Homo sapiens
aaactgcaccgcgcaaagccaggggcgtgggcgggcccgggctgctctacctgcgctcggaaagctagggctccaaagcgttcctgagcggtttttgaccgcgaatgtgatagtgctcatggatgtctcagtggtacgaacttcagcagcttgactcaaaattcctggagcaggttcaccagctttatgatgacagttttcccatggaaatcagacagtacctggcacagtggttagaaaagcaagactgggagcacgctgccaatgatgtttcatttgccaccatccgttttcatgacctcctgtcacagctggatgatcaatatagtcgcttttctttggagaataacttcttgctacagcataacataaggaaaagcaagcgtaatcttcaggataattttcaggaagacccaatccagatgtctatgatcatttacagctgtctgaaggaagaaaggaaaattctggaaaacgcccagagatttaatcaggctcagtcggggaatattcagagcacagtgatgttagacaaacagaaagagcttgacagtaaagtcagaaatgtgaag

SEQ ID NO: 3868 - DNA, 2261 bp, Homo sapiens
gtgctgtgcgtagctgctcctttggttgaatccccaggcccttgttggggcacaaggtggcaggatgtctcagtggtacgaacttcagcagcttgactcaaaattcctggagcaggttcaccagctttatgatgacagttttcccatggaaatcagacagtacctggcacagtggttagaaaagcaagactgggagcacgctgccaatgatgtttcatttgccaccatccgttttcatgacctcctgtcacagctggatgatcaatatagtcgcttttctttggagaataacttcttgctacagcataacataaggaaaagcaagcgtaatcttcaggataattttcaggaagacccaatccagatgtctatgatcatttacagctgtctgaaggaagaaaggaaaattctggaaaacgcccagagatttaatcaggctcagtcggggaatattcagagcacagtgatgttagacaaacagaaagagcttgacagtaaagtcagaaatgtgaaggacaaggttatgtgtatagagcatgaaatcaagagcctggaagatttacaagatgaatatgacttcaaatgcaaaaccttgcagaacagaggaagtagttcacaaaataatagagttgctgaatgtcactgaacttacccagaatgccctgattaatgatgaactagtggagtggaagcggagacagcagagcgcctgtattggggggccgcccaatgcttgcttggatcagctgcagaactggttcactatagttgcggagagtctgcagcaagttcggcagcagcttaaaaagttggaggaattggaacagaaatacacctacgaacatgaccctatcacaaaaaacaaacaagtgttatgggaccgcaccttcagtcttttccagcagctcattcagagctcgtttgtggtggaaagacagccctgcatgccaacgcaccctcagaggccgctggtcttgaagacaggggtccagttcactgtgaagttgagactgttggtgaaattgcaagagctgaattataatttgaaagtcaaagtcttatttgataaagatgtgaatgagagaaatacagtaaaaggatttaggaagttcaacattttgggcacgcacacaaaagtgatgaacatggaggagtccaccaatggcagtctggcggctgaatttcggcacctgcaattgaaagaacagaaaaatgctggcaccagaacgaatgagggtcctctcatcgttactgaagagcttcactcccttagttttgaaacccaattgtgccagcctggtttggtaattgacctcgagacgacctctctgcccgttgtggtgatctccaacgtcagccagctcccgagcggttgggcctccatcctttggtacaacatgctggtggcggaacccaggaatctgtccttcttcctgactccaccatgtgcacgatgggctcagctttcagaagtgctgagttggcagttttcttctgtcaccaaaagaggtctcaatgtggaccagctgaacatgttgggagagaagcttcttggtcctaacgccagccccgatggtctcattccgtggacgaggttttgtaaggaaaatataaatgataaaaattttcccttctggctttggattgaaagcatcctagaactcattaaaaaacacctgctccctctctggaatgatgggtgcatcatgggcttcatcagcaaggagcgagagcgtgccctgttgaaggaccagcagccggggaccttcctgctgcggttcagtgagagctcccgggaaggggccatcacattcacatgggtggagcggtcccagaacggaggcgaacctgacttccatgcggttgaaccctacacgaagaaagaactttctgctgttactttccctgacatcattcgcaattacaaagtcatggctgctgagaatattcctgagaatcccctgaagtatctgtatccaaatattgacaaagaccatgcctttggaaagtattactccaggccaaaggaagcaccagagccaatggaacttgatggccctaaaggaactggatatatcaagactgagttgatttctgtgtctgaagttcacccttctagacttcagaccacagacaacctgctccccatgtctcctgaggagtttgacgaggtgtctcggatagtgggctctgtagaattcgacagtatgatgaacacagtatagagcatgaatttttttcatcttctctggcgacagttt

SEQ ID NO: 3869 - DNA, 2029 bp, Homo sapiens
gaatgtcatgaagacccaatccagatgtctatgatcatttacagctgtctgaaggaagaaaggaaaattctggaaaacgcccagagatttaatcaggctcagtcggggaatattcagagcacagtgatgttagacaaacagaaagagcttgacagtaaagtcagaaatgtgaaggacaaggttatgtgtatagagcatgaaatcaagagcctggaagatttacaagatgaatatgacttcaaatgcaaaaccttgcagaacagagaacacgagaccaatggtgtggcaaagagtgatcagaaacaagaacagctgttactcaagaagatgtatttaatgcttgacaataagagaaaggaagtagttcacaaaataatagagttgctgaatgtcactgaacttacccagaatgccctgattaatgatgaactagtggagtggaagcggagacagcagagcgcctgtattggggggccgcccaatgcttgcttggatcagctgcagaactggttcactatagttgcggagagtctgcagcaagttcggcagcagcttaaaaagttggaggaattggaacagaaatacacctacgaacatgaccctatcacaaaaaacaaacaagtgttatgggaccgcaccttcagtcttttccagcagctcattcagagctcgtttgtggtggaaagacagccctgcatgccaacgcaccctcagaggccgctggtcttgaagacaggggtccagttcactgtgaagttgagactgttggtgaaattgcaagagctgaattataatttgaaagtcaaagtcttatttgataaagatgtgaatgagagaaatacagtaaaaggatttaggaagttcaacattttgggcacgcacacaaaagtgatgaacatggaggagtccaccaatggcagtctggcggctgaatttcggcacctgcaattgaaagaacagaaaaatgctggcaccagaacgaatgagggtcctctcatcgttactgaagagcttcactcccttagttttgaaacccaattgtgccagcctggtttggtaattgacctcgagacgacctctctgcccgttgtggtgatctccaacgtcagccagctcccgagcggttgggcctccatcctttggtacaacatgctggtggcggaacccaggaatctgtccttcttcctgactccaccatgtgcacgatgggctcagctttcagaagtgctgagttggcagttttcttctgtcaccaaaagaggtctcaatgtggaccagctgaacatgttgggagagaagcttcttggtcctaacgccagccccgatggtctcattccgtggacgaggttttgtaaggaaaatataaatgataaaaattttcccttctggctttggattgaaagcatcctagaactcattaaaaaacacctgctccctctctggaatgatgggtgcatcatgggcttcatcagcaaggagcgagagcgtgccctgttgaaggaccagcagccggggaccttcctgctgcggttcagtgagagctcccgggaaggggccatcacattcacatgggtggagcggtcccagaacggaggcgaacctgacttccatgcggttgaaccctacacgaagaaagaactttctgctgttactttccctgacatcattcgcaattacaaagtcatggctgctgagaatattcctgagaatcccctgaagtatctgtatccaaatattgacaaagaccatgcctttggaaagtattactccaggccaaaggaagcaccagagccaatggaacttgatggccctaaaggaactggatatatcaagactgagttgatttctgtgtctgaagtgtaagtgaacacagaagagtgacatgtttacaaacctcaagccagccttgctcctggctggggcctgttgaagatgcttgtattttacttttccattgtaattgctatcgccatcacagctgaacttgttgagatccccgtgttactgcctatcagcattttactacttt

SEQ ID NO: 3870 - DNA, 3259 bp, Homo sapiens
actgcaaccctaatcagagcccaaatggcgcagtgggaaatgctgcagaatcttgacagcccctttcaggatcagctgcaccagctttactcgcacagcctcctgcctgtggacattcgacagtacttggctgtctggattgaagaccagaactggcaggaagctgcacttgggagtgatgattccaaggctaccatgctattcttccacttcttggatcagctgaactatgagtgtggccgttgcagccaggacccagagtccttgttgctgcagcacaatttgcggaaattctgccgggacattcagcccttttcccaggatcctacccagttggctgagatgatctttaacctccttctggaagaaaaaagaattttgatccaggctcagagggcccaattggaacaaggagagccagttctcgaaacacctgtggagagccagcaacatgagattgaatcccggatcctggatttaagggctatgatggagaagctggtaaaatccatcagccaactgaaagaccagcaggatgtcttctgcttccgatataagatccaggccaaagggaagacaccctctctggacccccatcagaccaaagagcagaagattctgcaggaaactctcaatgaactggacaaaaggagaaaggaggtgctggatgcctccaaagcactgctaggccgattaactaccctaatcgagctactgctgccaaagttggaggagtggaaggcccagcagcaaaaagcctgcatcagagctcccattgaccacgggttggaacagctggagacatggttcacagctggagcaaagctgttgtttcacctgaggcagctgctgaaggagctgaagggactgagttgcctggttagctatcaggatgaccctctgaccaaaggggtggacctacgcaacgcccaggtcacagagttgctacagcgtctgctccacagagcctttgtggtagaaacccagccctgcatgccccaaactccccatcgacccctcatcctcaagactggcagcaagttcaccgtccgaacaaggctgctggtgagactccaggaaggcaatgagtcactgactgtggaagtctccattgacaggaatcctcctcaattacaaggcttccggaagttcaacattctgacttcaaaccagaaaactttgacccccgagaaggggcagagtcagggtttgatttgggactttggttacctgactctggtggagcaacgttcaggtggttcaggaaagggcagcaataaggggccactaggtgtgacagaggaactgcacatcatcagcttcacggtcaaatatacctaccagggtctgaagcaggagctgaaaacggacaccctccctgtggtgattatttccaacatgaaccagctctcaattgcctgggcttcagttctctggttcaatttgctcagcccaaaccttcagaaccagcagttcttctccaacccccccaaggccccctggagcttgctgggccctgctctcagttggcagttctcctcctatgttggccgaggcctcaactcagaccagctgagcatgctgagaaacaagctgttcgggcagaactgtaggactgaggatccattattgtcctgggctgacttcactaagcgagagagccctcctggcaagttaccattctggacatggctggacaaaattctggagttggtacatgaccacctgaaggatctctggaatgatggacgcatcatgggctttgtgagtcggagccaggagcgccggctgctgaagaagaccatgtctggcacctttctactgcgcttcagtgaatcgtcagaagggggcattacctgctcctgggtggagcaccaggatgatgacaaggtgctcatctactctgtgcaaccgtacacgaaggaggtgctgcagtcactcccgctgactgaaatcatccgccattaccagttgctcactgaggagaatatacctgaaaacccactgcgcttcctctatccccgaatcccccgggatgaagcttttgggtgctactaccaggagaaagttaatctccaggaacggaggaaatacctgaaacacaggctcattgtggtctctaatagacaggtggatgaactgcaacaaccgctggagcttaagccagagccagagctggagtcattagagctggaactagggctggtgccagagccagagctcagcctggacttagagccactgctgaaggcagggctggatctggggccagagctagagtctgtgctggagtccactctggagcctgtgatagagcccacactatgcatggtatcacaaacagtgccagagccagaccaaggacctgtatcacagccagtgccagagccagatttgccctgtgatctgagacatttgaacactgagccaatggaaatcttcagaaactgtgtaaagattgaagaaatcatgccgaatggtgacccactgttggctggccagaacaccgtggatgaggtttacgtctcccgccccagccacttctacactgatggacccttgatgccttctgacttctaggaaccacatttcctctgttcttttcatatctcttgcccttcctactcctcatagcatgatattgttctccaaggatgggaatcaggcatgtgtcccttccaagctgtgttaactgttcaaactcaggcctgtgtgactccattggggtgagaggtgaaagcataacatgggtacagaggggacaacaatgaatcagaacagatgctgagccataggtctaaataggatcctggaggctgcctgctgtgctgggaggtataggggtcctgggggcaggccagggcagttgacaggtacttggagggctcagggcagtggcttctttccagtatggaaggatttcaacattttaatagttggttaggctaaactggtgcatactggcattggcccttggtggggagcacagacacaggataggactccatttctttcttccattccttcatgtctaggataacttgctttcttctttcctttactcctggctcaagccctgaatttcttcttttcctgcaggggttgagagctttctgccttagcctaccatgtgaaactctaccctgaagaaagggatggataggaagtagacctctttttcttaccagtctcctcccctactctgcccctaagctggctgtacctgttcctcccccataaaatgatcctgccaatctaa

SEQ ID NO: 3871 - DNA, 1548 bp, Homo sapiens
agctcatactagggacgggaagtcgcgaccagagccattggagggcgcggggactgcaaccctaatcagagcccaaatggcgcagtgggaaatgctgcagaatcttgacagcccctttcaggatcagctgcaccagctttactcgcacagcctcctgcctgtggacattcgacagtacttggctgtctggattgaagaccagaactggcaggaagctgcacttgggagtgatgattccaaggctaccatgctattcttccacttcttggatcagctgaactatgagtgtggccgttgcagccaggacccagagtccttgttgctgcagcacaatttgcggaaattctgccgggacattcaggatcctacccagttggctgagatgatctttaacctccttctggaagaaaaaagaattttgatccaggctcagagggcccaattggaacaaggagagccagttctcgaaacacctgtggagagccagcaacatgagattgaatcccggatcctggatttaagggctatgatggagaagctggtaaaatccatcagccaactgaaagaccagcaggatgtcttctgcttccgatataagatccaggccaaagggaagacaccctctctggacccccatcagaccaaagagcagaagattctgcaggaaactctcaatgaactggacaaaaggagaaaggaggtgctggatgcctccaaagcactgctaggccgattaactaccctaatcgagctactgctgccaaagttggaggagtggaaggcccagcagcaaaaagcctgcatcagagctcccattgaccacgggttggaacagctggagacatggttcacagctggagcaaagctgttgtttcacctgaggcagctgctgaaggagctgaagggactgagttgcctggttagctatcaggatgaccctctgaccaaaggggtggacctacgcaacgcccaggtcacagagttgctacagcgtctgctccacagagcctttgtggtagaaacccagccctgcatgccccaaactccccatcgacccctcatcctcaagactggcagcaagttcaccgtccgaacaaggctgctggtgagactccaggaaggcaatgagtcactgactgtggaagtctccattgacaggaatcctcctcaattacaaggcttccggaagttcaacattctgacttcaaaccagaaaactttgacccccgagaaggggcagagtcagggtttgatttgggactttggttacctgactctggtggagcaacgttcaggtggttcaggaaagggcagcaataaggggccactaggtgtgacagaggaactgcacatcatcagcttcacggtcaaatatacctaccagggtctgaagcaggagctgaaagtgagtgaaaatggagggcaaggagagagaaagcagctttggaagaaggcataagaaggggataaacagaagcctcttgggaaccagcagttcttctccaacccccccaaggccccctggagcttgctgggccctgctctcag

SEQ ID NO: 3872 - DNA, 3073 bp, Homo sapiens
agctcatactagggacgggaagtcgcgaccagagccattggagggcgcggggactgcaaccctaatcagagcccaaatggcgcagtgggaaatgctgcagaatcttgacagcccctttcaggatcagctgcaccagctttactcgcacagcctcctgcctgtggacattcgacagtacttggctgtctggattgaagaccagaactggcaggaagctgcacttgggagtgatgattccaaggctaccatgctattcttccacttcttggatcagctgaactatgagtgtggccgttgcagccaggacccagagtccttgttgctgcagcacaatttgcggaaattctgccgggacattcaggatcctacccagttggctgagatgatctttaacctccttctggaagaaaaaagaattttgatccaggctcagagggcccaattggaacaaggagagccagttctcgaaacacctgtggagagccagcaacatgagattgaatcccggatcctggatttaagggctatgatggagaagctggtaaaatccatcagccaactgaaagaccagcaggatgtcttctgcttccgatataagatccaggccaaagggaagacaccctctctggacccccatcagaccaaagagcagaagattctgcaggaaactctcaatgaactggacaaaaggagaaaggaggtgctggatgcctccaaagcactgctaggccgattaactaccctaatcgagctactgctgccaaagttggaggagtggaaggcccagcagcaaaaagcctgcatcagagctcccattgaccacgggttggaacagctggagacatggttcacagctggagcaaagctgttgtttcacctgaggcagctgctgaaggagctgaagggactgagttgcctggttagctatcaggatgaccctctgaccaaaggggtggacctacgcaacgcccaggtcacagagttgctacagcgtctgctccacagagcctttgtggtagaaacccagccctgcatgccccaaactccccatcgacccctcatcctcaagactggcagcaagttcaccgtccgaacaaggctgctggtgagactccaggaaggcaatgagtcactgactgtggaagtctccattgacaggaatcctcctcaattacaaggcttccggaagttcaacattctgacttcaaaccagaaaactttgacccccgagaaggggcagagtcagggtttgatttgggactttggttacctgactctggtggagcaacgttcaggtggttcaggaaagggcagcaataaggggccactaggtgtgacagaggaactgcacatcatcagcttcacggtcaaatatacctaccagggtctgaagcaggagctgaaaacggacaccctccctgtggtgattatttccaacatgaaccagctctcaattgcctgggcttcagttctctggttcaatttgctcagcccaaaccttcagaaccagcagttcttctccaacccccccaaggccccctggagcttgctgggccctgctctcagttggcagttctcctcctatgttggccgaggcctcaactcagaccagctgagcatgctgagaaacaagctgttcgggcagaactgtaggactgaggatccattattgtcctgggctgacttcactaagcgagagagccctcctggcaagttaccattctggacatggctggacaaaattctggagttggtacatgaccacctgaaggatctctggaatgatggacgcatcatgggctttgtgagtcggagccaggagcgccggctgctgaagaagaccatgtctggcacctttctactgcgcttcagtgaatcgtcagaagggggcattacctgctcctgggtggagcaccaggatgatgacaaggtgctcatctactctgtgcaaccgtacacgaaggaggtgctgcagtcactcccgctgactgaaatcatccgccattaccagttgctcactgaggagaatatacctgaaaacccactgcgcttcctctatccccgaatcccccgggatgaagcttttgggtgctactaccaggagaaagttaatctccaggaacggaggaaatacctgaaacacaggctcattgtggtctctaatagacaggtggatgaactgcaacaaccgctggagcttaagccagagccagagctggagtcattagagctggaactagggctggtgccagagccagagctcagcctggacttagagccactgctgaaggcagggctggatctggggccagagctagagtctgtgctggagtccactctggagcctgtgatagagcccacactatgcatggtatcacaaacagtgccagagccagaccaaggacctgtatcacagccagtgccagagccagatttgccctgtgatctgagacatttgaacactgagccaatggaaatcttcagaaactgtgtaaagattgaagaaatcatgccgaatggtgacccactgttggctggccagaacaccgtggatgaggtttacgtctcccgccccagccacttctacactgatggacccttgatgccttctgacttctaggaaccacatttcctctgttcttttcatatctcttgcccttcctactcctcatagcatgatattgttctccaaggatgggaatcaggcatgtgtcccttccaagctgtgttaactgttcaaactcaggcctgtgtgactccattggggtgagaggtgaaagcataacatgggtacagaggggacaacaatgaatcagaacagatgctgagccataggtctaaataggatcctggaggctgcctgctgtgctgggaggtataggggtcctgggggcaggccagggcagttgacaggtacttggagggctcagggcagtggcttctttccagtatggaaggatttcaacattttaatagttggttaggctaaactggtgcatactggcattggcccttggtggggagcacagacacaggataggactccatttctttcttccattccttcatgtct

SEQ ID NO: 3873 - DNA, 4866 bp, Homo sapiens
cgctgtctctccccctcggctcggagaggcccttcggcctgagggagcctcgccgcccgtccccggcacacgcgcagccccggcctctcggcctctgccggagaaacagttgggacccctgattttagcaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagcgctgccccatacctgaagaccaagtttatctgtgtgacaccaacgacctgcagcaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttcagaggctaggttgtttctgtgggtgccttatcagggctgggatacttctgattctggcttccttcctgccccaccctcccgaccccagtccccctgatcctgctagaggcatgtctccttgcgtgtctaaaggtccctcatcctgtttgttttaggaatcctggtctcaggacctcatggaagaagagggggagagagttacaggttggacatgatgcacactatggggccccagcgacgtgtctggttgagctcagggaatatggttcttagccagtttcttggtgatatccagtggcacttgtaatggcgtcttcattcagttcatgcagggcaaaggcttactgataaacttgagtctgccctcgtatgagggtgtatacctggcctccctctgaggctggtgactcctccctgctggggccccacaggtgaggcagaacagctagagggcctccccgcctgcccgccttggctggctagctcgcctctcctgtgcgtatgggaacacctagcacgtgctggatgggctgcctctgactcagaggcatggccggatttggcaactcaaaaccaccttgcctcagctgatcagagtttctgtggaattctgtttgttaaatcaaattagctggtctctgaattaagggggagacgaccttctctaagatgaacagggttcgccccagtcctcctgcctggagacagttgatgtgtcatgcagagctcttacttctccagcaacactcttcagtacataataagcttaactgataaacagaatatttagaaaggtgagacttgggcttaccattgggtttaaatcatagggacctagggcgagggttcagggcttctctggagcagatattgtcaagttcatggccttaggtagcatgtatctggtcttaactctgattgtagcaaaagttctgagaggagctgagccctgttgtggcccattaaagaacagggtcctcaggccctgcccgcttcctgtccactgccccctccccatccccagcccagccgagggaatcccgtgggttgcttacctacctataaggtggtttataagctgctgtcctggccactgcattcaaattccaatgtgtacttcatagtgtaaaaatttatattattgtgaggttttttgtcttttttttttttttttttttttggtatattgctgtatctactttaacttccagaaataaacgttatataggaaccgtc

SEQ ID NO: 3874 - DNA, 2615 bp, Homo sapiens
gggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacagggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagcgctgccccatacctgaagaccaagtttatctgtgtgacaccaacgacctgcagcaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggag

SEQ ID NO: 3875 - DNA, 2633 bp, Homo sapiens
ggatcctggacaggcaccccggcttggcgctgtctctccccctcggctcggagaggcccttcggcctgagggagcctcgccgcccgtccccggcacacgcgcagccccggcctctcggcctctgccggagaaacaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggcgctgccccatacctgaagaccaagtttatctgtgtgacaccaacgacctgcagcaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaa

SEQ ID NO: 3876 - DNA, 3319 bp, Homo sapiens
gcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacagcaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagcgctgccccatacctgaagaccaagtttatctgtgtgacaccattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaa

SEQ ID NO: 3877 - DNA, 2769 bp, Homo sapiens
aaggctactcaaggagagtaggaggaggctaggtcaggaagggcaagcactggtggcctacccaggacttggcccaaccctctgggtcaggtcaccctcgtcggagtgagcggaccccgctggaattggagcccagtaaggtctatgagtttggtgttttgatcctggctacccatcccttccatcccaggggtggttcaccaggctgagtggagccttatactagggagagaggaagctgaagaactgggctccagcatgtctcagtggaatcaagtccaacagttagaaatcaagtttttggagcaggtggatcaattctatgatgacaactttcccatggaaattcggcatctgttggcccaatggattgaaaatcaagactgggaggcagcttctaacaatgaaaccatggcaacgattcttcttcaaaacttgttaatacaactggatgaacagttaggtcgtgtttccaaagagaaaaacctactcttgatacacaatctaaaaagaattaggaaggtccttcagggaaaatttcatggaaatccaatgcatgtagctgtggttatttcaaactgtttaagggaagagaggagaatattggctgcagccaacatgcctgtccaggggcctctagagaaatccttacaaagttcttcagtttcagaaagacagaggaatgtggagcacaaagtggctgccattaaaaacagtgtgcagatgacagaacaagataccaaatacttagaagatctgcaagacgaatttgactacaggtataaaacaattcagacaatggatcagagtgacaagaatagtgccatggtgaatcaggaagttttgacactgcaggaaatgcttaacagcctcgatttcaagagaaaggaggctctcagtaaaatgacccaaatcatccatgagacagacctgttaatgaacaccatgctcatagaagagctgcaagactggaagcggcggcagcaaatcgcctgcatcgggggtccactccacaatgggctcgaccagcttcagaactgctttacactattggcagaaagtcttttccaactgagaaggcaattggagaaactagaggagcaatctaccaaaatgacatatgaaggtgatcccattccaatgcaaagaactcacatgctagaaagagtcaccttcttgatctacaaccttttcaagaactcatttgtggttgagcgacagccatgtatgccaacccaccctcagaggccgttggtacttaaaaccctaattcagttcactgtaaaactaaggctactaataaaattgccagaactaaactatcaggtaaaggttaaggcatcaattgacaagaatgtttcaactctaagcaaccgaagatttgtactttgtggaactaatgtcaaagccatgtctattgaagaatcttccaatgggagtctctcagtagaatttcgacatttgcaaccaaaggaaatgaagtccagtgctggaggtaaaggaaatgagggctgtcacatggtgactgaagaacttcattccataacgtttgaaacacagatctgcctctatggcctgaccatagatttggagaccagctcattgcctgtggtgatgatttccaatgtcagtcagttacctaatgcttgggcatccatcatttggtacaacgtgtcaaccaacgattcccagaacttggttttctttaataatcctccacctgccacattgagtcaactactggaggtgatgagctggcagttttcatcgtacgttggtcgtggtcttaactcagatcaactccatatgctggcagagaagcttacagtccaatctagctacagtgatggtcacctcacctgggccaagttctgcaaggaacatttacctggtaaatcatttaccttttggacatggcttgaagcaatattggatctaattaagaaacacattcttcccctttggattgatgggtatgtcatgggctttgttagcaaagagaaggaacggctgttgctaaaggataaaatgcctggcacctttttattaagattcagtgaaagccatctcggaggaataactttcacctgggtggaccattctgaaagtggggaagtgagattccactctgtagaaccctacaataaaggccggttgtctgctctgccattcgctgacatcctgcgagactacaaagttattatggctgaaaacattcctgaaaaccctctgaagtacctatatcctgacattcccaaagacaaagccttcggtaaacactacagctctcagccttgcgaagtttcaagaccaacagaaaggggtgacaaaggttatgttccttctgtttttatccccatctcaacaatccgaagtgattcaacagagccacattctccatcagaccttcttcccatgtctccaagtgtgtatgcggtgttgagagaaaacctgagtcccacaacaattgaaactgcaatgaagtctccttattctgctgaatgacaggataaactctgacgcaccaagaaaggaagcaaatgaaaaagtttaaagactgttctttgcccaataaccacattttatttcttcagctttgtaaataccaggttctaggaaatgtttgacatctgaagctctcttcacactcccgtggcactcctcaattgggagtgttgtgactgaaatgcttgaaaccaaagcttcagataaacttgcaagataagacaactttaagaaaccagtgttaataacaatattaacagaaga

SEQ ID NO: 3878 - DNA, 2822 bp, Homo sapiens
tttttcctggcactgctgagccacctgcagttgcgagagccgctgggagggataagagggaagaggacgcccggtgaaggggctccagcctggcagtttctgcgtgttagcatttctagaatagagtgggtgggaactgacccaagtaaagtcccagagactcgaacactgacgcacaggaaagcctcaagtgggaggagaaatgcaaatcccctactgatgatggcgtcagcggctttctcctagggactgtgaggggcgcttctgactttggacttgagcactgcctgggacctgtgctgagagagcgctagcatgtctcagtggaatcaagtccaacagttagaaatcaagtttttggagcaggtggatcaattctatgatgacaactttcccatggaaattcggcatctgttggcccaatggattgaaaatcaagactgggaggcagcttctaacaatgaaaccatggcaacgattcttcttcaaaacttgttaatacaactggatgaacagttaggtcgtgtttccaaagagaaaaacctactcttgatacacaatctaaaaagaattaggaaggtccttcagggaaaatttcatggaaatccaatgcatgtagctgtggttatttcaaactgtttaagggaagagaggagaatattggctgcagccaacatgcctgtccaggggcctctagagaaatccttacaaagttcttcagtttcagaaagacagaggaatgtggagcacaaagtggctgccattaaaaacagtgtgcagatgacagaacaagataccaaatacttagaagatctgcaagacgaatttgactacaggtataaaacaattcagacaatggatcagagtgacaagaatagtgccatggtgaatcaggaagttttgacactgcaggaaatgcttaacagcctcgatttcaagagaaaggaggctctcagtaaaatgacccaaatcatccatgagacagacctgttaatgaacaccatgctcatagaagagctgcaagactggaagcggcggcagcaaatcgcctgcatcgggggtccactccacaatgggctcgaccagcttcagaactgctttacactattggcagaaagtcttttccaactgagaaggcaattggagaaactagaggagcaatctaccaaaatgacatatgaaggtgatcccattccaatgcaaagaactcacatgctagaaagagtcaccttcttgatctacaaccttttcaagaactcatttgtggttgagcgacagccatgtatgccaacccaccctcagaggccgttggtacttaaaaccctaattcagttcactgtaaaactaaggctactaataaaattgccagaactaaactatcaggtaaaggttaaggcatcaattgacaagaatgtttcaactctaagcaaccgaagatttgtactttgtggaactaatgtcaaagccatgtctattgaagaatcttccaatgggagtctctcagtagaatttcgacatttgcaaccaaaggaaatgaagtccagtgctggaggtaaaggaaatgagggctgtcacatggtgactgaagaacttcattccataacgtttgaaacacagatctgcctctatggcctgaccatagatttggagaccagctcattgcctgtggtgatgatttccaatgtcagtcagttacctaatgcttgggcatccatcatttggtacaacgtgtcaaccaacgattcccagaacttggttttctttaataatcctccacctgccacattgagtcaactactggaggtgatgagctggcagttttcatcgtacgttggtcgtggtcttaactcagatcaactccatatgctggcagagaagcttacagtccaatctagctacagtgatggtcacctcacctgggccaagttctgcaaggaacatttacctggtaaatcatttaccttttggacatggcttgaagcaatattggatctaattaagaaacacattcttcccctttggattgatgggtatgtcatgggctttgttagcaaagagaaggaacggctgttgctaaaggataaaatgcctggcacctttttattaagattcagtgaaagccatctcggaggaataactttcacctgggtggaccattctgaaagtggggaagtgagattccactctgtagaaccctacaataaaggccggttgtctgctctgccattcgctgacatcctgcgagactacaaagttattatggctgaaaacattcctgaaaaccctctgaagtacctatatcctgacattcccaaagacaaagccttcggtaaacactacagctctcagccttgcgaagtttcaagaccaacagaaaggggtgacaaaggttatgttccttctgtttttatccccatctcaacaatccgaagtgattcaacagagccacattctccatcagaccttcttcccatgtctccaagtgtgtatgcggtgttgagagaaaacctgagtcccacaacaattgaaactgcaatgaagtctccttattctgctgaatgacaggataaactctgacgcaccaagaaaggaagcaaatgaaaaagtttaaagactgttctttgcccaataaccacattttatttcttcagctttgtaaataccaggttctaggaaatgtttgacatctgaagctctcttcacactcccgtggcactcctcaattgggagtgttgtgactgaaatgcttgaaaccaaagcttcagataaacttgcaagataagacaactttaagaaaccagtgttaataacaatattaacag

SEQ ID NO: 3879 - DNA, 709 bp, Homo sapiens
gggacctgtgctgagagagcgctagcatgtctcagtggaatcaagtccaacagttagaaatcaagtttttggagcaggtggatcaattctatgatgacaactttcccatggaaattcggcatctgttggcccaatggattgaaaatcaagactgggaggcagcttctaacaatgaaaccatggcaacgattcttcttcaaaacttgttaatacaactggatgaacagttaggtcgtgtttccaaagagaaaaacctactcttgatacacaatctaaaaagaattaggaaggtccttcagtccccagggttggctacagcacagctgcccttggatcgacatggagaaacctgcattcaaaggtccaaatcttgtccctaggacttagcttcttcacctgggacattcagatgatactaattgaggaaaccaagatacaggaatttagtacccatctattccttctaatacaaaacatcggagaattctggcttttgcaaactgttgttgacattttatacccagatgttaccattacctttgaagcctcttgtgcctcctccctgacaccactctgctctctttccgcctggagcaaccactgacccaaaatttgcatttgtcattttttttctttttgttgccattttaccacatacatttgcatccctaaacaataaagtgtctaggtttgaaagctgctaaatcca

SEQ ID NO: 3880 - DNA, 474 bp, Homo sapiens
ggggcaaggctactcaaggagagtaggaggaggctaggtcaggaagggcaagcactggtggcctacccaggacttggcccaaccctctgggtcaggtcaccctcgtcggagtgagcggaccccgctggaattggagcccagtaaggtctatgagtttggtgttttgatcctggctacccatcccttccatcccaggggtggttcaccaggctgagtggagccttatactagggagagaggaagctgaagaactgggctccaggaaagcctcaagtgggaggagaaatgcaaatcccctactgatgatggcgtcagcggctttctcctagggactgtgaggggcgcttctgactttggacttgagcactgcctgggacctgtgctgagagagcgctagcatgtctcagtggaatcaagtccaacagttagaaatcaagtttttggagcaggtggatcaattctatgatgacaact

SEQ ID NO: 3881 - DNA, 569 bp, Homo sapiens
aggggcaaggctactcaaggagagtaggaggaggctaggtcaggaagggcaagcactggtggcctacccaggacttggcccaaccctctgggtcaggtcaccctcgtcggagtgagcggaccccgctggaattggagcccagtaaggtctatgagtttggtgttttgatcctggctacccatcccttccatcccaggggtggttcaccaggctgagtggagccttatactagggagagaggaagctgaagaactgggctccagggactgtgaggggcgcttctgactttggacttgagcactgcctgggacctgtgctgagagagcgctagcatgtctcagtggaatcaagtccaacagttagaaatcaagtttttggagcaggtggatcaattctatgatgacaactttcccatggaaattcggcatctgttggcccaatggattgaaaatcaagactgggaggcagcttctaacaatgaaaccatggcaacgattcttcttcaaaacttgttaatacaactggatgaacagttaggtcgtgtttccaaagagaaaaacctactcttg

SEQ ID NO: 3882 - DNA, 4301 bp, Homo sapiens
agacaggatattcactgctgtggcaaggcctgtagagagtttcgaagttaggaggactcaagacggtccctccctggacttttctgaaggggctcaaaagatgacacgcgccagagctggaaggcgtcgccaattggtccacttttccctcctccctttttgcggatgagaaaactgaggcccaggtttgggatttccagagcccgggatttcccggcaacgcccgacaaccacattcccccggctattctgacccgccccggttccgggacgctccctgggagccgccgccgagggcctgctgggactcccgggggaccccgccgtcggggcagcccccacgcccggcgccgcccgccgggaacggccgccgctgttgcgcacttgcaggggagccggcgactgagggcgaggcagggagggagcaagcggggctgggagggctgctggcgcgggctcgcgcgctgtgtatggtctatcgcaggcagctgacctttgaggaggaaatcgctgctctccgctccttcctgtagtaacagccgccgctgccgccgccgccaggaaccccggccgggagcgagagccgcggggcgcagagccggcccggctgccggacggtgcggccccaccaggtgaacggccatggcgggctggatccaggcccagcagctgcagggagacgcgctgcgccagatgcaggtgctgtacggccagcacttccccatcgaggtccggcactacttggcccagtggattgagagccagccatgggatgccattgacttggacaatccccaggacagagcccaagccacccagctcctggagggcctggtgcaggagctgcagaagaaggcggagcaccaggtgggggaagatgggtttttactgaagatcaagctggggcactacgccacgcagctccagaaaacatatgaccgctgccccctggagctggtccgctgcatccggcacattctgtacaatgaacagaggctggtccgagaagccaacaattgcagctctccggctgggatcctggttgacgccatgtcccagaagcaccttcagatcaaccagacatttgaggagctgcgactggtcacgcaggacacagagaatgagctgaagaaactgcagcagactcaggagtacttcatcatccagtaccaggagagcctgaggatccaagctcagtttgcccagctggcccagctgagcccccaggagcgtctgagccgggagacggccctccagcagaagcaggtgtctctggaggcctggttgcagcgtgaggcacagacactgcagcagtaccgcgtggagctggccgagaagcaccagaagaccctgcagctgctgcggaagcagcagaccatcatcctggatgacgagctgatccagtggaagcggcggcagcagctggccgggaacggcgggccccccgagggcagcctggacgtgctacagtcctggtgtgagaagttggccgagatcatctggcagaaccggcagcagatccgcagggctgagcacctctgccagcagctgcccatccccggcccagtggaggagatgctggccgaggtcaacgccaccatcacggacattatctcagccctggtgaccagcacattcatcattgagaagcagcctcctcaggtcctgaagacccagaccaagtttgcagccaccgtacgcctgctggtgggcgggaagctgaacgtgcacatgaatcccccccaggtgaaggccaccatcatcagtgagcagcaggccaagtctctgcttaaaaatgagaacacccgcaacgagtgcagtggtgagatcctgaacaactgctgcgtgatggagtaccaccaagccacgggcaccctcagtgcccacttcaggaacatgtcactgaagaggatcaagcgtgctgaccggcggggtgcagagtccgtgacagaggagaagttcacagtcctgtttgagtctcagttcagtgttggcagcaatgagcttgtgttccaggtgaagactctgtccctacctgtggttgtcatcgtccacggcagccaggaccacaatgccacggctactgtgctgtgggacaatgcctttgctgagccgggcagggtgccatttgccgtgcctgacaaagtgctgtggccgcagctgtgtgaggcgctcaacatgaaattcaaggccgaagtgcagagcaaccggggcctgaccaaggagaacctcgtgttcctggcgcagaaactgttcaacaacagcagcagccacctggaggactacagtggcctgtccgtgtcctggtcccagttcaacagggagaacttgccgggctggaactacaccttctggcagtggtttgacggggtgatggaggtgttgaagaagcaccacaagccccactggaatgatggggccatcctaggttttgtgaataagcaacaggcccacgacctgctcatcaacaagcccgacgggaccttcttgttgcgctttagtgactcagaaatcgggggcatcaccatcgcctggaagtttgactccccggaacgcaacctgtggaacctgaaaccattcaccacgcgggatttctccatcaggtccctggctgaccggctgggggacctgagctatctcatctatgtgtttcctgaccgccccaaggatgaggtcttctccaagtactacactcctgtgctggctaaagctgttgatggatatgtgaaaccacagatcaagcaagtggtccctgagtttgtgaatgcatctgcagatgctgggggcagcagcgccacgtacatggaccaggccccctccccagctgtgtgcccccaggctccctataacatgtacccacagaaccctgaccatgtactcgatcaggatggagaattcgacctggatgagaccatggatgtggccaggcacgtggaggaactcttacgccgaccaatggacagtcttgactcccgcctctcgccccctgccggtcttttcacctctgccagaggctccctctcatgaatgtttgaatcccacgcttctctttggaaacaatatgcaatgtgaagcggtcgtgttgtgagtttagtaaggctgtgtacactgacacctttgcaggcatgcatgtgcttgtgtgtgtgtgtgtgtgtgtgtccttgtgcatgagctacgcctgcctcccctgtgcagtcctgggatgtggctgcagcagcggtggcctcttttcagatcatggcatccaagagtgcgccgagtctgtctctgtcatggtagagaccgagcctctgtcactgcaggcactcaatgcagccagacctattcctcctgggcccctcatctgctcagcagctatttgaatgagatgattcagaaggggaggggagacaggtaacgtctgtaagctgaagtttcactccggagtgagaagctttgccctcctaagagagagagacagagagacagagagagagaaagagagagtgtgtgggtctatgtaaatgcatctgtcctcatgtgttgatgtaaccgattcatctctcagaagggaggctggggttcattttcgagtagtattttatactttagtgaacgtggactccagactctctgtgaaccctatgagagcgcgtctgggcccggccatgtccttagcacaggggggccgccggtttgagtgagggtttctgagctgctctgaattagtccttgcttggctgcttggccttgggcttcattcaagtctatgatgctgttgcccacgtttcccgggatatatattctctcccctccgttgggccccagccttctttgcttgcctctctgtttgtaaccttgtcgacaaagaggtagaaaagattgggtctaggatatggtgggtggacaggggccccgggacttggagggttggtcctcttgcctcctggaaaaaacaaaaacaaaaaactgcagtgaaagacaagctgcaaatcagccatgtgctgcgtgcctgtggaatctggagtgaggggtaaaagctgatctggtttgactccgctggaggtggggcctggagcaggccttgcgctgttgcgtaactggctgtgttctggtgaggccttgctcccaaccccacacgctcctccctctgaggctgtaggactcgcagtcaggggcagctgaccatggaagattgagagcccaaggtttaaacttctctgaagggaggtggggatgagaagaggggtttttttgtactttgtacaaagaccacacatttgtgtaaacagtgttttggaataaaatatttttttcataaa

SEQ ID NO: 3883 - DNA, 515 bp, Homo sapiens
aacagccgccgctgccgccgccgccaggaaccccggccgggagcgagagccgcggggcgcagagccggcccggctgccggacggtgcggccccaccagaggagagcgcttcagcgctcggctcgccctaggtgaacggccatggcgggctggatccaggcccagcagctgcagggagacgcgctgcgccagatgcaggtgctgtacggccagcacttccccatcgaggtccggcactacttggcccagtggattgagagccagccatgggatgccattgacttggacaatccccaggacagagcccaagccacccagctcctggagggcctggtgcaggagctgcagaagaaggcggagcaccaggtgggggaagatgggtttttactgaagatcaagctggggcactacgccacgcagctccagaaaacatatgaccgctgccccctggagctggtccgctgcatccggcacattctgtacaatgaacagaggctggtccgagaagccaacaat

SEQ ID NO: 3884 - DNA, 3755 bp, Homo sapiens
gtaacagccgccgctgccgccgccgccaggaaccccggccgggagcgagagccgcggggcgcagagccggcccggctgccggacggtgcggccccaccaggtgaacggccatggcgggctggatccaggcccagcagctgcagggagacgcgctgcgccagatgcaggtgctgtacggccagcacttccccatcgaggtccggcactacttggcccagtggattgagagccagccatgggatgccattgacttggacaatccccaggacagagcccaagccacccagctcctggagggcctggtgcaggagctgcagaagaaggcggagcaccaggtgggggaagatgggtttttactgaagatcaagctggggcactacgccacgcagctccagaaaacatatgaccgctgccccctggagctggtccgctgcatccggcacattctgtacaatgaacagaggctggtccgagaagccaacaattgcagctctccggctgggatcctggttgacgccatgtcccagaagcaccttcagatcaaccagacatttgaggagctgcgactggtcacgcaggacacagagaatgagctgaagaaactgcagcagactcaggagtacttcatcatccagtaccaggagagcctgaggatccaagctcagtttgcccagctggcccagctgagcccccaggagcgtctgagccgggagacggccctccagcagaagcaggtgtctctggaggcctggttgcagcgtgaggcacagacactgcagcagtaccgcgtggagctggccgagaagcaccagaagaccctgcagctgctgcggaagcagcagaccatcatcctggatgacgagctgatccagtggaagcggcggcagcagctggccgggaacggcgggccccccgagggcagcctggacgtgctacagtcctggtgtgagaagttggccgagatcatctggcagaaccggcagcagatccgcagggctgagcacctctgccagcagctgcccatccccggcccagtggaggagatgctggccgaggtcaacgccaccatcacggacattatctcagccctggtgaccagcacattcatcattgagaagcagcctcctcaggtcctgaagacccagaccaagtttgcagccaccgtacgcctgctggtgggcgggaagctgaacgtgcacatgaatcccccccaggtgaaggccaccatcatcagtgagcagcaggccaagtctctgcttaaaaatgagaacacccgcaacgagtgcagtggtgagatcctgaacaactgctgcgtgatggagtaccaccaagccacgggcaccctcagtgcccacttcaggaacatgtcactgaagaggatcaagcgtgctgaccggcggggtgcagagtccgtgacagaggagaagttcacagtcctgtttgagtctcagttcagtgttggcagcaatgagcttgtgttccaggtgaagactctgtccctacctgtggttgtcatcgtccacggcagccaggaccacaatgccacggctactgtgctgtgggacaatgcctttgctgagccgggcagggtgccatttgccgtgcctgacaaagtgctgtggccgcagctgtgtgaggcgctcaacatgaaattcaaggccgaagtgcagagcaaccggggcctgaccaaggagaacctcgtgttcctggcgcagaaactgttcaacaacagcagcagccacctggaggactacagtggcctgtccgtgtcctggtcccagttcaacagggagaacttgccgggctggaactacaccttctggcagtggtttgacggggtgatggaggtgttgaagaagcaccacaagccccactggaatgatggtggttttgtgaataagcaacaggcccacgacctgctcatcaacaagcccgacgggaccttcttgttgcgctttagtgactcagaaatcgggggcatcaccatcgcctggaagtttgactccccggaacgcaacctgtggaacctgaaaccattcaccacgcgggatttctccatcaggtccctggctgaccggctgggggacctgagctatctcatctatgtgtttcctgaccgccccaaggatgaggtcttctccaagtactacactcctgtgctggctaaagctgttgatggatatgtgaaaccacagatcaagcaagtggtccctgagtttgtgaatgcatctgcagatgctgggggcagcagcgccacgtacatggaccaggccccctccccagctgtgtgcccccaggctccctataacatgtacccacagaaccctgaccatgtactcgatcaggatggagaattcgacctggatgagaccatggatgtggccaggcacgtggaggaactcttacgccgaccaatggacagtcttgactcccgcctctcgccccctgccggtcttttcacctctgccagaggctccctctcatgaatgtttgaatcccacgcttctctttggaaacaatatgcaatgtgaagcggtcgtgttgtgagtttagtaaggctgtgtacactgacacctttgcaggcatgcatgtgcttgtgtgtgtgtgtgtgtgtgtgtccttgtgcatgagctacgcctgcctcccctgtgcagtcctgggatgtggctgcagcagcggtggcctcttttcagatcatggcatccaagagtgcgccgagtctgtctctgtcatggtagagaccgagcctctgtcactgcaggcactcaatgcagccagacctattcctcctgggcccctcatctgctcagcagctatttgaatgagatgattcagaaggggaggggagacaggtaacgtctgtaagctgaagtttcactccggagtgagaagctttgccctcctaagagagagagacagagagacagagagagagaaagagagagtgtgtgggtctatgtaaatgcatctgtcctcatgtgttgatgtaaccgattcatctctcagaagggaggctggggttcattttcgagtagtattttatactttagtgaacgtggactccagactctctgtgaaccctatgagagcgcgtctgggcccggccatgtccttagcacaggggggccgccggtttgagtgagggtttctgagctgctctgaattagtccttgcttggctgcttggccttgggcttcattcaagtctatgatgctgttgcccacgtttcccgggatatatattctctcccctccgttgggccccagccttctttgcttgcctctctgtttgtaaccttgtcgacaaagaggtagaaaagattgggtctaggatatggtgggtggacaggggccccgggacttggagggttggtcctcttgcctcctggaaaaaacaaaaacaaaaaactgcagtgaaagacaagctgcaaatcagccatgtgctgcgtgcctgtggaatctggagtgaggggtaaaagctgatctggtttgactccgctggaggtggggcctggagcaggccttgcgctgttgcgtaactggctgtgttctggtgaggccttgctcccaaccccacacgctcctccctctgaggctgtaggactcgcagtcaggggcagctgaccatggaagattgagagcccaaggtttaaacttctctgaagggaggtggggatgagaagaggggtttttttgtactttgtacaaagaccacacatttgtgtaaacagtgttttggaataaaatatttttttc

SEQ ID NO: 3885 - DNA, 3671 bp, Homo sapiens
gtaacagccgccgctgccgccgccgccaggaaccccggccgggagcgagagccgcggggcgcagagccggcccggctgccggacggtgcggccccaccaggtgaacggccatggcgggctggatccaggcccagcagctgcagggagacgcgctgcgccagatgcaggtgctgtacggccagcacttccccatcgaggtccggcactacttggcccagtggattgagagccagccatgggatgccattgacttggacaatccccaggacagagcccaagccacccagctcctggagggcctggtgcaggagctgcagaagaaggcggagcaccaggtgggggaagatgggtttttactgaagatcaagctggggcactacgccacgcagctccagaaaacatatgaccgctgccccctggagctggtccgctgcatccggcacattctgtacaatgaacagaggctggtccgagaagccaacaattgcagctctccggctgggatcctggttgacgccatgtcccagaagcaccttcagatcaaccagacatttgaggagctgcgactggtcacgcaggacacagagaatgagctgaagaaactgcagcagactcaggagtacttcatcatccagtaccaggagagcctgaggatccaagctcagtttgcccagctggcccagctgagcccccaggagcgtctgagccgggagacggccctccagcagaagcaggtgtctctggaggcctggttgcagcgtgaggcacagacactgcagcagtaccgcgtggagctggccgagaagcaccagaagaccctgcagctgctgcggaagcagcagaccatcatcctggatgacgagctgatccagtggaagcggcggcagcagctggccgggaacggcgggccccccgagggcagcctggacgtgctacagtcctggtgtgagaagttggccgagatcatctggcagaaccggcagcagatccgcagggctgagcacctctgccagcagctgcccatccccggcccagtggaggagatgctggccgaggtcaacgccaccatcacggacattatctcagccctggtgaccagcacattcatcattgagaagcagcctcctcaggtcctgaagacccagaccaagtttgcagccaccgtacgcctgctggtgggcgggaagctgaacgtgcacatgaatcccccccaggtgaaggccaccatcatcagtgagcagcaggccaagtctctgcttaaaaatgagaacacccgcaacgagtgcagtggtgagatcctgaacaactgctgcgtgatggagtaccaccaagccacgggcaccctcagtgcccacttcaggaacatgtcactgaagaggatcaagcgtgctgaccggcggggtgcagagtccgtgacagaggagaagttcacagtcctgtttgagtctcagttcagtgttggcagcaatgagcttgtgttccaggtgaagggcagggtgccatttgccgtgcctgacaaagtgctgtggccgcagctgtgtgaggcgctcaacatgaaattcaaggccgaagtgcagagcaaccggggcctgaccaaggagaacctcgtgttcctggcgcagaaactgttcaacaacagcagcagccacctggaggactacagtggcctgtccgtgtcctggtcccagttcaacagggagaacttgccgggctggaactacaccttctggcagtggtttgacggggtgatggaggtgttgaagaagcaccacaagccccactggaatgatggggccatcctaggttttgtgaataagcaacaggcccacgacctgctcatcaacaagcccgacgggaccttcttgttgcgctttagtgactcagaaatcgggggcatcaccatcgcctggaagtttgactccccggaacgcaacctgtggaacctgaaaccattcaccacgcgggatttctccatcaggtccctggctgaccggctgggggacctgagctatctcatctatgtgtttcctgaccgccccaaggatgaggtcttctccaagtactacactcctgtgctggctaaagctgttgatggatatgtgaaaccacagatcaagcaagtggtccctgagtttgtgaatgcatctgcagatgctgggggcagcagcgccacgtacatggaccaggccccctccccagctgtgtgcccccaggctccctataacatgtacccacagaaccctgaccatgtactcgatcaggatggagaattcgacctggatgagaccatggatgtggccaggcacgtggaggaactcttacgccgaccaatggacagtcttgactcccgcctctcgccccctgccggtcttttcacctctgccagaggctccctctcatgaatgtttgaatcccacgcttctctttggaaacaatatgcaatgtgaagcggtcgtgttgtgagtttagtaaggctgtgtacactgacacctttgcaggcatgcatgtgcttgtgtgtgtgtgtgtgtgtgtgtccttgtgcatgagctacgcctgcctcccctgtgcagtcctgggatgtggctgcagcagcggtggcctcttttcagatcatggcatccaagagtgcgccgagtctgtctctgtcatggtagagaccgagcctctgtcactgcaggcactcaatgcagccagacctattcctcctgggcccctcatctgctcagcagctatttgaatgagatgattcagaaggggaggggagacaggtaacgtctgtaagctgaagtttcactccggagtgagaagctttgccctcctaagagagagagacagagagacagagagagagaaagagagagtgtgtgggtctatgtaaatgcatctgtcctcatgtgttgatgtaaccgattcatctctcagaagggaggctggggttcattttcgagtagtattttatactttagtgaacgtggactccagactctctgtgaaccctatgagagcgcgtctgggcccggccatgtccttagcacaggggggccgccggtttgagtgagggtttctgagctgctctgaattagtccttgcttggctgcttggccttgggcttcattcaagtctatgatgctgttgcccacgtttcccgggatatatattctctcccctccgttgggccccagccttctttgcttgcctctctgtttgtaaccttgtcgacaaagaggtagaaaagattgggtctaggatatggtgggtggacaggggccccgggacttggagggttggtcctcttgcctcctggaaaaaacaaaaacaaaaaactgcagtgaaagacaagctgcaaatcagccatgtgctgcgtgcctgtggaatctggagtgaggggtaaaagctgatctggtttgactccgctggaggtggggcctggagcaggccttgcgctgttgcgtaactggctgtgttctggtgaggccttgctcccaaccccacacgctcctccctctgaggctgtaggactcgcagtcaggggcagctgaccatggaagattgagagcccaaggtttaaacttctctgaagggaggtggggatgagaagaggggtttttttgtactttgtacaaagaccacacatttgtgtaaacagtgttttggaataaaatatttttttc

SEQ ID NO: 3886 - DNA, 2653 bp, Homo sapiens
agtaacagccgccgctgccgccgccgccaggaaccccggccgggagcgagagccgcggggcgcagagccggcccggctgccggacggtgcggccccaccaggtgaacggccatggcgggctggatccaggcccagcagctgcagggagacgcgctgcgccagatgcaggtgctgtacggccagcacttccccatcgaggtccggcactacttggcccagtggattgagagccagccatgggatgccattgacttggacaatccccaggacagagcccaagccacccagctcctggagggcctggtgcaggagctgcagaagaaggcggagcaccaggtgggggaagatgggtttttactgaagatcaagctggggcactacgccacgcagctccagtgcagctctccggctgggatcctggttgacgccatgtcccagaagcaccttcagatcaaccagacatttgaggagctgcgactggtcacgcaggacacagagaatgagctgaagaaactgcagcagactcaggagtacttcatcatccagtaccaggagagcctgaggatccaagctcagtttgcccagctggcccagctgagcccccaggagcgtctgagccgggagacggccctccagcagaagcaggtgtctctggaggcctggttgcagcgtgaggcacagacactgcagcagtaccgcgtggagctggccgagaagcaccagaagaccctgcagctgctgcggaagcagcagaccatcatcctggatgacgagctgatccagtggaagcggcggcagcagctggccgggaacggcgggccccccgagggcagcctggacgtgctacagtcctggtgtgagaagttggccgagatcatctggcagaaccggcagcagatccgcagggctgagcacctctgccagcagctgcccatccccggcccagtggaggagatgctggccgaggtcaacgccaccatcacggacattatctcagccctggtgaccagcacattcatcattgagaagcagcctcctcaggtcctgaagacccagaccaagtttgcagccaccgtacgcctgctggtgggcgggaagctgaacgtgcacatgaatcccccccaggtgaaggccaccatcatcagtgagcagcaggccaagtctctgcttaaaaatgagaacacccgcaacgagtgcagtggtgagatcctgaacaactgctgcgtgatggagtaccaccaagccacgggcaccctcagtgcccacttcaggaacatgtcactgaagaggatcaagcgtgctgaccggcggggtgcagagtccgtgacagaggagaagttcacagtcctgtttgagtctcagttcagtgttggcagcaatgagcttgtgttccaggtgaagactctgtccctacctgtggttgtcatcgtccacggcagccaggaccacaatgccacggctactgtgctgtgggacaatgcctttgctgagccgggcagggtgccatttgccgtgcctgacaaagtgctgtggccgcagctgtgtgaggcgctcaacatgaaattcaaggccgaagtgcagagcaaccggggcctgaccaaggagaacctcgtgttcctggcgcagaaactgttcaacaacagcagcagccacctggaggactacagtggcctgtccgtgtcctggtcccagttcaacagggagaacttgccgggctggaactacaccttctggcagtggtttgacggggtgatggaggtgttgaagaagcaccacaagccccactggaatgatggggccatcctaggttttgtgaataagcaacaggcccacgacctgctcatcaacaagcccgacgggaccttcttgttgcgctttagtgactcagaaatcgggggcatcaccatcgcctggaagtttgactccccggaacgcaacctgtggaacctgaaaccattcaccacgcgggatttctccatcaggtccctggctgaccggctgggggacctgagctatctcatctatgtgtttcctgaccgccccaaggatgaggtcttctccaagtactacactcctgtgctggctaaagctgttgatggatatgtgaaaccacagatcaagcaagtggtccctgagtttgtgaatgcatctgcagatgctgggggcagcagcgccacgtacatggaccaggccccctccccagctgtgtgcccccaggctccctataacatgtacccacagaaccctgaccatgtactcgatcaggatggagaattcgacctggatgagaccatggatgtggccaggcacgtggaggaactcttacgccgaccaatggacagtcttgactcccgcctctcgccccctgccggtcttttcacctctgccagaggctccctctcatgaatgtttgaatcccacgcttctctttggaaacaatatgcaatgtgaagcggtcgtgttgtgagtttagtaaggctgtgtacactgacacctttgcaggcatgcatgtgcttgtgtgtgtgtgtgtgtgtgtgtccttgtgcatgagctacgcctgcctcccctgtgcagtcctgggatgtggctgcagcagcggtggcctcttttcagatcatggcatccaagagtgcgccgagtctgtctctgtcat

SEQ ID NO: 3887 - DNA, 2653 bp, Homo sapiens; identical to SEQ ID NO: 3886
